United States Patent 7,745,391 (HUMAN THROMBOSPONDIN POLYPEPTIDE) - sequence listing, part 49

SEQ ID NO: 133857 - DNA, 1926 bp, Homo sapiens
gcctgttgcttcagcctgagctcggttagggcctcacttccctgcttccacacctcagggaggcctcggtgattttgccagagcctcagcctccatcgctctgtaacctgcgggtattggatgattcgtagctaagacttcgcgacacccttgaagctgagaaatggaacccttaacattcagggatgtggccatagaattctctccagaagagtggaaatgcctggaccctgcccagcagaatttgtatagagatgtgatgttggagaactacagaaacctggtctccctagaggaaggaacagagccacagagaaaaatgacttgctcacaacagaagagccagtagtaaaacacaggtgtctggaaatgaagtatggaaatgaaatcatgaataaagacccagttttcagaatctctccacgaagtagaggaactcataccaatccagaagagcctgaagaagatgttcaagctgaaagagtccaagcagcaaatgcactcactactccaaacttggaggaggaaccagtcataactgcaagctgtttacacaaggaatattatgagacaaagaaagttgcttttcaacaacaaagaagaaagcagccatcagaaatgtttcgttttgtgttaaaaagtgaagttttgggattactaggacacaatggagctggcaaaagtacttccattaaaatgataactgggtgcacagtgccaactgcaggagtggtggtgttacaaggcaacagagcatcagtaaggcaacagcgtgacaacagcctcaagttcttgggtactgccctcaggagaactcactgtgtcccaaacttacaatgaaagagcatttggagttgtatgcagccgtgaaaggactgggcaaagatgctgctcttagtatttcatgattggtggaagctctcaagctccaggagcaacttaaggctcccgtgaaaactctatcagagggaataaagagaaagctatgcttcgtgctgagcatactggggaacccatcagtggtgcttctagacgagctgttcaccgggatggaccctgaggggcagcagcaaatgtggcagatacttcaggctaccattaaaaaccaggagaggggcgccctcttgaccacccattacatgtcagaggctaagtctctgtgtgaccgtgtggccatcatggtgtcaggaacgctaaggtgtattggttccattcaacagctgaaaagtttggtaaagattatttactagaaataaaaatgaaagaacctactcaggtggaagctctccacacagagattttgaagcttttcccacaggctgcttggcaggaaagatattcctctttaatggcatgtaagttacctgtggaggatgtccaccctctgtctcaggcctttttcaaattaaaggcagtgaaacagaccttcaacctggaggaatacagcctctctcaggctaccttggagcaggtgttcttagaactctgtaaagagcaggcgctgggaaatgttgatgataaaattgatataacagttcgatggaaacttctcccacgggaagattcttaaaacgaagaacctcctaacattcaattttaagtcctactgcattattagtttccataattctacaagaatgtttccttttacttcagttaacaaaagaaaatattcaatagtttaaacatgcaacaatgattaaagttttcatttttaaaaattttaggatgaaggaaacaaggaaatatagggaaaagtagcagacaaaattaacaaactcagacatgttattcatccccaacatgggtctattttgtgcttaaaaataattttaaaatcataaaatattaggtttgtttttggttattatcaataaagttaacactgagcacattttacaaataaaaatgagttttttgcctaaa

SEQ ID NO: 133858 - DNA, 252 bp, Homo sapiens
taatatctttatactccagagtagagaataagcaaaaaaataaaaaaaataaaaaaaataagtcatgcatgcaggtcttgactccacgtggggcatcctggggaacctgccattgctgttatcagcctacaaatgtgccatcatattacctttgtgaagtggttgtgtcgggaaacctgggaatgcattaaaatgctgcagctgacccactgagagggtcttttttctcatagggatgctgaataagcttgt

SEQ ID NO: 133859 - DNA, 424 bp, Homo sapiens
tctcaagttagacaccacagttctgaggaggccattccacggtgtcagacgcccttcttagtggctccagctgagtctgtgctcaaaccttagttcagatctttgaaataatcgactatttacttcttctttgttccctgctagatggaatcttagcatggatgctttattttgttaagaatcttatacctagatttttttttttacagccccttacaggtagaaatactcagtgattgtttaaggaaagaatgaataaatgaacacatgaataattaccaaaaagatccaaatgccctcagtttgacgcaattaccaaagagattcaaatgcccacagcttgacataattacctggaagttaggtacagaggcacttagaaaaaaatgcaggagcaaatcttttaacattgggttaggtaatt

SEQ ID NO: 133860 - DNA, 395 bp, Homo sapiens
aggtcgaggctacactgagccgtgattacaccaccgcactccagcctaagcaacagagtgagaccctgtctcaaaagaaaaaaaaaagacccagcagggcagatggagtaaccagcaaagccgaccttagtggtgaggctgggcatggcggcctgagcagggatcggctccaaatagtacgtctaccgtgggctcctggacctttctccctttgctagaagagaagcaccagcaccctcccttttcctcttgtgacattttaaaatgtattattcccattcatagccttataaaatcagtacgcagtaattagagaacatttggaaaacacagaaaagtagaaggaagaaaataattacctatagccttcccactcagatcagcccattcacaga

SEQ ID NO: 133861 - DNA, 673 bp, Homo sapiens
tgtcggcggcccttcagaggagatgctgccccacggaacgcctggcaagtgctggcgaagcggcatgggcgtcccactccgttcctcaaccaatttcctcacaatcgcgagccgaagtgtggcgctttggcagtttcgcaaggtcttttgtcaggagatgagttactgaggattgggggtctttggagctcttggacctgaagaacgattaagtttttctcccttcagagagccaagagatggggtcttgctgtgttgcccagggtggagtgcagtggctattcacaggtgtgatcatagctactatagcctcaaaccctgggttcaagtgagtcctttgaactagaacattggccttttctggttctgcagaagcttccagccttcagatttgaactgggacactggctctgcagattttggacttgccagccttcataattgtaacctacactcctgtcatttgtggaatgattgctggagccagaggccaggaagaagttcatgagcctgagagaaaaagcaaggatttccagttctaccctacagagtcttgttctgttgcccaggctgcagtgcaatggccgtgctcttggctcacttgtactccatctcccatgttcaactgattctctgtgtcagctccctagtcgcttggataccaggcccctga

SEQ ID NO: 133862 - DNA, 314 bp, Homo sapiens
aacatcttgtccagtaaaaaagttgtggtaggtggggactgacttgcttttagggtgcaatttatttctttgctacatctctcttcttacatagccctgtattagtcaacccactccagaagacctgtcttccattatgggaattgttcccagccatacttatggtcacgaaggtgacctttatttccatggagtatgttctgctggtttttttgtttgtttgtttgttttttgtttttaagagacagagtcttgctctgtcgcccaggcttgagtgcagtggtgcgatcgtggctcactgcagccttgacctc

SEQ ID NO: 133863 - DNA, 267 bp, Homo sapiens
caggcgtgagcccccgtgcctggccaaatctttcatactatgatttttatggacagtagtccataaactaggaaacgccatgatttatttaaccaaggcctactgttgggcatgatcgactcttgcactttgaacatatcaccccatgctttcctgctaagaagtccacttttaaaaatgccttgtaatttttaaaaattcctctattttaacattccgctattgagtttagggaaatacagtttcctcatgatgggggatcccttg

SEQ ID NO: 133864 - DNA, 307 bp, Homo sapiens
ccatattgccaaacctaagttcattttgattaaaactgttgttcaaatcagaaaccaccctacatgaaaactaaatagcctattttaaaagacataaatacaatgggaaactggcttaaaaccattcccatcaacagtaatatgtataatcctgcttgttctcatttcaaacatggagtctcacttttgcctaagctctatttaggcattttcagtaaacaaacattaagctgaattatttacaaaattaggattccacacattcctgttagagagctttacgtgagagtaaaacactgttgtcctg

SEQ ID NO: 133865 - DNA, 330 bp, Homo sapiens
ggagtttacaatccagggggaaaacagacctgaatacaaatggtgacaatacaagacggagtcaaagagcccaacttgaagtttcagcagaatagcaccaaagactagttcccaacccagctcccagagccagagccagagccagagccaggctggctgcatgagatcacctgggagcttttgcaaacataggtcctaactgagcccctaatcatcagactgggagtcactgggagtgagctccaggaattggtttatttaataagcacccacacacacatgattctgatgttcctatgccttgtagaaacatggaactatggaaaacgc

SEQ ID NO: 133866 - DNA, 292 bp, Homo sapiens
catttccttcaggaattagatttccattccattcctttcatcagtcaaatgatagacatttatagagcacctaccccatgccagacattttggtcagtggacttagtgttggaatcacaggaagggcagtatcacagtctagtaggagagagacccttttagaatgaataatttttcataatgacgtgtatataattgagagatacagaaagtgctgtggcaccctggaggagagagtaaatttttcttcctaaagtaatcttgcagatcctaataagagaatgggtgttca

SEQ ID NO: 133867 - DNA, 686 bp, Homo sapiens
gttggatgttgtgcttcagagcgtaggctttatttccacatctggctatacacatgtgtatgcatgcataggacctaatctgactaatgtgcattatgtccccatcctttgcaatcagaatatcaatgagcatggtggttttcaaaattaattgattttgctattaatagttcaaacctaaaatttctgggatctgtgaaaagaggtagttattacttggaggcagaagaactattgcttctgaaataggaagcaaaatgaagagagctttccaaatgtgtttcttagataaggcccatccttatgtagaaacatagcaaaagaacttaaaactagattatagatggtttggaagatgggaaagaacaagtaaatacatgaattgctagtagtggcagaagccaagtactgttgggaaaagagtagtagctttggaaaaagggactcaggaaaagagtgatcaaaaatagttactatgaaattttagtttggcgtaatgacttagttcaagaagaaaggacatctctattccaagaaagttcaaatcaaatgttaataagctggtatgtactttagcatgtgaagatcacccctctgttccaaaaaccggtaggcttcataaataaataatttatttcttaaacatgtatttagtgcctacagtgtacaaagcactggggtaagga

SEQ ID NO: 133868 - DNA, 606 bp, Homo sapiens
gttgtcatgacagtcttctaaaccctatttaactcaaactgtagctgcatagagcttgagtatggtaaataaactacacttactttatgagaaaacagatcctaaggcacaaaagattgaggcataatgtctgctcataaagtagcctggcaggagaaatgggacctcttatttctgtacccctttcaccaactcatcaaggacactgagcctgttggggctacagtgataatagggaaagtacagaagatgcatgactagaggtctctgatcatggccaggagaaaagttcagtagttttcaaggggaagtgattttcaggtcaaagcaactgtcaaacttagtgaaatggagtttccctgtgaaaatgctaactagccacttgatataatatcttagatgtgtaggaccatattacctatgatatagtatggaaaaaatttaaattttttctctaagtatttttctgtttataccttttattttcatgcttgcttagtacatagaacagggggcatgaaataaaggaaaaccaaaccaagcaatacattgagccaccaccatccaggagggcaattgatgggtaatgggtaatatagggtatca

SEQ ID NO: 133869 - DNA, 729 bp, Homo sapiens
ggctcacgtctgacctcccaacactttgggaggccgaggcagggggatcgtttgagaccagcctggacaacattgtgagaccctgttccttgaattgccctgggagatttcctcagcttgtactggaggtgtgtggccccatgaagcccatagtcaccgttcaccctgagagacgctggctttggggctcacacgcctgctgcggggcagccccaggagatggccaccctgtttctcctggagctggagctgcgcgtgttctcagcaactgtggtggctgtcctgttttgtttgcatcttataaacctttacctgattacattttcctcttcaatttagctgctagaaaacttaaagtcagattggtggctcaccagtaatgagagtttagagtagaggtaaactttatgacatagtcttagactcttcactttctcctcagccaacatgattcacatttactttattttgctgtactgtgagtgtctttgtgtttcctgaattccttctggaataaggcaggttgttagtaagcacaggtttctggtccatctcatagcctcaggcagtgggcggtgctgtccgtgctccctttctgggttacctgtggtagctctgaagttgcagggctgcgatttgaagcctgatttagtacaccgtgtttctgttgtgttctgtggtggtttgctcctcacatgtgagcattcaccctgtggccctgtgtttttc

SEQ ID NO: 133870 - DNA, 639 bp, Homo sapiens
catggggaggtgataatcaaagtacacaaagcctcagttaaagagaagaaataaatttcatttttttttgttgagatccatgtccaattgatttttgacaaggatgccaagagcattcaatgggagaaagaatgaataatctctcaattacatagtgctgggacaactggagatcctcatacaaaataatggagttgggctacctcacaccatctacatgaactaactcaaaatggatcaacaacctaatattggagtgaagacttaaaagaaaacatttctttgaagaaaacaaatggcaagtcttcatcaccttggatgtggcaatggattcttaaatatgatgccaaaagcaagagcaagaaagaaaaaaaaaaaaaaaaaaaaaactttgggggcggccatgggccccgaaaaagttttaaaaccaatcggtggggcgcggggccccagatgggtaaggaacacggggcaaaaggggtcaccaaggaaacccgggcaaggaaaagcgcggggtttccaccaaaaaaaaaaccccgggggaaaacgaggggtcgggacaaactcaaaggaagccagaggccaaaaggggataaaacaggggcccagggagcgaaataaaccgggcgcggggggggc

SEQ ID NO: 133871 - DNA, 761 bp, Homo sapiens
gtcaaagtcctaaaggctgtcagccttgtctgtatatgtctggacccaactgtagacacatttttttttccagcttacatttagatcagtagacataaatagatatgaggagaaaggggtgtggtccaactccaaatacatatttaagtattagctccattctggctaaaatgctttagttggaatgaccacacattggtcccagttttgtcccctggcgacacatctcctttttactctgtagtcagaacacaactttgttctaatactaactctatttttatgaaaatgtgattaaattgcaacctagacattgacgaacaagactatttctttgtaaatgaatctcctgaatataaacccagctgagaggctaccagaagaccagtgttttcaatgttggtggagaagcaggtttcagaacactgtgtagatgctgctctttaaaaatctctgatgggaaattggccacaagagaatattcaagttagtccaaagaaagaggattacagaatagaaagtccagaaataaatccatgcatctacagccaagaaaatctactgattttcaacaaagatgtcaagaacacgcaatggagaaaggacagtctcttcaataaatgatgctcagaaaattggatatccacatgcagaagaatgaatctggacccctgtctttcaccatatagaaaattcaactcaaaatgggttaaagacaaatgtaagacccaaaactataaaactcctggaagaaaacacat

SEQ ID NO: 133872 - DNA, 466 bp, Homo sapiens
ttgaggcctctagctcctcttcacttttccctttcagaagggcatggatccgcacggcctccttccacggaacaccacccaggtcagatgggggcaggcgaggctcctcctcctcctcctctccctcctcctccatctcagactcggaactactgtgaggaaataaccacatagccagagtgagggaatgaagaaaaactgagaaggggaaggggaagggccaccatcagaaacaatgcatgtcaggcaaagcagctgctgagcaggcggagagagacaggagggaggagagagcggcatcagcaggacagggtacctgggcatgagaagccacctacccaagcccgactaaggggacaaagggaagaatgcctcctgctcacagacctcacgcacttctcctcaggtggatggggtagggaggggaccaccgaaggctgcctgtgggtctggcccagcctctgcc

SEQ ID NO: 133873 - DNA, 303 bp, Homo sapiens
gagctcttaaagtgggaaacagaccagatggctagttaaagacaattcctacatgtttaattgtgacaaaaagaacagctgccactatgaaacgaattataaagctatgaccagaacacataaaaacacctgatgagctgggagaaaagacctaatgtgcaacacccagcctacctcactcacgtgcattgcctgccttagccctgtgggctctggggcttgcaaccactgacacaggaatccaagccttttccataaaccttgtcatcatttatcagcctggagagaaggagtaggtttatt

SEQ ID NO: 133874 - DNA, 483 bp, Homo sapiens
cgttcaaattgcaaagggtgaacacatttaatgaagtccgagacgacccatttcccccaagcatcctaccatgtgtctagtaatgacaacacttggcctctttatcaaacccaccagctcctatgcctgcagccggcagcctctgcttgccccaggggggagtccttctcagcagaagctgccctgagcagatcaaatcttcggatatcattcaggtgtcctgctcagtctgttcctaaccaagcctggggcaggaaccctggcacaggtggtggtgttcagaggaaagaatgtgggccaggagccttgaatggtcccaagggcctaggatgatgctaggtgacactgatctgttccaactaagactcttactcttgggaatcagcttagtagcttccagtgacagtcccagactctggcactgagaggaactcaagaaaccactgagtgcagggctcacggtgagcacctctttgctaaaca

SEQ ID NO: 133875 - DNA, 352 bp, Homo sapiens
tcccagctactttgaaggctgaggtgggaggatcgcttgagcctgggaggttgaggctacagtgagctgtgatcacaataaagccgacattgattaaacacctcctacgggccaggcaccctgctgagcactgcaaccccgagggtgatcccactgtcacccattgtgcagaaaaggacattgaggcagaggttgagtaattttgctccgggcccaccactgatcctgcatgtcggtgggagggcacccacgctctgcttcaggaggaagcaacttcatgccagtgccaagacccaccaaggcaggggaaaagatgacacggcttcaggtaggcagcaggctctggtctttg

SEQ ID NO: 133876 - DNA, 242 bp, Homo sapiens
aggtcaagctgagtcatacacacaaggccaaatgtggggaaagcaggaatcaaaggctggaggtaggggaaattctaaatctgcagagcaccatctttgagaaaaagaaaaagaataaaaacctatactggaaggagaacaatcacgaagagaactggtgggtgaagaagttgagataaattgtgcaagccttcactagagataatgtccttttgataggccggttggtgtagtagaagaag

SEQ ID NO: 133877 - DNA, 209 bp, Homo sapiens
tggcaaaatagacattgaaaattttattttatgaattcttagtcactaatttcagcctttttgcctcttagcagaactgaacattatgtaatttgcatactgcaccaggtagaaatccccttgatgtagtcttttctagtgtttaatcatatatgtaactttattgtgtcaatccaaatctctcattcatgtcattttatatctgagct

SEQ ID NO: 133878 - DNA, 748 bp, Homo sapiens
ggttgcagtgagccaagattgcactactgcactccagcctgggtgacagagtgagaccatggcacccccctccccttcaaaaagaaatcagcctcataatcaatttctctggattaaggagtaagagcgtctcaagatttgctgtttatagagagggaggctaatagtttgagagagatacagaatctagggagagtgtgggtttttggtctttcagttgtttgccagccttggataaagaatgaagattacttgagcatattatttagagacaagtggagagaataaaggcacatgccagataggagataattaataaagcacttgtccaaaatagaaacttgttgaacaggaagagacgtcaagtataaggagattttaagatgggagaagggaattttgagtgtttgtattggatgacctcagggttcccagtaaagcaggagctgaattcatcgaaggtgatgtgttggtcaggatcaagagagaggttgggagaacaaagtgctaaaatcgttgtggtcaagagtttaaaaagtgtataccagaagagttattgagtgataggggtttgaaataggcaaagctgtaggaaagggggctggaaggaatattaggaggaacactaaatatacttctgaggtctacctcctggtctgtgaacataaaggagctgaaagagtaatggctgaagttctttagtttagctaaagttttttagctaaagctagaattgttgaaagttgta

SEQ ID NO: 133879 - DNA, 436 bp, Homo sapiens
taggggcatctttggaattgcatgtaaggaaagaggggcatgtagaatgcattagagattccatcataatcatgtctgggcgtggtggctcacacctgtaatcccagcactttgggaggccaaggcgggtggatcacctgaggtcaggagtttgtgaccagcctgaccaacatggtgaaatcctgtctctactaaaaaattacaatatttacccgggcgtggtggcacgtgcctgtaatcccagctgctcaggaggctgaggcaggaggtggaggtttcagtgagctgagatcgcttcattgcactgcagcctgggcgacggagtgagactctgtcttaaaaaaaaataaaaactactgtcatctacagcctttggtactcttgtttctcataactgaacactctcaatatgctcagttgattggacccgggatgg

SEQ ID NO: 133880 - DNA, 455 bp, Homo sapiens
gaagagctagcatcttaaaataagtcactgttaggactggtgatgacacggatgttcgtctgcatacaagcacaggcacactgcaaccctggcccttgaaggacaattctgttttattaaaggcttgagtttataaccacaaaggtattctttttgttcaggtagtcagcattcactcaataaacacttgtttatcctatctttatcccaggtattgttgtaggctctgagacctagtagaaaaactgaccaagtcctttgaagtattagttattgagtggccaataagagaagacaaaaaagaattaaaaatccgtagatgtggttcatccactcccagattagaataaagatccattgcacagtttcttctatatagttttatggatgtaggatagataatattatcctctgaggctcattgatgagtaaatacaaataaaagtggattgttt

SEQ ID NO: 133881 - DNA, 349 bp, Homo sapiens
caacgcttctttcattccaatgttagaaaagagtgagactaggctaggctgggcgcggtggctcacgcctgtaatcccggcactttgggaggccaaggcgggcagatcataaggtcaggagttcaagaccatcctggctaaaacggtgaaaacccatctctactaaaaatacaaaaaattagccaggcgcctgtagtcccaggtactcgggaggctgaagcaggagaatggcgtgaacccgggaggcggagcttgcagtgagccaagatcgcgccactgcactccagcctgggcgaaagagcgagactccgtctcaaaaaaaaaaaaaaaaaaaaagaaagaaagaaac

SEQ ID NO: 133882 - DNA, 292 bp, Homo sapiens
acctccccctgtgtaccccaggtgctgggcagttaccagtgatttgcagctttgaaacccccagaaggtctgtggagacttagaggacaggaggtctttggtcccagacttcccacaccagctccaaggcagcaggtaatcttctctgactgtgatgacctctcccacaactcttcctgtcccctgcccaccccagagtctttatcctaaaaatccatctcaacagacatggtctccaaagttcaactgccaaaggctcagacctgagacaggagactgggagagttgcggg

SEQ ID NO: 133883 - DNA, 728 bp, Homo sapiens
agattgagaccagtctggtcaacatggcaaaaccctgtatctactaaaaatacaaaaaattagctgggtgtggtgatgcatgcctataatcccagccactctggaggctgaggcaggagaatcgcttgaagccaggaggcagagattgcagtgagccaagatcactccactgcattccagcctggatgacagaatgagactctgtctcaaaaacaaacaaaaaagaatgcacactacagatatacttgcaaaagtattccataaaatatgttcattacagtatcatttttcattaaaaatatatatatatatatttttaaactaaaattatctttaataagggaactaaggaagcattgcctgaggcagaccatgcaaatggcaggtagggatcttggacagtatagacttgacacagttatatttctcagctaacaaaataatccctcatcctttactggtaccataaggcttttgtattttctttataactaacttaccaaaaaatatttattagagtcctactatattctaaagatagtctattatatcttttcaatagagctggaccttgagagattggtgtaatttcaccaagtagaaaagacaggtagggcattacagaaggccaaacaaacatggggccatgaaagtttatggtgtgctggatgtacaggatagagcacacatgtattacacggggggcggaaaggggtgcagaaacagtg

SEQ ID NO: 133884 - DNA, 306 bp, Homo sapiens
gccaccagcatgaagtccacagcagccttccttcacagggatgtcagggcaaggagtatgggggtgggtctcgcaagggggttcccacgtcctggcctccacgtcgctccccatggagatccttccaaagcacagatctgactatggcatctctgctccaacacccctcattagttcaccgctggcttcagaataaagtccgcattccttgcttggcattcaaggtctgcttcccaagcaagacgtccagccctttcaggacagggcctgtgttttccccagtccctggcacatcaatgttggatg

SEQ ID NO: 133885 - DNA, 404 bp, Homo sapiens
aagatgtgcatatcccatgactttgcaattctgctcctaggaatgtgccccacagaactgcatactagaatgttcacagcagcactattagcaacatcatagccaaaaaactggaaactatgcaaatgtccatcaaaatggttaaattacatattcacacaatagaatgccatatagcaatgagcatgatctatatttccacctaaaacatggctgaatctcataaacataactgagcaaaaagaagccagacataaaggatacatactatatgattccatatatacatgtagaaaggataaaaagggcaaaactaggccatgcctgaaatcccagtgatttgggaagctgaagaggaaggattgcttgaaggtaggagttcgagaccagcctaggaaacatag

SEQ ID NO: 133886 - DNA, 563 bp, Homo sapiens
aggcccctgctgagcactgagggctctcctgctgcctaggcgaaccagaaactcattctcactaatgggacagagaaggaacattcgtggagcatgcgggtcatagaattaaaatagataagtatatacgtggggaaaaggcaagacttaacttagagaacagtcctctctaaggcctggctataggcacggagggatcaggggtacccgtgtagcatttcaaatgctgtcacatcagcagctgcttataccaccatcaggaaacacgcttcccacacaaacctcaccaccgtccacccaggctcctgcagactggccagggcaccagatgctaccagttcactggaaagtacactgaccttggagtccatagccctgggttggagtctcccctctgccatcgactatctgtctgattctaggtcagtcattgaaactctatgctactctcagttttctcatccatgaaatgggcttccatgcctgcccatcttgagacaggttgtcatgtgtccatgagttaataaatatatagaattccagagtccaccctgtatccccag

SEQ ID NO: 133887 - DNA, 395 bp, Homo sapiens
acaggaaaagtggctggggacactgtgccagacagatctctcccattaaatgtagggaaaaaaaaaaaggaactgattctgatgaaaagccccctctaattgcaaaatgtcactgtgttataagtgagatctagtattatgacgattctaaatttaagagaatatttgtatacagttttaagatatgcaacccatccaagaagggtggtgcatgccagaaatccatctatttgggaggctgaggcagggggatcccttgagcccaggagtttgagaccaacctgggcaacacaagaaggctccatctaaaaaaattttctttgaataagacatacaaccaaaattcaaatttctattactattattttttcttttgtaagaattcacttgaaaag

SEQ ID NO: 133888 - DNA, 1322 bp, Homo sapiens
gtttcttgctgtttattgcaacccgcctacatcgttggtgtgtgcagctgaactcaggctgtttaggaagcccacgggcagggctctgtggggcccattcctggtcccacgtctctggcaagggctcctcttgagctgaggcttctgagctcctgcaggcgggagtagggaggcaggtcccactgtcagccaagctgcagggtttttaggaagaaagtgggggctgtgcaccgtgggctcacacctataatcccagcactttgaggctggccggaaggatcgctgtggcccaggagtttgaaaactcatgcctataatcccagcactttgggaggccggcaaggaggatcactttagctcaggagtgtgagagcagccttggtcctatctctataaaaaatttaaaaactggccaggcatggtggcacatgcctatagtcctggttgcttgggaggctgaggtgggaggattgcttgagcccaggaggtcgaggctgcagtaaactgtgatggtgccgctgcagtccagcctgggccacagagcaagaccgtgtatcaaaaggaaagggctgctgtggaagggcctccagtcccctggcctgggctgcaggggccgctgctccagccctgccttctacatgtgccgagatgtgagcagtcacccctggagatcctcaccccttctctgtagaacgaggagttgggctgccagggattggggtctgggcgcgttgctggtgtgtgtgtgtgtgtgtgtgtgtgtgtgtgtgtgtgtgtttcctgggaggaggcccccacagtcttcgtcatgttctccagggcccagtgggaaggagttggaagttggatggagagaaatgtggagtagggcaggaacctccttcctaggaaggagcctgcgggggaccctgcaaggggtcccaggttccccaggaggcctcgggtgtgctgtcaaaggggccgctggggctgggagtctgtccatgtcttcagcctgggtctcgtgagttcagggagtttgaacctgggtggagaatgagcccctgtgcgtcttccctaacctccagctgacacgagcttccgcagaccccgcggtggcgggtgtgggcgctccccgtgccatctgttggggacacctcacacatcacttgcgctcagcccgtgtcgcggctgcaggagccaccagaccttgtaaatactcggatgcccacatctgctcgtctgtgtctccctgtggctgtgcatcagacctcacgcgtttaaaacgtccttctgagaaggggccacaggcaggtgccacccattgccacggcaccatggca

SEQ ID NO: 133889 - DNA, 381 bp, Homo sapiens
cccggattcaagtgatcctccacttcagtccccagagtaactgggactacaggtgtgcaccaccatgcctgactaatttttgtattttttttatagggatgagggtttcaccatgttgctcaggctggcctcaaactcctaggctcaagtaatcttcctgccttggcctcccaaagtgctggaattataggtgtgaatcactgcgcctggcggtcatcaggatttttaaaaaccccacaggttattctaagggcagcccaggttgagaaacactggcccaaagaagtgtcagggaacaattaggagccaggtgtgaatggagggagtctctgggtgcagagggaagggatagtgcagtgggagataagcctgggaagtagg

SEQ ID NO: 133890 - DNA, 663 bp, Homo sapiens
atcataatcactgcaaatcttctattatacaatgtatgtatctcaacactgtcatgaaattggctagttaagtttactcctttgctcttattataccagaaaaaaaactatgatagacatttttggggtgagaaatctttacacatgtccattgacatttccttaagggaattttcttgaaatggaagtgcttcatcagatttattcagaattttaaaaacatttaatacacactgccaactagctcttaggaagaaaacaatgcagttttgaaaggtacacattaaccagttagttacattaccttgacctgaaatttcttttggtttgttgtttccatttccataataaccccactgagttctcttgtatcttttttagtattctataatcgatgtttgctcatgaggatgtctgccccaagctggccagactattagcctgaatgctcagcacagcactagacgctaaagagatgagagaaggatgaatagttaaatggaaacatatgcctttcactagataaatacttctttagagcactgtagtggaggcagtatcaatttaatttctgacacattagacactttgaccactaattaaaacctaagcatgaaaaattacttgctgcttcttatggaaaataacccacaacatcctttg

SEQ ID NO: 133891 - DNA, 505 bp, Homo sapiens
cacaccttcgtcaacactggatattacaaacctaagcaaaaaggtttcatggtttttaatccacacttatctgattattaataagattaagcatttttacatatatatgtgaattacctatgaatagcctttgcccatattcctgctggattgtttttcctattgatttctaagagttcatgcctgttatagatattgcaactatttgctttactcctttgtcatctgcccttttttttgagactgagtcttgctctgttgcccaagctggagtgcaatggcacgatctcggctcatgcaacctccacctcccgagttcaagtgattctcttgcctcagtaacttggattacaggcacctgccaccatgcccagctaatttttgtattttcagtaaagatgggctttcaccatgttggccaggctggtctcgaactcctgacctcaagtgatccacctgcctcggcctcccaaagtgctgggattacaggcgtgagccaccgcgc

SEQ ID NO: 133892 - DNA, 667 bp, Homo sapiens
tttccacagggaggtatttttaatttgtatctgcagttggtggacagaaatagccaaatataaggccctgagctctttataaagcacagaaggggagagaggtgctcacatttattgagcacttgccaggagcaacatatgttctttcttctccagaggcaggtattcttaccctcacactacagaaacagaggtcctgggatgccgagtgagacccccagcttacacgtggctggctgccttccagtgcaactaccttgcactgcctccccagagtgaacctccttggcctcctgaacgcttctgagattgaaacttagcaaatctgcagcagtgttctccaggtttagatgttgcagaatctcattggcatttaacgtggctgggtgtttgagtgtatttttatgtcttgcctgaggcctgaataaaagttacaagcagcactgaagaccaaaccaagaatgaaaatgtgggcagccaaccttgtaaccttagctaatctttaattatgccttaattgaggttctatgaagtagatataggaagactaataataatatgttgagtttatgcagcattttaatttccccactccttcacgtgtgttgtaataattattgctgccgtttcctgagccccagctgggtgccagttaccctgtgaagcc

SEQ ID NO: 133893 - DNA, 699 bp, Homo sapiens
ggagctactataggagcaattattttgtttactaaaactgaataccttgctatctctttgatacatgtttacaaagcctgggtaaaaatggtataaattacttttgaaccacctctacattctgagggtttcagcaggacaatgaagaggtgttctatgtatagaatttgcaatatcaaaaataagaaaatactcgtaagtgaggaaatgtgttgggttttttttttaagtgtagtaggacaatatttcacaaatcattctacaaagtgattgtcctgctatttctgcagtttcaaaataggtggtttttagagccattcacataaatttccattaatgaagtcaaaattatttggggaaaaacaggtaaggtaaagagttcactttcatattatttgaattaaacctcttttattttcttacaggctcagtctttaagtaataaagtagcagctttcaagtaaatgaagtgtctaaaataaatattgattcaactcttatttgaaaaatctatttgttcttgttttagatgattagaatagtattttaggcatttgttggtaccttttccatttggttgaacttttaacttagctttatgtaataactcatactttaaaaataataaatgcatcaaattctatcctaaacatatgaagacaatttaggattcagaatcctgtagtggatctctgtgaa

SEQ ID NO: 133894 - DNA, 683 bp, Homo sapiens
tgccaccatgcccagctagttagtgagtgagtgagagtgtgtgtgtgtgtgtgtgtgtgtgtgtgtgtgtgtgtgtgtgtgtgtgtgtgtgctgaccagcattccttcctggtaagagaccaccaaccacggaatggttctggctgatttacagaggctgtgcacaagatgcctctgtgtcctccatttcaccttttgacctatagaggctaattttaatgcatttaaatgttaagtctccatcccaaaatgaatgtgggacatatgtaacatgtatgtttgcttactgtatatgcaaatacctcctcccattatgaatattcatagctcctcccataacctgttaaatatgtacactgagccaacccttttggaataagtttctattccacccctttctcccttgaagtgcctgctttcagtttctaccagaggctacacttcccagcctgcaggatggccagcctgcaggccacaactctgaataagaaaagctctcctctctaagtttatgaaccttgtgattcttcagttgacatttttgacagtgtggttgctctctggataagggcaggaaggtggtgctgtcaagcagagcagctttgtagagggtgtcggggcacagcgtaggtgtcggggcacagcgtaggtgcccattcagagcccgaggactcatccaccag

SEQ ID NO: 133895 - DNA, 785 bp, Homo sapiens
gaggctgaggtgggcagatcacttgaggtcaggagttcgagaccagcctgaccaaaatggtgaaaccccatctgtactaaatacaaaaattagatgtggtggtgggcgcctgtaatctcagttactcgggaggctgaggttgcagtaagccgagatcatgccactgcactccaacccgggcgacagagtgagacctgtctcaaaaaataaaaataaggaaacttaacttttggtacctaactcatagcctccagaaacccattcatgtactgtagattagtcaaccatcttgtagggaattgtttatagagggcacaatcacattttaagagtaaataaataacatcctgctaaatcttttgaggaaatgagcaattccatatagatttgtgagaattatttagaaaaaagattttaggttgaataattggcttatttaataaagatttacccttttattctattcttaaaacttgtttttggccttagggtattcttgtgacttacggaaaatttgatagtaattatcaaattattgttctaaactctgaagctcatttttggtataacctagataacaattgcatatttgtatggacaggtatttactgatttcttttacaaataaaacattgtgcttgcttgtaaggaataatcaaggaaattaacatgtggtcatttccttgaaaagaatggataattctatagcagccatggtcacaaataatacaaggtgaagaattagtcaactaaggaatgggaataggataacagggatagactat

SEQ ID NO: 133896 - DNA, 211 bp, Homo sapiens
tatgagtggagggagtgagagctgaagggtatgtagggggtcaagtcaagagcgaccttacatgccaagctcagggactaggattcacatcctgaaggtgatgccaaccccaggatggtgatgcttaagtccaagaaagagaagggggtggggggaatggagagtaggggacagatgcctgaacagcatagagaggaggtcccatcaggca

SEQ ID NO: 133897 - DNA, 504 bp, Homo sapiens
tattacaaaccaagcagtgaataagaaagaggcaaaagaaatatgtcttggctgtttctccttctcattggtcatgatgaagttcttgtaatagcactgaagctgagatgccttgaccacacattttttttaacagctttatcaaggtgtacttgatgtacaaaaaaaacctactgttcatgtttaatgtatactatttaacatactgggatatatgcatccacttgtgatatcactactccaatcaaggtaataaatatatccatcccctcccaaagttgcctttgccttttttatccctttgtgtgtgtgagtgtggtgataagaccacttcacatgaaatctagtctcttaaaattttaggtatataatactgcattgtaaactctaggcacaatgttgtacagaagatctctagaactatttttaatcattccttctttctccttccaacacattcagcatgttcccctttagtacagctctagtcttacacactatatt

SEQ ID NO: 133898 - DNA, 358 bp, Homo sapiens
agtgtgaagtcacaggaagaggtggtgtgatgccacaggaagggactgtgtgaagccacaggaaggggcagtaggaagtcacaggaaggggctgtgtgaagccacaggaagggggagtgttaaaccacaggaaggcacagtgtgaagtcacaggaaggggctgtgtgaagtcacaggtagggacagggggtagtcacaggaaggtgctgtgtgaagccacaggcagggtcagtgagaagtcacgggaagaaggagtgtgaagtcatgggaaggggctgtctgaagtcacaggaagaggcagtgggatgtcaaaggaagggatggtgtgaagtcagaggaagaagctgtgtgaagtcac

SEQ ID NO: 133899 - DNA, 745 bp, Homo sapiens
gttgcccaggctggagtgcagtggtgcagtcatggctcaccgcaaccttgaattcctgggctcaagctgtcctcccagctgagcctcctgagtagctgggagtacagagtccagtttccatctgggagccaatgcccagcttccgtgccaggacaaaagtcacatttcacaagtgtcccgaagctgaggaaaattcacatccctaaagatcacaagaattcactgcaagtaaatacatccctgcagttcagcaagacatcaaggatgacagctggctatggatctaccaagctctgcaatgacacttgtcaagtatggaaaagctcaaggcatcctgacattacacaacttttgagaggctgggaaaccaagggaaatatttcttcctcagggagagagatactgcggctgaagagccaaggccaggccctcccataaatgactccctggaatgtcagcccccgtttctgaaatccagccactggccctctcaggagtgatttggtttcactctactttaactcctggacatagcacagaaagcagaaaccccttgccatcaggtgtcaggcctgccaaggtcacctcttccggctccagggatgctgaggagattgcactgtaactccaaacttcaggatcgggagctaagccaagttccacagagtttgttcactgccttgtacttcctccaaggacgagtgttttgcaagggatctgataacttcccagttcaaggaacctg

SEQ ID NO: 133900 - DNA, 869 bp, Homo sapiens
agtgcccccgaagagacagtgcattaattgtcaccccttaggagcattgtgtgaattagtgtgatttagcacatgcccagagggatgaaactctagctccatagggtaggtcctgattactcctggagcaggcagccagctcagctcatggggagctctgagaagtctctcaatgcctcgcatgcagcccctgctcaggagtcatgtgtcacttcacagtcttgctttccagtgggtcaaagcatgatgtttatgagaaacaaatacacaaaattctgacttgtgtgaatacagaacacgtgcaataaaacgactgcaatctatttttaaaatgtggtctgagaagtcaggtttaatatgactatgtaatatataaacaatatattttccacagaaaggaaaatataaataataaaatatgtctatttcttttttttggtggaaaattactcccacaatttggtcccaagggggtcttaatttgtcatcaggtctgtggctaaatgtcttataaaggaatgcttctttctttcgagaagtgtacaggaacagtctgcactgactgcttttacctgtaaatgttttgagaattcagaagtcactttccttccacaataggtgctaggcattttatttaaataaagcaaaaacatttctgtcataaagaaggtgttaataacctcaaagctatgcgaaatatactagtacaatctaatactcatggtgaaaaatacagtaattaagagcaattcaagtttttttgttttggtttaacttcagaattaaaataaactcagaattaaaaaaataaaaaatggttttattacatgtcagagtattgagatacaaaatatataccagatactgca

SEQ ID NO: 133901 - DNA, 452 bp, Homo sapiens
agtacccaactgagacacagaataacttctaacagaaacacatcgagtgttcttagcaacagccagtgtgaagaattcactgcaggtctcctgcagccgtggagctgagattttaatacagcaaatggataggatcaggtgcctgggataagagatgggttgggctctgaggttaaggtcaagaacagaaattctggggtgatgtgtgaagagcagatgagtttagaattttaggattaagacccacaagctgggagtgaggatacttactcctttcctccattttttatttactaggagatgacgcctgggagtcagttgatctctccgagcttcagacccatctcttaggtcctttccaaatctatcatagtatgatcatgacaaccaggagtaagactggggttggaaaagggaagaaacggtgaggggtaaagagaaaagggaaagaa

SEQ ID NO: 133902 - DNA, 340 bp, Homo sapiens
ttgcaaagctcatcctttgtaagacccaactcagtcactccctgtaagattgaatcaacccttctgttttgaaagatatcgattatcacattgtggagtaattatgtatttacaaaccgtaatcttgctgtgagcccctttgactgcagacattgtgcttttgtattcccttcctctagccactatgtttgacaacaccataggtactaagtaactgtgcagtgaatgaaagacctgagtagatttagagatgaagacagagcttgaaggccctggagagatcttaatgttggaaggctggggagtaggcgggccgacctagaaatctgacctatatttc

SEQ ID NO: 133903 - DNA, 697 bp, Homo sapiens
gaagatatttgtggttttgagtttagtaattgaaagctgtagaatttatatgcccagacattttgaggaccaacagtatcacattgtaaaattattttggtacactatgatatagtattttatatgataaaatgtttcaacgttgacaaagtgggtttcatcatgttggagctttttgcattttcaaaaagtgtaaaaattacttattttagtttttttccaagtaagcttagggtttttgaaattttgcatttcttaatctgtagatgtttccatttttcctaattgaaatttttaaatttctaaaatttagttgtttcgtcccttttccaacaatttttccaaaagcttttagaatttcataataattttgttttatcttgtttttgcattttgtttagttgctattttgttatcttttgcaaggaaggaggaggatttgcttcagttgtaagtgtatacattttcctcttccccttgggcccaaatgttttctccttttgtcctgtaaagtgtctgctgtgaggtttacccctgctaggtaaaaaaggcatttttttaaatctccataactttttgaaggcataaaaactgccattttgtagccctgctaaagaattttgacatctaattggtctaagtgaactaaatgtctacattggttattataatttgataacctgtaaaaaaaaatttt

SEQ ID NO: 133904 - DNA, 285 bp, Homo sapiens
cttacattatccatctgttgtctatttttttcatgagagctcttaacatattaatgataagttccatgtctgataattctgacacgtgtcatgtctctatctggttccaatgattgctttatctcttcagaccatgacttttcttgccttttgacgttctttgacattttttttgaattttttgttgcaagccagatctggtgtgttatgtaataggaacaggtaaataagtctttagcttgcagacttatcttaatctgactaactattagactgtgtttaaag

SEQ ID NO: 133905 - DNA, 121 bp, Homo sapiens
aaggctgaaaatacaatacttctagaagtggtaacagagtctcttaaaatccaaactgatagttcagaggattagtattaacaccactggcatactgtttttaagccattgaattattttg

SEQ ID NO: 133906 - DNA, 400 bp, Homo sapiens
ccattcctgtaggttttataatgcttctgatgtttgtgtccatgattccaaacatctggctaattgactgcatttataccttttacacatatgtcttggttttatgtatatatttgttgtgttaatgggaagcatactgatataaaatgcaactggaaaaagtagtacagaaaaaggaaatattctctgtcaagtgccattctgttgaaactgatgtttaagtagatgaacatctttttcactgagaagttgtaaccaaatcagattcagctgcatgttaatatatcaaacaggaaaaattaaagtactgtgtagcagctgtcttgaaatatgcaggttgaaaaaatttaaagtgatatgcattggatatatgatacaacatttatgaaattgagatgga

SEQ ID NO: 133907 - DNA, 3240 bp, Homo sapiens
ggcgagcagaagcccgctcgcccgctgccgagtggcagtcacgactgtgaggtcgccggcgaggtggccgcgggcgcggcggggcggggcagggcgcactctcctccacgcccgcggaagtgccggggaggtgggcagggcggggagggagagggagcgaggctggaggagggcacgtcggcgcctcggcgaggatgggagtccccaggacccggagctgagcagcctggcgcgcggcgggcagggcgcgcaggacagaagcctcgctgttcctccgggagcccaacaccgttcccgcgcggccacgatgatccctccgagcagcccccgcgaggacggcgtggacgggctgcccaaggaggcggtgggcgccgagcaaccgccctctcctgcatccaccagcagccaggaatccaagctccagaaactaaaacgatcactttctttcaagaccaagagtttacggagcaaaagtgctgacaacttcttccagcgaaccaacagcgaagacatgaaactgcaagcacacatggtggctgagatcagccccagctccagcccactccctgctccaggaagcctgacgtccacacccgccagggctggtctgcatccaggtggcaaggctcatgcctttcaggaatacatcttcaagaagcccactttctgtgatgtctgcaaccacatgatagtgggaacaaatgctaagcatggactgcgctgcaaagcctgtaagatgagcatccaccacaagtgcacagatggcctggcaccccagcggtgcatgggcaagctgccaaaggggtttcggcgttactacagctcccccttgctcattcatgaacagtttggctgcattaaagaagttatgcccattgcctgtggcaataaggtggaccctgtctacgagaccctccgcttcggcacctccctggcccagaggacaaagaagggcagctccggcagtggctctgactcacctcacagaacctctacttcagatcttgtggaggttcctgaggaagccaatgggccaggaggcgggtatgacctaaggaaacgcagcaacagcgtgtttacatatccagaaaatggcactgatgatttcagagatccagcgaagaacataaaccaccagggatctctttccaaagacccattacagatgaacacctatgttgccttgtacaaatttgtaccacaggagaatgaagatttggaaatgaggccaggagacataattactcttttagaggattccaatgaagactggtggaaagggaaaattcaagacagaattggcttctttccagccaactttgttcagagactacaacaaaatgagaagatttttagatgtgttagaaccttcattgggtgtaaggaacaggggcagataacactgaaagagaatcagatctgcgtgagttctgaagaagaacaagatggttttatcagagtcctcagtggaaaaaagaaaggcctcatcccccttgatgtactagaaaacatctgattgctggctcctcctccgtttgcagtaggcaagctctgctgcgatgcctctgcctcatctcacactgcgtcaacccaaaggagctgccgcactgacccagccccccaggaaacagtgagacaagaatcaagtatctgagactgtggagtaatagccacaaaacagagggcccactgcacagcatatccaggctgccacaggtggggacgaggctgagagagtcagcaggcagagccagatgccatgcttggcagcagcagtaggactataaaccacagctgtcccccaggatcccactcctttcctgtctgtgtggtgtaagttaacacactggagtgtgctccagtttgcagggtagcccagtgcaaggttcagatccatgtagctaagtattatcctgcttccagacctatgtcaccagtaccaatcagtcagtgtcatcacatttcaggccccaagcaatctctgtgcaaagcatcagaaagacctgcttcccagcccccagcattccagtgctctccaggcttcctctctttgtgattgtgctgtccagagtgtccagcttgttctttctttctcttcagtcctctgagtacatctggtggtgtgcattagatgtgagggctatgttgacatggcatcacctccaaagacctgacctgcctaaagactgatgacaggccatccttcctgctgttctaggtactggcctgggtgacagagcaggacatgagacatagatacagtggggaggagaagtggggaaaggtggagcagagagttcttacttattgaagattatacagccctttcggttatgaagtccctgcttgaaggcaatggacctggggaagagactatcacaaaaagtctccattttcattttacatcctctctattggaggcagcacttttccctcatgctgtcctataggactccactttgaaggttgtgcctacgttgcagggaactaggaacatggaggggaaccaacaacagcatcttagaagaaatgtagccaaattggagtccattcttctttagggcagtatatgaaatcctagcagatgtaaaatggaaaagaatcctaatgcttcttccttcagaaagtagaggaactaggggcccaattagcatcatctaggggaatctctattactctgtacttatactaatgtttacaagaatgcaatatactgtgatgccttcctactcaagcctcctagcattcaaacttccatcctattagtcattaacatggttaaacttcaattcacaatcaccttggaatcaatgtcagtttgatttattttgttacagagcaataaaatcattagaacaatggtttttaaaagacttaagtggatgcatcctatgcatgtaagcattatttcccaaaccaaagcatcattcatctccatttatttcttttgttcccgctcagtgtgaagttgggaactgagaggggatggctgctggtttcacagaagtttggatgccttactcttatcttaaagccagcatccagaatttcctccctctctgatgccacatgcaaaaccaggtgtacgatgtcaagatggattctttgagagccagggtagatcatatgactgcctttctgtaaaattggatgcctagtacaaatgctctttgcctctaattcagtattccatttaataaaaacaatacagtggctggaaaggagcatcagaaaaaaatg

SEQ ID NO: 133908 - DNA, 3207 bp, Homo sapiens
ggcgagcagaagcccgctcgcccgctgccgagtggcagtcacgactgtgaggtcgccggcgaggtggccgcgggcgcggcggggcggggcagggcgcactctcctccacgcccgcggaagtgccggggaggtgggcagggcggggagggagagggagcgaggctggaggagggcacgtcggcgcctcggcgaggatgggagtccccaggacccggagctgagcagcctggcgcgcggcgggcagggcgcgcaggacagaagcctcgctgttcctccgggagcccaacaccgttcccgcgcggccacgatgatccctccgagcagcccccgcgaggacggcgtggacgggctgcccaaggaggcggtgggcgccgagcaaccgccctctcctgcatccaccagcagccaggaatccaagaccaagagtttacggagcaaaagtgctgacaacttcttccagcgaaccaacagcgaagacatgaaactgcaagcacacatggtggctgagatcagccccagctccagcccactccctgctccaggaagcctgacgtccacacccgccagggctggtctgcatccaggtggcaaggctcatgcctttcaggaatacatcttcaagaagcccactttctgtgatgtctgcaaccacatgatagtgggaacaaatgctaagcatggactgcgctgcaaagcctgtaagatgagcatccaccacaagtgcacagatggcctggcaccccagcggtgcatgggcaagctgccaaaggggtttcggcgttactacagctcccccttgctcattcatgaacagtttggctgcattaaagaagttatgcccattgcctgtggcaataaggtggaccctgtctacgagaccctccgcttcggcacctccctggcccagaggacaaagaagggcagctccggcagtggctctgactcacctcacagaacctctacttcagatcttgtggaggttcctgaggaagccaatgggccaggaggcgggtatgacctaaggaaacgcagcaacagcgtgtttacatatccagaaaatggcactgatgatttcagagatccagcgaagaacataaaccaccagggatctctttccaaagacccattacagatgaacacctatgttgccttgtacaaatttgtaccacaggagaatgaagatttggaaatgaggccaggagacataattactcttttagaggattccaatgaagactggtggaaagggaaaattcaagacagaattggcttctttccagccaactttgttcagagactacaacaaaatgagaagatttttagatgtgttagaaccttcattgggtgtaaggaacaggggcagataacactgaaagagaatcagatctgcgtgagttctgaagaagaacaagatggttttatcagagtcctcagtggaaaaaagaaaggcctcatcccccttgatgtactagaaaacatctgattgctggctcctcctccgtttgcagtaggcaagctctgctgcgatgcctctgcctcatctcacactgcgtcaacccaaaggagctgccgcactgacccagccccccaggaaacagtgagacaagaatcaagtatctgagactgtggagtaatagccacaaaacagagggcccactgcacagcatatccaggctgccacaggtggggacgaggctgagagagtcagcaggcagagccagatgccatgcttggcagcagcagtaggactataaaccacagctgtcccccaggatcccactcctttcctgtctgtgtggtgtaagttaacacactggagtgtgctccagtttgcagggtagcccagtgcaaggttcagatccatgtagctaagtattatcctgcttccagacctatgtcaccagtaccaatcagtcagtgtcatcacatttcaggccccaagcaatctctgtgcaaagcatcagaaagacctgcttcccagcccccagcattccagtgctctccaggcttcctctctttgtgattgtgctgtccagagtgtccagcttgttctttctttctcttcagtcctctgagtacatctggtggtgtgcattagatgtgagggctatgttgacatggcatcacctccaaagacctgacctgcctaaagactgatgacaggccatccttcctgctgttctaggtactggcctgggtgacagagcaggacatgagacatagatacagtggggaggagaagtggggaaaggtggagcagagagttcttacttattgaagattatacagccctttcggttatgaagtccctgcttgaaggcaatggacctggggaagagactatcacaaaaagtctccattttcattttacatcctctctattggaggcagcacttttccctcatgctgtcctataggactccactttgaaggttgtgcctacgttgcagggaactaggaacatggaggggaaccaacaacagcatcttagaagaaatgtagccaaattggagtccattcttctttagggcagtatatgaaatcctagcagatgtaaaatggaaaagaatcctaatgcttcttccttcagaaagtagaggaactaggggcccaattagcatcatctaggggaatctctattactctgtacttatactaatgtttacaagaatgcaatatactgtgatgccttcctactcaagcctcctagcattcaaacttccatcctattagtcattaacatggttaaacttcaattcacaatcaccttggaatcaatgtcagtttgatttattttgttacagagcaataaaatcattagaacaatggtttttaaaagacttaagtggatgcatcctatgcatgtaagcattatttcccaaaccaaagcatcattcatctccatttatttcttttgttcccgctcagtgtgaagttgggaactgagaggggatggctgctggtttcacagaagtttggatgccttactcttatcttaaagccagcatccagaatttcctccctctctgatgccacatgcaaaaccaggtgtacgatgtcaagatggattctttgagagccagggtagatcatatgactgcctttctgtaaaattggatgcctagtacaaatgctctttgcctctaattcagtattccatttaataaaaacaatacagtggctggaaaggagcatcagaaaaaaatg

SEQ ID NO: 133909 - DNA, 3024 bp, Homo sapiens
ggcgagcagaagcccgctcgcccgctgccgagtggcagtcacgactgtgaggtcgccggcgaggtggccgcgggcgcggcggggcggggcagggcgcactctcctccacgcccgcggaagtgccggggaggtgggcagggcggggagggagagggagcgaggctggaggagggcacgtcggcgcctcggcgaggatgggagtccccaggacccggagctgagcagcctggcgcgcggcgggcagggcgcgcaggacagaagcctcgctgttcctccgggagcccaacaccgttcccgcgcggccacgatgatccctccgagcagcccccgcgaggacggcgtggacgggctgcccaaggaggcggtgggcgccgagcaaccgccctctcctgcatccaccagcagccaggaatccaagaccaagagtttacggagcaaaagtgctgacaacttcttccagcgaaccaacagcgaagacatgaaactgcaagcacacatggtggctgagatcagccccagctccagcccactccctgctccaggaagcctgacgtccacacccgccagggctggtctgcatccaggtggcaaggctcatgcctttcaggaatacatcttcaagaagcccactttctgtgatgtctgcaaccacatgatagtggcctgtggcaataaggtggaccctgtctacgagaccctccgcttcggcacctccctggcccagaggacaaagaagggcagctccggcagtggctctgactcacctcacagaacctctacttcagatcttgtggaggttcctgaggaagccaatgggccaggaggcgggtatgacctaaggaaacgcagcaacagcgtgtttacatatccagaaaatggcactgatgatttcagagatccagcgaagaacataaaccaccagggatctctttccaaagacccattacagatgaacacctatgttgccttgtacaaatttgtaccacaggagaatgaagatttggaaatgaggccaggagacataattactcttttagaggattccaatgaagactggtggaaagggaaaattcaagacagaattggcttctttccagccaactttgttcagagactacaacaaaatgagaagatttttagatgtgttagaaccttcattgggtgtaaggaacaggggcagataacactgaaagagaatcagatctgcgtgagttctgaagaagaacaagatggttttatcagagtcctcagtggaaaaaagaaaggcctcatcccccttgatgtactagaaaacatctgattgctggctcctcctccgtttgcagtaggcaagctctgctgcgatgcctctgcctcatctcacactgcgtcaacccaaaggagctgccgcactgacccagccccccaggaaacagtgagacaagaatcaagtatctgagactgtggagtaatagccacaaaacagagggcccactgcacagcatatccaggctgccacaggtggggacgaggctgagagagtcagcaggcagagccagatgccatgcttggcagcagcagtaggactataaaccacagctgtcccccaggatcccactcctttcctgtctgtgtggtgtaagttaacacactggagtgtgctccagtttgcagggtagcccagtgcaaggttcagatccatgtagctaagtattatcctgcttccagacctatgtcaccagtaccaatcagtcagtgtcatcacatttcaggccccaagcaatctctgtgcaaagcatcagaaagacctgcttcccagcccccagcattccagtgctctccaggcttcctctctttgtgattgtgctgtccagagtgtccagcttgttctttctttctcttcagtcctctgagtacatctggtggtgtgcattagatgtgagggctatgttgacatggcatcacctccaaagacctgacctgcctaaagactgatgacaggccatccttcctgctgttctaggtactggcctgggtgacagagcaggacatgagacatagatacagtggggaggagaagtggggaaaggtggagcagagagttcttacttattgaagattatacagccctttcggttatgaagtccctgcttgaaggcaatggacctggggaagagactatcacaaaaagtctccattttcattttacatcctctctattggaggcagcacttttccctcatgctgtcctataggactccactttgaaggttgtgcctacgttgcagggaactaggaacatggaggggaaccaacaacagcatcttagaagaaatgtagccaaattggagtccattcttctttagggcagtatatgaaatcctagcagatgtaaaatggaaaagaatcctaatgcttcttccttcagaaagtagaggaactaggggcccaattagcatcatctaggggaatctctattactctgtacttatactaatgtttacaagaatgcaatatactgtgatgccttcctactcaagcctcctagcattcaaacttccatcctattagtcattaacatggttaaacttcaattcacaatcaccttggaatcaatgtcagtttgatttattttgttacagagcaataaaatcattagaacaatggtttttaaaagacttaagtggatgcatcctatgcatgtaagcattatttcccaaaccaaagcatcattcatctccatttatttcttttgttcccgctcagtgtgaagttgggaactgagaggggatggctgctggtttcacagaagtttggatgccttactcttatcttaaagccagcatccagaatttcctccctctctgatgccacatgcaaaaccaggtgtacgatgtcaagatggattctttgagagccagggtagatcatatgactgcctttctgtaaaattggatgcctagtacaaatgctctttgcctctaattcagtattccatttaataaaaacaatacagtggctggaaaggagcatcagaaaaaaatg

SEQ ID NO: 133910 - DNA, 1137 bp, Homo sapiens
ggcgagcagaagcccgctcgcccgctgccgagtggcagtcacgactgtgaggtcgccggcgaggtggccgcgggcgcggcggggcggggcagggcgcactctcctccacgcccgcggaagtgccggggaggtgggcagggcggggagggagagggagcgaggctggaggagggcacgtcggcgcctcggcgaggatgggagtccccaggacccggagctgagcagcctggcgcgcggcgggcagggcgcgcaggacagaagcctcgctgttcctccgggagcccaacaccgttcccgcgcggccacgatgatccctccgagcagcccccgcgaggacggcgtggacgggctgcccaaggaggcggtgggcgccgagcaaccgccctctcctgcatccaccagcagccaggaatccaagctccagaaactaaaacgatcactttctttcaagaccaagagtttacggagcaaaagtgctgacaacttcttccagcgaaccaacagcgaagacatgaaactgcaagcacacatggtggctgagatcagccccagctccagcccactccctgctccaggaagcctgacgtccacacccgccagggctggtctgcatccaggtggcaaggctcatgcctttcaggaatacatcttcaagaagcccactttctgtgatgtctgcaaccacatgatagtggcttctctcttgaagccagcaagaccacgagcccaccgggaggaaggaacaactccagacgcgtcgccttaagagctgtaacactcaccacgaacgtctgcagcttcactcctgagccagcgagaccacgaacccaccagaaggaagaaactccgaacacatccgaacatcagaaggaacaaactccggacacgccaccattaagaactgtaacactcaccgcgagggtccgaggcttcattcttgaagtcagtgagaccaagaacccaccaattccagacacacatatatgctaatcttagaaagacatggatactatctcccctctccactccatccttaaacatctcatgactattaagaatgagaaagggaccaagtggcaagagaacatcttcatatgcatacaactttccagaaaataaaaatttgccaagttgtca

SEQ ID NO: 133911 - DNA, 833 bp, Homo sapiens
tttcccaccctaaaactgctctcccttttccagtttgttgctcctgcaacctcagtcagcagggattcaagctgcaggttctaacttcgttcttgctgacagtaaagtattttgttttttttcttccttggcattcagatctgcgtgagttctgaagaagaacaagatggttttatcagagtcctcagtggaaaaaagaaaggcctcatcccccttgatgtactagaaaacatctgattgctggctcctcctccgtttgcagtaggcaagctctgctgcgatgcctctgcctcatctcacactgcgtcaacccaaaggagctgccgcactgacccagccccccaggaaacagtgagacaagaatcaagtatctgagactgtggagtaatagccacaaaacagagggcccactgcacagcatatccaggctgccacaggtggggacgaggctgagagagtcagcaggcagagccagatgccatgcttggcagcagcagtaggactataaaccacagctgtcccccaggatcccactcctttcctgtctgtgtggtgtaagttaacacactggagtgtgctccagtttgcagggtagcccagtgcaaggttcagatccatgtagctaagtattatcctgcttccagacctatgtcaccagtaccaatcagtcagtgtcatcacatttcaggccccaagcaatctctgtgcaaagcatcagaaagacctgcttcccagcccccagcattccagtgctctccaggcttcctctctttgtgattgtgctgtccagagtgtccagcttgttctttctttctcttcagtcctctgagtac

SEQ ID NO: 133912 - DNA, 564 bp, Homo sapiens
gacagaaaatctttaataatggttagataacacttacgatccatacactgaaattacattgcaatgacttctccatttcctgttttctttctttcctctctcaatttatttcacctttcttttctcatttttcttttattttctctttcagggatctctttccaaagacccattacagatgaacacctatgttgccttgtacaaatttgtaccacaggagaatgaagatttggaaatgaggtaaaaaccttctgtaaagaaaaaaaagagtaaaattttaaagtcagtatttctccatgtgaaaaagtaagtccatctgtgcccctcctaatgctttatagctgtgattctcaaactttagcatgtatctaatgacctgcaaggctggttaacacacaggccctgtccccagagtttttgattcatcagatctgaggcagggcctcagaagttgcattcctaaggagttcccaggtggcactgacaatgctgtccaaggaacacactttgggaagcaccactttagtacatgctcaacagaactgctaatgggagttttcatga

SEQ ID NO: 133913 - DNA, 1446 bp, Homo sapiens
ggcgagcagaagcccgctcgcccgctgccgagtggcagtcacgactgtgaggtcgccggcgaggtggccgcgggcgcggcggggcggggcagggcgcactctcctccacgcccgcggaagtgccggggaggtgggcagggcggggagggagagggagcgaggctggaggagggcacgtcggcgcctcggcgaggatgggagtccccaggacccggagctgagcagcctggcgcgcggcgggcagggcgcgcaggacagaagcctcgctgttcctccgggagcccaacaccgttcccgcgcggccacgatgatccctccgagcagcccccgcgaggacggcgtggacgggctgcccaaggaggcggtgggcgccgagcaaccgccctctcctgcatccaccagcagccaggaatccaagctccagaaactaaaacgatcactttctttcaagaccaagagtttacggagcaaaagtgctgacaacttcttccagcgaaccaacagcgaagacatgaaactgcaagcacacatggtggctgagatcagccccagctccagcccactccctgctccaggaagcctgacgtccacacccgccagggctggtctgcatccaggtggcaaggctcatgcctttcaggaatacatcttcaagaagcccactttctgtgatgtctgcaaccacatgatagtggcctgtggcaataaggtggaccctgtctacgagaccctccgcttcggcacctccctggcccagaggacaaagaagggcagctccggcagtggctctgactcacctcacagaacctctacttcagatcttgtggaggttcctgaggaagccaatgggccaggaggcgggtatgacctaaggaaacgcagcaacagcgtgtttacatatccagaaaatggcactgatgatttcagagatccagcgaagaacataaaccaccagggatctctttccaaagacccattacagatgaacacctatgttgccttgtacaaatttgtaccacaggagaatgaagatttggaaatgaggtaaaaaccttctgtaaagaaaaaaaagagtaaaattttaaagtcagtatttctccatgtgaaaaagtaagtccatctgtgcccctcctaatgctttatagctgtgattctcaaactttagcatgtatctaatgacctgcaaggctggttaacacacaggccctgtccccagagtttttgattcatcagatctgaggcagggcctcagaagttgcattcctaaggagttcccaggtggcactgacaatgctgtccaaggaacacactttgggaagcaccactttagtacatgctcaacagaactgctaatgggagttttcatgaaggttgaacgttaaatgcacttggcatctggtggggcctaatagggaatcaaaaaatatatttaatcaaatatcagat

SEQ ID NO: 133914 - DNA, 1629 bp, Homo sapiens
ggcgagcagaagcccgctcgcccgctgccgagtggcagtcacgactgtgaggtcgccggcgaggtggccgcgggcgcggcggggcggggcagggcgcactctcctccacgcccgcggaagtgccggggaggtgggcagggcggggagggagagggagcgaggctggaggagggcacgtcggcgcctcggcgaggatgggagtccccaggacccggagctgagcagcctggcgcgcggcgggcagggcgcgcaggacagaagcctcgctgttcctccgggagcccaacaccgttcccgcgcggccacgatgatccctccgagcagcccccgcgaggacggcgtggacgggctgcccaaggaggcggtgggcgccgagcaaccgccctctcctgcatccaccagcagccaggaatccaagctccagaaactaaaacgatcactttctttcaagaccaagagtttacggagcaaaagtgctgacaacttcttccagcgaaccaacagcgaagacatgaaactgcaagcacacatggtggctgagatcagccccagctccagcccactccctgctccaggaagcctgacgtccacacccgccagggctggtctgcatccaggtggcaaggctcatgcctttcaggaatacatcttcaagaagcccactttctgtgatgtctgcaaccacatgatagtgggaacaaatgctaagcatggactgcgctgcaaagcctgtaagatgagcatccaccacaagtgcacagatggcctggcaccccagcggtgcatgggcaagctgccaaaggggtttcggcgttactacagctcccccttgctcattcatgaacagtttggctgcattaaagaagttatgcccattgcctgtggcaataaggtggaccctgtctacgagaccctccgcttcggcacctccctggcccagaggacaaagaagggcagctccggcagtggctctgactcacctcacagaacctctacttcagatcttgtggaggttcctgaggaagccaatgggccaggaggcgggtatgacctaaggaaacgcagcaacagcgtgtttacatatccagaaaatggcactgatgatttcagagatccagcgaagaacataaaccaccagggatctctttccaaagacccattacagatgaacacctatgttgccttgtacaaatttgtaccacaggagaatgaagatttggaaatgaggtaaaaaccttctgtaaagaaaaaaaagagtaaaattttaaagtcagtatttctccatgtgaaaaagtaagtccatctgtgcccctcctaatgctttatagctgtgattctcaaactttagcatgtatctaatgacctgcaaggctggttaacacacaggccctgtccccagagtttttgattcatcagatctgaggcagggcctcagaagttgcattcctaaggagttcccaggtggcactgacaatgctgtccaaggaacacactttgggaagcaccactttagtacatgctcaacagaactgctaatgggagttttcatgaaggttgaacgttaaatgcacttggcatctggtggggcctaatagggaatcaaaaaatatatttaatcaaatatcagat

SEQ ID NO: 133915 - DNA, 653 bp, Homo sapiens
aagaaatgccctttaagcacaggactacaacatatagaaacttagattagtgactgaatacgatagattcagggcatcttgaagtgcatgatttggctgaagtatagagttcataaaggctattgatggaagataaaaagttgataagaaacatgggacagatgacagaagcctgaaatgccaagtatgaactgcagactagttatgaaatgcatgcttttgttgtgaggaagaaaaaacaggagggaggtataggatgatctattaccggaaggtgaaaatactgattaacaaatattgatcactgctatgtaggactacccaatattcattccaccccagctaatttttctaagccaatcatggtaatctcatcacatctcggcagtggttagttaggggataggtaagcctaagctaatgtgggccagttagaaaagagaagtttatttaaagtgtctggaaaagaagtttccttgttcttgagagcaacaaaaagctagcctcttagatatggtcagtccattcaaaattatgcccccttctagtctaaacaacttcctatgtgggctaatacaactcctatagttagtcaatttatattggggtttctgaataatccagagttggaggtagggtgtgaatggggctac

SEQ ID NO: 133916 - DNA, 270 bp, Homo sapiens
ccctcttccccctccttgtggggcaccccacaatgaccactgctgtgacgcctccactggggcgtggggctctgggtcctgcccgcactcagccctgaggtgtcgctcccgtccactgcggccctgctgggctgtgcaccttgtgcctggtaggtgtgatgggtggctctggccacgtggtcccatggtccaggacccggttgcacatgaaccttctgccaccctgctcagaagccccaggagccacgtggagattctctcactgggctt

SEQ ID NO: 133917 - DNA, 102 bp, Homo sapiens
aagctccagcatgagttgtgtctgatggtctttgaattagaatgtggagagggtagacaaaattctggatatcccttccagagtttctcttgaggacatcca

SEQ ID NO: 133918 - DNA, 648 bp, Homo sapiens
tgatcttgagcacctgggctcaagcaatccacccacctcagcctcccagagtgctgggactacaggcatgagccaccacgcccagcccaattctatgagttttgacaaatgcatgtagttgtcatacatataacctcaggcaagatatagaatattcccatcccccttgtgctatctgtagtcagtctactcctcccactgccaaccctggcaattctaccatccctggagttttgccttttccagaatgtcatataagtggaatcatctgtatgtagaattttgtatctttttctttcatgttacacggtggtcttgagattcagccatgctgttgttgtgtgtatcacagtttgttccttttcaatgctgagttggattgcgttgtatggttgtgacacagtttgtttatccattcctaagttgagggacatttggattgtttacagtttggggaatttttaataaagctgctataaacagttaaatacaggtcttcatgtagacgtatgtttttatttctctctggtaaatatctaggagtaggatttctaggtcatttggtgggtgtgtgtataactttgtaagaagctgctgaactatcttgaaatggctggtccattttgcactcccaccagcaacgtatga

SEQ ID NO: 133919 - DNA, 331 bp, Homo sapiens
ctgtgctctcccaggaggagctggagtgtgtatttctgggaaaagtgatagcctcagggacttctgggatgatgcttataaccaattgtgggagggtccccagggcgtggaagcaaagttcgacctggcacagcagcttcccttcatcccaggtggttgctcaaaatagaccagctgagactctaagccagcttctcctcctggtgacaggaaggggtgagcctcctggaaatggtgggtggagtttctccaactttcaggttcccaagaatgacctggagcacttgaataaaaacttccacatccgaggccctgctcctgatgcatgaca

SEQ ID NO: 133920 - DNA, 652 bp, Homo sapiens
tacctccttctttattatgtacccatcaggcacatttgttccaagtctaactccttctttctctgcagtattgttgaaatttaaatattactttttgccttgttaggaacttcatggaaatgatcttttaagaaaataatgtactttgtgaatacgttttatatatgaattatagtattttaggaagacaggaacttttttttttccctaagagatgtttcaaccaagaaaatcaatttttttccaactgcttcttcattttctcatatttcatgctggttttctttacaagatttttttttaatgctcatgaaactatgaccttgtataagtttcccaggagacatgattctcagcattttgttggacaaacatttgttttttgtaactacatgaacaagccaaattgcacgtagtccaaaaaataattctggcctttttaactacactctttttctttttaatgccatattcaaggaatcccagtacagtggcaattaaaacattcgaattttgccatttaaccatgagaaggatttacagccttggcacatatagtaagataagttaacactctgaggaaggtttcacagtatattctcattttaattgtcagttgagtggacatgaagaaggcatttctgttttacaa

SEQ ID NO: 133921 - DNA, 736 bp, Homo sapiens
ggcacgatcttggctcactgcaaacaccacctcctgggtcaagcaattctcctgcctcagcctcccaagtagctgggattataggtgcacgccaccacacccagccaatttttgtatttttagtagagacagagtttcaccatcttggtcaccatcactcctgaccttgtgatctacctgccttgggctcccaaagtgctgggattacaggcatgaaaaaaatatgtagcgactttaagataaaattgctactaaaaacaaagaacattttaaaatgataagaggaccaatttactagaaagatataatgattataaacatacatgcacctaacaatagagccccaaaatatataaagcgaaacctgacagaatgtatacgagaaagaccacaataatagagacttacataccccacttccaataatagatagaaggactagtcagaagaccagcaagaaatggaagatttgggtaacactataaactaactccacctaatagacatgacagaacactccatctagcaatacattattctcaagggcacatggaacattccaggatagactatatgttagaccataaaataagtctcagtaaattaaaaaagactgaaaatatacaagttatgttctgcaaccaatgggaggaaattagaaaccaaccacagaaaaaaatttaagaaattcacaaatatgtaaacatttttaaaaatcctaaagaatcaacaggtc

SEQ ID NO: 133922 - DNA, 244 bp, Homo sapiens
gaatcatactgcagcatcacttaacagttgtgtgactttgggtgccttatttaaccttgatgaacttctgcttatctctgtaaactgcgcataatagtatggactttagtgttattgtaaggattccatgagattaagtaaatgaaccttggcatggctttgagcttttactgtggttctttaatagcagatttcagggtggaatgtactcaggagcatcagacaccagggatagtggtggatg

SEQ ID NO: 133923 - DNA, 228 bp, Homo sapiens
caaatcaatatgatgaactatgcaaaattgaggaaatacctgaaggcaaatctccagttatgttctactaaaataactgactacaagatattgtaaatataggtaacatctttgacttttcataattaaatatctctagtttcagatttctcaggaaaaaaatgggctataaaaattacaagaaattctagtcataaagctaggttacaaatacatggaggttcatta

SEQ ID NO: 133924 - DNA, 406 bp, Homo sapiens
tcctgtgggtggatcctatctccaggtataaactcacatctaccaggccaggaaggataaaaaagctaaatgtttccagccatgaaatgaaaccattcattctgacctcaagagaaccttctgagtgtttttgtggggggcggtgtgaaacaggttcatagtctgcatcacggctagagaggagaaaaggtattccttagaaagtgggtcagagatcagagagatcccatggggagcatttggtattgggctgctttttcctttctgatgttgttcgttctttaattcttcatttactgagtgtcttctatcttaacttcggctgctataacaaaacaccgcagatgaggtggcttaaacagacatgtatttctcattgttctggaggatggaatgctgcgagggc

SEQ ID NO: 133925 - DNA, 756 bp, Homo sapiens
tatcagcattctacaaggtgagcaggggaaggaaactgagggttcaacttctccattggtgaactccattggagttcaacaactccaaccctccaagtgagggtccagttctcactcagtgcctttgtttttggccctttgggtttcctatgctgggctgggtgtccctgagactggaacctctctgtttcaatctccccagacagtaaggctcatgtctccgataggtgggggagagttgctcaccttctaagagagaagcaggagagatcttcatgctctgactgctttttataggttttcaaccagtcctcttactttcagctgtacctgaacacttcctgtgcagaggtactaggtgcctcagttcctgaggggaccagtggctctgctgtgaggactggttccctcttgtcggcttctcctcctgcctgcagtaagggctcacctttctctactcagccaagtcagttattactcatccattttccttcttccaaaagtttgctgaactgtcttgttcagggtcatctctttcctgctcctctttgtcctcgtaggtttatgtctttttagatccctttatggttatgtttattgggtttcagaagacagtgaagaaaaatgcatgttttcaatcacccatgtttaactctgagtccactctaacatttttggttttaatttgttttgtctagcccctagtagtatcaatatgggagctggtttggtttccctaggaagtataattttgta

SEQ ID NO: 133926 - DNA, 331 bp, Homo sapiens
ggagttcaagaccagcctgggtaacatggcaaaatttggtctctaaaaatatacatacacacacacacacacgcgcgcgtgcatttgtatatttgtttactttatttaatttaatttaatttatttatttatttgcaacggagtctcaaaaaaaaaaacaaaacccccaaaaaacaaaacaggaaaatcttttagccagaaggtcaacagggctgagtgtgtggctcacacttgtaatgggatttggaatttaacactccctttggccaacaggttgtaatcagctcttttggtccatcaccagcaaaaaaaccactttctttttaggcac

SEQ ID NO: 133927 - DNA, 770 bp, Homo sapiens
cagattggatcctggtacttcttcactgccttgtgaagaaataaacgtatttcttcactgccttgttaatttttaagtgcttttaaacatattttgcccagatttttttgagtagcttcagcagaagggttggtttgaattatcttagttctttattatcagaattggaagttcttaaacttttgaggagaccattttcggaaagatttttgaagactcaattacacacacacacacacacacacacacacacacacacacacgtctgaatttgcctccttttctgccatgggtacacccctccctactggcccacccaggattgctcccatggctttggcttcaaagctattaggttgggatcactggtctcataggcagccatcacggctctggttcattgaatgccctatacgtgattttagcctgtgaaacttcttttactaaaaaaaaaaaaaaaaaaaaaaaaaaaattttgtgggggcgtcagcgacccacgaaaaaaagtcttgtcaagaacaacaatcctggtggggcgcgcgcgcaggcccattgtgatgaccatgcagcaaagcggtcacacaagaggtgtccaacagaaaaactccgggggacataacatgcggtgctggatctccccaccagtaaaaaaaagcgccggggggccaccgccggcgcgtcaggcaaaacagcacgaggcagagctgtgcgggacaaaggcggggactacacacgagggagctcccgaggagccagcatattacattagg

SEQ ID NO: 133928 - DNA, 527 bp, Homo sapiens
tgggcaacagagtgagactccatctcaaaagaaaaaaaaagagtatgtttatgtgtggttgaaacacatatacctttttggtttgtttgcacaccaagtttctagaacaacacataggctgttgacactggatagttttaagggagcacggcactggttagaggtttagaattttttgttctacactcctatacaatttgagtatttcccattgaacaagtattactttattagtaacatttaataattaaactatcaaagaaagatcaataaataaaatatgttctatattaactaataaaggagaaaatggctaggggatgcagtcactgccttatatttttctgtgagtccctgttgtttactaaagtcatagctcttctgtaaggcaaccaaaatataaaggcccagatctgaaataatttgttccctctttttttagacaaaacgaatacactaagttcagaaagtatacatttatattcataaatgtaggatatatctttggcaaatcacccatggatgct

SEQ ID NO: 133929 - DNA, 402 bp, Homo sapiens
gcagggtgctcagggaggacatgtgcaggaggtgacgtctgaaaagagagcacgcaggaatccagtctgccaatgagggaagctgacacagggtctcagtgctcgggacgggggaatgctggtacccctggttccacggctgcatgctggagatgagtgcaggagcacagggtgtgagggggagtgagacacctggtctggctgtttctgcaggccagcgccctgcacaaacagtaccttctgcaattctccgaggccttcccctagaatctcactggtgtcggttgatcaatgtgtgtgtgcctgtgtgtgtggaagagaagggagcagtcgagggagatgaaggacttcttgcttttagggtggatggagttcagacaattaactgtaaactaaaagagg

SEQ ID NO: 133930 - DNA, 399 bp, Homo sapiens
accccttctgtccctcaggtaacgtcagcagggaccccagaggtacctgataaaccaagcagactaacataacgctgaaaggctctgacgattaaactgtcagtgggaccacaggccacaaatcaggccaggccctgctccctaagcagaatcagggcaattacctgctaaaattaaatatttaaataagacccagaattccctaataggtaaaatgggatacaatagaaaattcctttcataccaagtaccaagaaatgtgcagcatgaatgagaaagacaatgaatgccaacgtcaagatgaaccaactgctggagttatctggcaaggatctgaaaacagccatcataaaaatgcttcaagaggcaaatctgttgaagaaatgaaaaaatagaaag

SEQ ID NO: 133931 - DNA, 430 bp, Homo sapiens
ccgtttaataaattcacacttaaaaaaactagcagtcacttgaaatgcctttgtaaatatgaatcatacatgcttttaatttgtatgcaaagaccttgaacccaaattgtctcctacactcattttaacatgaaattaatgatataaattatgtaaattttgaatccatgaggttttctcatttattacttggaacatgaattaatatatgaatacattaacatgtaaatcttaaatacataaatctgaacctaagcaaatataccataaatatggtttcactacaggtgatacttgcaagtaaaaaaaattgactagaggcgggggatgaacaagatctagaataatttggctccctttaggaaatgtgggaaaagtgaatatgttctttgctctttccagatagtctgaaatgcatacatgtctgtca

SEQ ID NO: 133932 - DNA, 647 bp, Homo sapiens
  misc_feature (415)..(415): n is a, c, g, or t
  misc_feature (463)..(463): n is a, c, g, or t
  misc_feature (552)..(552): n is a, c, g, or t
  misc_feature (570)..(570): n is a, c, g, or t
catcatggcagtctcctgtattctcagctacctgggaggctgagggaggagaattgcttgaacccaggaggcggaggttgcagtgagtcaagatcgtgccactgcactccagcctgggcaacagagcaagactccatctcaaaaagaaaaaaaataaataattcaataagtgaatgaacaggaattggggtctcaaagggatttagcctagtaagggaagtcacaaatgagctgagatacgaagatagtgtttgccagtgtggggaagagtgaagaaccacccaggcagtgggcagagggaaaaaaatgttcagggccgggtgcggtggctcacttctgtaatcccagcactttgggaggccgaggagggtggatcacctaaggttgggagttcaagaccagcctgggcaacatnggtgaaacccccgtgtctactaaaaatacaaaaaattacgcaggtgtnggtggtacatgcctgtaatcccagctactctggaggcagaggcacgagaactgcctgaacccagaaggcagaggttgcagtgagccgangattgcgccaccgcactnccagcctggggcggtagtgggggggtatggggagaaagagtgagactctgcctcaaaaaaaaaaaaaaaaaaaaaaa

SEQ ID NO: 133933 - DNA, 219 bp, Homo sapiens
gagtgcagcagatgttgagtgaaacttttcatatttccgcggaataaacagctaaggcctaagcaggaatgctgacatgtggggacagatgctccccacatccacattactgagaggcagcagcagaaccattcctacctcactgaaacatacctccacgcccccaaaccgcaaagggagaggatacgtgaggacaaagatcgacagttgaaatgagga

SEQ ID NO: 133934 - DNA, 459 bp, Homo sapiens
tctttcagtcttttcaaaatatatatttgaaattattttaacataattgaaactaaattttatagctttatatcttttttaaggattatgtaataaacattttccaagttatcaaataatttagattaacttttattttgtatagtatctccatgtcacatagatagcctaaattgtattttttcatttggatattataccatccattatggaaggacttttaaggttttgacaatgtagccattcttgtaatataaaaaagaacactaaccttttcacattttaaacttttcagaatcaaattatgattaaagctgctattataaacatccatgtgcaggattttatgtggacataaattttcaactcatttgggtaaacctttaatatattgttaatttgatactctttaaatacttaaataaactcagcaaagtttggaaaataattctccaagcc

SEQ ID NO: 133935 - DNA, 253 bp, Homo sapiens
tgatcctccagatttgggaaccttccatcctccccctagcccagttggtagtaggggttctcccctgaaccccaatccctcctcctaaggtggaagggcaaaaatgtggacttcgaaatcaacatatctgggagtgactctacagtgtacctttttactgtcattaaaactttgacaacttacttcaattttctttagataggaggaataataataccaatctcagagattttggtgaggatgaaatgaggta

SEQ ID NO: 133936 - DNA, 348 bp, Homo sapiens
caacagactaggaagtatttctgctaattcatgctgaagtgtgattggctgataggtgtggtctcaacctccctcctctgccagtcactagtgtaccactgtggccatcttttccagcccctcctctgccccttgagtatgtctaggtcctagaaacagtggtcagggctcttcaagtcctctcggttgcccttgcccactggcacacgtgggggttgctgtcttcagcagagccagccactccgtcttgacagccagggcagagatgtggctgggcacacagcaagaatgtgaccactgatgctgggatgtcagagtctgtgcatcaacccagggttctgagtctgg

SEQ ID NO: 133937 - DNA, 302 bp, Homo sapiens
tgctaggattacaggggtaagccacggtggccagcctcttgacttttaaaataaatcacagttggtacttatggatttatttttctgattattggattactgtctctctatgccactagatgctaagttagttccaagagagcagagacctttctgctttggttggcaatttatcctcaccacagtagcctgcaatcagtaggtgcacaataagtaattgtttaaagaaggatataaaaataatattgccactggctatcctagccagggacgaggaagacacttcttcacatgggagacta

SEQ ID NO: 133938 - DNA, 771 bp, Homo sapiens
tacaaaaacaaaaacatttttcataaacatttatagaatctgagatggactaccttttttattctatagttgccttttccccttgtttccctcctttcttccctctttccctctctcttataccccccttctttttactcattttcttttcggggtgacttttttcattgcatagtgcttacatattccatggtgtaatgttattttatagatgtgagtaagtactagtaggattgtaatcttctgaattgttactttcaattgtttaggcccacaccaaaaatatatttctcaaatgaactcatgagtttattactgtttaaatttaatatacttcataataacctaaagattagttatgggagttctaccaagggggcagtctggtagcaagcaatgaggtgggggtgactaggagtttcaaagttttgtttaaaaacttggaaggcacatcatttttacttaagacttctttgtttttgttttttgttttttccttaagtggggctattgaagattcaagaggtgctagaatcccctcaagccctctcttggtcccattattgaatctacatgactagccactcactcccttaatttgtcttagttgcttggaagtggaatttttgatagcagcctaaccccaaaatggtctagtagctggcccactttcatcagtttaccctttagttgtttttttttaaccaaagctgcaaaaagaaatagaaaaccagtccactcccatgacttgcaggatcatctctttgaaaa

SEQ ID NO: 133939 - DNA, 531 bp, Homo sapiens
gattaagttaatcttattttacatgtgtagaaactgaagcctattaaagtcactggttggtgttcacatgaacgaatcagtagaaccaataatataaactaaatttctacttttggtcatgatggaagaactacatttaccttcccatcttaaacaactagcaaaccagaaaaagtatataaaaaccacagccagacattgatcaataggtagtatagaactgtgacaactgaaagaaggaacacaaacaaaatgattcttaagatcactcttactgcttggaggcagtttccaggccacagcacatggagggggagtccaagcagagtcttgtggtctaccccagtgaaggacaaagagattagggtggggtcgtgggggaggtgcaaagcagctcaaatgtatggggcagagactgcctgaggagacagagctgcacacaaaaggcattctggagatctgccgaggagccttcttgagtcttttactgatgacttatctgcatatatgtgggaagaaactattgggaaa

SEQ ID NO: 133940 - DNA, 491 bp, Homo sapiens
tattccagggggatttgccgggctggtaatttgtttggtgctgataattgcatcttacatttttccagctttacttaaaactgtgtgccgggtttgccggcatttaattactgctctgcggcagccacaaggttatttattaaagagttattttatcttgatacagtggatcctgcccctcatcccctccttaatgttgtgttattttcatcagagaaatttctctgagtgaatgcagattgcggggctgcctccccctgcgattaggctgtcactctactgaatgctgatgcctctgggcgccgcaccgccctattatagggggttgtcagcgcaaataattagacttaaaagttacagctgaaatataatccagaaatggcagggccctgttttggaaattgtctataaaatgtcagcactaaggatgcacagggaacggtaatatactggcattgttggagcctaagattagaccctgagtgcatttt

SEQ ID NO: 133941 - DNA, 723 bp, Homo sapiens
ggcctctctggtgtcagtaggaaatcctgatttttagctacggttggtgtgcactaagtcatcttcagaagttggtaggattctgtgagtccagaggacagagcttatagaggcattagtattgtaggactaattgtggatcctgggtgccctgttaaagtaacccttgtcatcatttatgctaaagatgatacccttctggcagtttgccacagtacaattcagatgcatctgcttttaacccttttccgttatcattggaagtctgacagtgcgctgcataaacaccttgagtaccacagcattccgtaatatcaatttctagaagaagcctctttctaatagtagtgtggccggtgcttattaatcatctagctactgagttactgtattggattaaaatatataaagagagagcacaccaaatctatgcagattcctttatcctagtatgtcagtttccttttctatctctcatttttaccttatttactgtaacaaagattgttgattttaaagacttatgggtaccgtgctctctttttagttaggtaggttaaatgagtattcataaaagcaaatgttatttttctacattatgcagatattgaaattgtgtattatgagcaccagtttggttaagtactttttgtggaaccagttagagctaatatctaaaaaaggaagaaaatgatttgtggaaccagttagagttaatatcta

SEQ ID NO: 133942 - DNA, 372 bp, Homo sapiens
ggctcactggaacctctgactccctggttcaagcaattctcctgcctcagcctcccgagtagctgggattacaggcatgcgccaccatgcccagatatacctttttttttttttttttggatttttagtagagactggatttcaccatatcagccaggatggttgccaggatggtctcagtctcctgacctcgtgatctgtctgccttggcttcccaaagtgcagttgcaggatctcggcttcctgcaacctccgcctccaggttcctgcaccctctgtctccggtgggctgagctgaggtgggacagactgacgcggagaggaagggaagccacctggcctgaagatcctgtctctaagatcaggttctga

SEQ ID NO: 133943 - DNA, 700 bp, Homo sapiens
tagttagtgcctgagttagcaccagaaccaaagtatcccaggtcccagtctagttctagttttacttgttatgggtaatagctaaaacagaacattctggaatgtgggaataatgaaacagtattttgtttttgtttcgtttgtttgttttgagacagaatctcgctctgtcacccaggatggagtgcagtggcgccatctcggctcactgcaagctctgcctcctgggttcatgccattctcctgcctcagcctcccgagtacctcagctccctcagcctctgggactacaggcgcccgccacaatgcccggctaattttttctattttttagtagagacggggcttcaccgtgttagccaggatgatctcgatctcctgacctcatgatccgcctgcctcagtctcccaaagtgctgggattacaggcgtgagccaccgcggccagccgaaacattattttaatgcttgtcagtaatgagttaaaataggaaaattgcaccatgattcccatctccacaatacctattcatatatgttccatttgtaccaacaacaatgatttttaaaatatatgcctttttgtcctttctttgcctcagttaacacaacacaatgtattgtcttatggtattctattttctcatatatttgttattcaagttttcaagaaacaatgtaaaaaatttagttactaatc

SEQ ID NO: 133944 - DNA, 307 bp, Homo sapiens
cactgtagcaaatgtcttggaaatcagctagtctgtgtctttggtaggccttaaattactagtatgttgaaaaatctttgtggtgatgataaatgaactaacgtttattaagtgcttcctgtgttccaggcactgtgccatgcacgtcacatacacgttcttatctaatcctcatgatgatcccagtagacaggtactatatgaagagctttcttcagggtggaagatcctgaaggcacagagggtgcatgaaggcagttgctgaagtcctaccagcccatggtagggctgagacttgcagccagaa

SEQ ID NO: 133945 - DNA, 506 bp, Homo sapiens
atcttgggctaggcccagcctgttgatctgattttaagttggttacctctgtgaataccctgattccaaatatgatcacagattgaggtactggggataaggagttcaatatatcttttttggggagaagatgggacacagttcaacccataccaccaccaacatgataacaagtgaaggctatttattcagcacttgctataccaagagaatccaccatcatcacttgtgtttggcagagactcacaacaggcagaggagtgggaaagcgctatagtggaaaaaagagaaggttctaggtatgccttaactggaagctgtggcatggggaagctgtgggcaggctaactagaagaggggcatcatatgtgattggttgggagtacatgtatggctttccctcattggtccttagttgaaagcaagaacaaaaattaaggaattgtgagttattatatttagtaagtgctggccatttggagccaatcggtacaggggtattattg

SEQ ID NO: 133946 - DNA, 444 bp, Homo sapiens
atcccccccgatagccggacagaagcagaaagggattagtggcatcatttctgcttctgtcagcaaaaaaagaccgattaccaagaaatattcatgtcccagagttatcactgaaaagtctctttgagaaatacgttttcattggactttatgagaagatggaacaagtgcccaagttagtccagtggctcatctccattggtgcaagtgttgagactataggaccgtatccccttcatgccctcatgcgactctgtatccaagccagagaaaaccatcttttccggtggttaatggatcacaagcccgagtggaaaggccgcattaaccagaaggatggggatggctgcactgtcctgcacgtcgtcgctgcccactccccaggatacctcgttaagcgtgagtagtggcattacccagagggtgcgctgtggctggctggtg

SEQ ID NO: 133947 - DNA, 697 bp, Homo sapiens
accatgaggcaggcagacattagagattactctcttgacattgtcctctactttcttaggacccttgccttacattgtacttggaatggcaaaacacttgtggtgtaatttgggagttcaatatggttagtttgggagagcagaagctctcttgagttaataatgtattgcagagcaggcatggggacgtctaggaccttggctgttccctccccaaagctatagaacatcacagaaccagggaactgtggggctgggagagacctctgaggaagagctcctttttcaaccatccattcacttgctcactcaccaacatcttgagcacatgctatttgaaagtcattatactacatgttgctcttgctatggagactaaaaacaggtatgacttctgctctcaggaaactcacaacccagaaagccgggaaatagcatgtcacacagctggtgggactgttgggagagaaagcagtaaggatgaaaatgttttcagttgaaatgcctaattctctctagacttccaggaaggggcctgacaattttggcacaaggactaccttctttccagtgcgtggctcatgtccctgggtctggcaagtccagaattagtagtagagaactcttgtccaaagcactaatttggaggctgagatttattgttgtcacagcacctggcttacaaaaataagctttg

SEQ ID NO: 133948 - DNA, 280 bp, Homo sapiens
cactgttaccataagtggggaataacttatgggctgtatattaataatatatcaatatataattaataccaatgttatgatacattaatatataattaatatatcaattatatattacataagctttattagataagaaatttaaaattagagccttttgcggtggtacccacctgtaatcccaactactcaggagtggagaatcacttgagcccagttcaaatccagcttgggcaacatggtgagaacttgtctcaaaaaaataacggaataactaagt

SEQ ID NO: 133949 - DNA, 833 bp, Homo sapiens
gtccttagtgatccttgaagagtagctgcaactggaagacacagaatggagagggtggatcatgcaaatgaaaagatgggctccaacattcagcggaaggaatttatggttggttcccccgtttttttgttggcggtggtggtttattttcattccccatgcccggtccttctgatggcactcactgatttggctctagggcacaagtctatgttgcatgcagtcctggtgtaacaatcaattgaggcatttcctgggcgaggagctgggacacgggccaagccaatcagactctggttcccccaggacgctgagtcatagtggagccatgccaagacggaaacagctgacctgctgtgctgctgccatggctccctgaggagtgtccctcagttcctaagaggggactgtctgcacgctggctcttatgggttgattttgcactttttctttgattctgagagctacccacatcctctccaattcttgctccagtcaaccagacacagtttctattgcttgcggtggaagacatgcccatgcagaaggcgtcaaggctcttgggaagatggggagtggcatgtgttctcatggtgttcacagctgcacatgggaaacacctcattgccttcgcacaacaaacccaagagggagggggttccttccccaattctgcaaatggaaaaactgaggctcagaggggaaattgatctctcagtgtcacagccaatgaatgacagagggaaagttgtggtccagggctgagtccgggttccacagtgtgtagatgaatttcttcaaccccttcatcatgtgacaagagccacaaggtc

SEQ ID NO: 133950 - DNA, 245 bp, Homo sapiens
agacaataggggaagagatttttatgttttgttcactgctgttttcacagtatgttcaatggctcttggcacagaatagacaatattcgttgactgaatgctattggacattatctgtttattgaattagtgataaatattttaccctacgttgatataaatggacatattctacaggtaacaaccctttatttctaaagcatgatctcaatgtattataaattactgaagtagattagttcttt

SEQ ID NO: 133951 - DNA, 377 bp, Homo sapiens
gctaatatattttcttagtgttaaagaaaagaatgttaaggagttactcagaaagtaacttgaacttttggtgtgggctgttttgatgattgttgggaagattttctttttttcttcattcctggggccatggtggctgatcatccaagcttggattaaactctgttccttgtacttttccttctcattttaggttttggagtcagtatacttatattaccaagaaaataaggttcctccaacttgtaagaaatattttctagtttcagagaattatgaattggtaaagattgaaaaagatggtatggatgtgtttgaattattcacttttatggtgtatagtcttcactttccatgttgtgttttgttggactcaa

SEQ ID NO: 133952 - DNA, 456 bp, Homo sapiens
tatggtggcttacacctgtaatccctaatttttacttctgagaaatgcaggattctatctgaactgggctattttttttttctgaagtctcttatattctcttttttatttgaattgacttaatctccaaccaaattataaaaaaggtgaacatgtataaccccaaatctcaatcccagatctgtcttaagtctacatgttatcccagcactttgggaggctgaggtgggtggatcacctgaggtcaggagttcgagaccagcctggccaacatggtgaaaccacgtctctactaaaaatacaaaaattagccgggcttggtggcatgtgcctgtaatcccagctacttggaaggctgaggcaggagaatctcttgaactcgggaggcggaggcttcagtgagccgatatcaggccattgcactccagcctgggtgacagagtgagactccttctc

SEQ ID NO: 133953 - DNA, 393 bp, Homo sapiens
  misc_feature (353)..(353): n is a, c, g, or t
  misc_feature (366)..(366): n is a, c, g, or t
aggatagaaatgtcacccaaaagcaggatggtgcagacaggtctcagaggacaggtaagcaaataggcaggatgtccagcatttgagagaaagtgcatgagctcagtctgaaagcagattccatatacagagtccaggttaggagccctgggatttagggaagaaagaaggagtggactgatggacaaagtccaaagacacaggccagactgcagagtggggaagaaggagctatggtggacatcattgaataattcatgggctttttctaattctccttagtccttctagaacacaggtcaacagatgtttacgactccagtccccatgatctaagtcaaggtcccagtggngatccatactgtngatggcttgctgaccgatagggaattt

SEQ ID NO: 133954 - DNA, 717 bp, Homo sapiens
caactccttcaggtcctttttaaattctctaccactactctcaaatttgttagctataaaaacaaattgtgaatcagtaaaatgttagataatgtgaatcattcctaaatttgaacttttttttaggcttggtaagttccccactgtctcctattacagggcttcttaacttggtatatgactaggcttgggagagggatatgaagccttaaattctactgcagactttcaaatgtaattatttttatgggaaatgcccacaggtatttttattgtcagattctcaaagtagtctgtaattcctaaagggttaagaaccactgtctgattgctgctaaacaagcaactttctttctttctttctttcttttttttttttgagatggagtttcgcgcttgttgcccaggctggagttcagtggcacaatctcagctcactgcaacctccgtctcctgggttcaagcgattctcctgcctcagcatctcaagtagctgggattacaggcgtgtgagccaccgcgcccagccaaatcttttttttttttaaacctctgtgaaatttgtatagtttaggcagtgagtacgctagattttcattgaaaggggtgacctttgggctagagttttaaaattcaggtagtgactaatccaagtcttgatttatgggcaggacttggacctgcagagaaagtggcatttcttttcagatgggaata

SEQ ID NO: 133955 - DNA, 720 bp, Homo sapiens
atccagagactggtgcagtcataaaattgtcatctgtcaattgtgagataaacgtggaaagtgagtaaatatttggaacttttatagcaatttgacatttccataacattctgttttacaaaattatcagtccataaatgattgagaattgaaaacaaagtttgttctttcccagaaataatttgagacaagactcacacttttcaagacatgagacaagtgacaatttaaataagaaattcttcacttgcacctctctgattagaatagcagaatattcatactatagcaagatttggcaaatgagggaatcaaaattttctaatgcctgtaacagcataagataatttataccagatatgttaaatgtgcagaagccttccaacactattcagtctttgttaaacttcagtaagttcatcctagagagtaactctgttaatgtaacaaatgtaggaaaacccttatccatggcaaataccatactgtcatcaccatttcacctccatactacctgtaggatggtgagcaaaatgcttatctcttctggacatgatgtttcaaatgctgatggtaactaataatgctgttacagagattagatggatttagtatgcatcatatccttggaagagtatctggtatgtagcctatgcttaatacatattagctattgttcatattgtctttattattagtattactactggtgaattctta

SEQ ID NO: 133956 - DNA, 389 bp, Homo sapiens
ccgccgcaggaggacacctctccaccaatgaggacacagaggactgggtaaagcggcagcttgtgcaaggtcacctagctagcaagtggtcaagccaggactcaacccagggcctctgacacacgctaggctagcactttctccaggcagaactgtgctctgcttttcggtctgggcttgtgactgctgcttagtaagcaataggatgacccctggtgttcacttaaaatgacagcagggccgggctcacgcctataatcccagtacttcggaaggctgaggtgggccgatcatttgagaccagcctggccaacatggtgaaaccctgtctctactaaagatacaaaaattagcctggcatgatggcgcacgcctataatcccagctac

SEQ ID NO: 133957 - DNA, 320 bp, Homo sapiens
cgagagggagggtcgtggctcggcccctgctcagacaaaggctgggaggcgggagacatgcacttccccttccttttcagccaggcgcgcgctgataccaggcccacgtcagctatttttggagccttttacacgacagctggaggagcgtcctttttaattttccccttttgtttggccgcccccacccccaccccttcgccttcatcgctgcacttgaggctccatcctggggcctctccttgacttgacctgccttggcaggcacatgccctccctgcctggctcactcgccgcagagacctggcagcccgcgcaaa

SEQ ID NO: 133958 - DNA, 258 bp, Homo sapiens
agctattctcctgccttggacctcccaaagtgctgggattacagacatgagccaccataccccacctgagaattttaaaaaataatcagaacattactgacatgtgggacaatttcaaggagcctaatgtacatgtaattggaatccctgaaaaagagaaaaggaggaggaggaagtaaccaaattacttaaaaccaatgataaagagaaaaaagcagccagataaaaaagacatattatatacagaggaacaaagat

SEQ ID NO: 133959 - DNA, 297 bp, Homo sapiens
gtagaatttgccaatttctgtagtgtaaatacttctaccatggccaagtttaagctgctcacatgatgtccctcaacgtggagcggggacatgtgcacatttggcttatgagcttgcgtatcttggttcccacgtacctttcaccctgagggcactgggtgacattgccaggtgtctgccaccagggcctgtctggatgtactgatccctcagtactctgatactttgtagtaattaaggtagtactgagcactatgtaaatattatactcctggcttatattttatgtgcatctga

SEQ ID NO: 133960 - DNA, 803 bp, Homo sapiens
  misc_feature (69)..(69): n is a, c, g, or t
  misc_feature (85)..(85): n is a, c, g, or t
gtgatcttcatctagtacagcagtgagcatcatgctttcctctttccgtgtttttacgattgtctgacntgaagaacccggcgancttggaagcttagataaaggcagtaattctatagaaagttaaaatgaatgtttgaatagcaaaactatttggtagttttgaaagtaaataaaatgttttgctgtcagatagtgtttatgtggagctgaagacttggatgcccctttcaagagcacagcaccattgcaaggggctgctgcaaggacctctgatcgctttgagggcccttgtgcttagggttgcctccgtcacacacacctgaccctgcactgggtgctggatgttggagataggaagtaattgggagaaggaggggagcaattaactaaatacagctgaaataaaaggctgctctaagtatcatgggtatctaagagggtaattggagagttggatttttttttcctgtggactaatcagtaaccattattttgatgcatgaaaagaactacagataactaccaaatagcagttagctttcaaaccggcgctcccaggaggaagtgtggcaactattcagaagttcactgtcttttgcaaaggctgagtactgaagtgacacacttcatttactagagtatttgcagtaggaaggtgacctaatgagaacaaatggtaaacttcaggagctttctcatcttctgactacagggtggtgctacagattacttgcctgtacttgatgcacaagagatgtgttgtgacttgttagtagaattaatcagaaaaacacaaaagt

SEQ ID NO: 133961 - DNA, 825 bp, Homo sapiens
gcatatatttgttttttagtgtggtcttaggtatttattgcaaaagattgaggacaagtagtataaccatattttattagtgaggtgttatctcattttaatttacatgaattttttaagttatttatttacttttatttctttatcatatcttttcctctatattcaagaaggtacaggtatttggggcataatactgagattctcttcaagtcaaaggatattaactgagtgcttgtcatgtgaagatcctaaaacaggtgctaagggggataaaagtataaaataagatctagtatctgttttcaagggatttagagtctataaggaagaacagataacagatatgaaaaaactctggcttcagtttttctcatttgtaaaaatgatcagatgtctcatttagttaaatgacagtggaaaataagtctagagtgatattcctgttattagctcagataagtgggtgcaaggcaaatgagctcttgaattggaagcttatacaaagcccacactataaactagttccgccttcacaatagaaaccttgatggaagtaaaacagtcaagttaataggtaatgaaaatgtgtgtgtgagataccatgcttaggagttatgaacctcttgatcagaaatttaattatcaggcatattcgtgtattttaaaatgccaggtaaacagcaatattaagagctaattaaaagaatgttagtatttgctgaaactgcataattggagaaagttaagtttaatttgagacattggtagagaaagttaaactttgcttgtttaggccagtgcaggagcatgtttaccaacaat

SEQ ID NO: 133962 - DNA, 390 bp, Homo sapiens
agagcatcatttagcctttctctctttttctgtccacagagttcaacagagtgcagtgggagaaagcatacagttagaagtcatgagacacaaatgcttctatcctcatctctgcctaatgctagctgtgtgaccttggacacattactgccctctcccaactcagacttccttacttcaaaaaaaggagtaataggaatcataattcctacccacctcaatggattgaaaggagctgatgaattaatgtatgccaaggtgcataaataattgtgaatgctttataagtatgggacaccaccgccaccaccatcatcatcatcatcatcgtcgtcatcatgatctttatttcctcttggccatggtgtagagcattccagtaagaagtcg

SEQ ID NO: 133963 - DNA, 467 bp, Homo sapiens
gaatccatgttttcaaatgctctgttttctctcaaagtccctgtacgcctcatgattagttgaatccaattatagaccaggtctggtttgaaatatcattaacataataattattatgggctgtcctctcatttaatcctcacaacaagcataagaggagataccatttttatcctctttttactgataagaacacaaggtccagagagttaagatgactttctgcttacgtggcagagctcacatttgaacccagggctgtgtgactcccaaacctgtgctccttattagcctccagtccccatactaccctgtgatgggtgtagggatcattcttcccttgctacagttaaggaaactgaggccaaacagaagagatgttttcctcagggtcacatagcaagttcatggcacagctgggtgaacccaggctctgtgtctcctggccaaccgtcactcccccactc

SEQ ID NO: 133964 - DNA, 330 bp, Homo sapiens
aatcatcgagctcggcccctattttagaagtttcaatagcagctttgtgatcttctgatgggggagatagagaatagtgtgatgagtgctatgaaacagagggatgctggagcatcagagaggaaacaaggggcagggctggggaaatgttcctccccgaagggatgaggtctgggtggagtattagaactaaaaggagttgtacagacaaagaaggggaaaagcgagagttattttaagctggagtgtgtgtacagtgtggtggctcagtgtgtgcgaagaatgggtgtctggaagcattgtgctattgaaacttctgcaggtaactgc

SEQ ID NO: 133965 - DNA, 533 bp, Homo sapiens
ctgtctgcacctggtggtctgttctgtctgtccctccagagtgccagctgccccacaggctccctccaggctgagttcatggtcctgccctctagtggccagagccagcttcacagggtaagaaccagctaagctccaggggctttccaggaaaagtgtcccttgcaaagggtgtggccttttcaccactcccaatagcaccctagaaatggcttgaactttcccctccccagagctccgcagagaacacagccagcagaggacacattccctgtcatccagaaatgggtttgattctcagctgagggacagcagaactggtagactgtcaggccacacagctgcctgcacagcaaccccatgcttggtgggggaaaggaaggatggtgggggctggcaggccacgggccgggcaggacagcgaggctcactggaggtggtgcactgtggaggggcaatgtcaggggacagctttctcttgttgggccacaagactccacaaggacagcacagtgactgattcccagcactac

SEQ ID NO: 133966 - DNA, 361 bp, Homo sapiens
cgatctagcaggatctccagtccgttcgactgagcccttcattttcagtaggtagtttttaaattgtcagagcagcaaaataagtattatttgtagatcaaatcattcctcttccaccctcagctttcttaaaatacatcagtggcttcccattgcccttaggataaaaggctgaaagaactacagggctccaagtggccaggcctctgtctgctttgtcagcctcatcagacctgtccctcttatcccctgcttttcttcttctcattttgtgcccaattaaattgtgcattggtatcaaaactgtaacacatctttccttccccagctctgtagaacctcagctcagtcgaacggactg

SEQ ID NO: 133967 - DNA, 302 bp, Homo sapiens
gcccgtttaactcccccatttccccagagctgttgtgggtccaaaaatgagcaccagtgctcagtagtcccaggcaggttcccagctttctccccttcagcccagcttctgtgtgctccctccatctgccctcagcaccttccctctgaagatgtgttagaagctcaccagtcatctcaggccctccgtgggagctgtatcatctggctgcatctggccggccatcccgcccttccaatccacatgaacttcttatttctgtctttgtccttattactcagaactcgggccttggccttgac

SEQ ID NO: 133968 - DNA, 138 bp, Homo sapiens
aaccccctcttcagggatgatctggcagaacctagaatccacatgaatgtccctgtggctgtgggggggcagtgggcatggagagtgaggatggagaaggactatttctgaggaccagtaggcaggatttggtagcag

SEQ ID NO: 133969 - DNA, 307 bp, Homo sapiens
cgaaatgaggtcctcaagtgctggggcaacctgtgaatttgcgtgctgcttatttatcactgtgcctgacatggagtgagtactcactaaggtgggctccttttcctcccagcaggctggtgggatcctgctgtccctcttctcccagtggttgaaagggtatcccctgtggtctttacaaatgagttaggaagtcctcaggctatgtcggactcatgggtcatgagtcagaatccaatcattttaaagccatagcttgtgtttgctcaaactttcccttgacagggcgaacacaggggtgcacatc

SEQ ID NO: 133970 - DNA, 232 bp, Homo sapiens
tgatgatgtgtataattattaccagaccaattgaactgtgtgtttcgactgatcataacaatcccaggtacagctgatctttctagtgtgctgttagtggagattggtctcagatgccttgtgttaacagtggtgggaatactaataatgatgatgacatgtgttacagatgcccactcatttaattctcacgaaagcccatatccacatcacctaccatcctttggcctgt

SEQ ID NO: 133971 - DNA, 187 bp, Homo sapiens
actctgggctcccatgtgatcctgagtagtacgggcatttagcgatcttttcctgatttgggagcactgtagtagtgccttctgggccttctccaccacccaagtggtaagctccttgcaagcaaagcttcgtctgacacattttagtgtcctgactccaagccctctcctgtcttcccccacagaa

SEQ ID NO: 133972 - DNA, 870 bp, Homo sapiens
atatacaaatgtcaaacaacatgaagataaagaaaagatcaattgtttggcaagttggtgctcatgtcatctttgtgagagatttcagcagagtggtgtgaacagaagtcagattgagggggtggaagaaatgattaagagatgaagaaatgaagtcatcaaaggttcaacagtctctctgtggtgtgtgtgtgtgtgtgtatgtgtgtgtgtttgtgtttagtagcaaaaaggaaagagggttggtagctgcaggggtaatcagagtagaatatttttatgagccagaggtcttctcttcatgtatggtgagaaaaggaaaggaaccagaaagaatagtaactattcaagatggcgaggagtaaggtgatgattgatgatggatcatgtgttgtgggatcagggtctctttagagttaatataaatcaaatttcagggccatgaagtaagacagtacattcatattttattgtagttaattaattctcttaaaaagggaatataaagggaaggtaatagttgcatatttatagattgtagtctaatatgagctgatttataaaatgttggcattatgtttttgaggtggtaggataaagaaaagaaagtgaaaactttaagtgtagggttgagtttatcaggaatgtgtttgatatagacttgtgagtggtaatctggaatatatctagtatctaaagatactaaagaaaaacaaagggccagtaggccttataggagaaaatggattcatagctcttaagggataaaagtgaaaaaatgacagatcaatatggctgttgttactagaaccattcctttgtttggaaaaagtgttagttactcttaaataatttaatgccaaaacaaaa

SEQ ID NO: 133973 - DNA, 541 bp, Homo sapiens
gagagaatttggtctcagggaaccagaagagacaccacatagaaaaggttttgaaagatatttgctgttgacgaaagtgaagaacagagcctttccaaggggcaggataaatggtgtgtacaaaggcctggtgaccttggcaacacagagttccaggaactagacatggcttagtattgctgaagcagagagttggaaggggcagtactgcacagtggttaagagggtcgttctgaagcccatttacctgggttaacatcttgactgtatgagattggttatgttaactttggacttcacttgctccgtctataaaatagggataagtatttatcttataggattgttgtaaagattaaaatgcattcatatgtgtaaaatgcttaatgaaatgactggcatgtaaaaattctcaataaattttagctgttaatattactgctgtcattacaaatgaagatgagtagtgggtggtgaagctgcggaggagagctgaggcgcttggcatatgagggagtttggttttgatcctgtgctggga

SEQ ID NO: 133974 - DNA, 815 bp, Homo sapiens
cccaaagccactttatataacaagtattttgaaatctccttttgccaacatgaaatgaaatgactgaatattacaacctaccttcatccaattaggaaaaaaaatgctctaactataatttaaaggggaaataaaaggaaaacaatttatgataaaataatacatattcctttatgtaaaagtatggctaataccagaagatatgatgaaggagtcagagccttgtactactatgttgaatcactttgaatgatgtgacagctacaaatgcagagtgatgcaggtaggttactttggtgcctcatatgccacgagaagtactgatgtcattaaagttctaaactagcagcacacaacatttccagaattgacatggtagtcacattcctggaaaattcaagatatgtaaagcaaaggtagattttaagctcagataattaaaaacaggcttttcagccatgtgaatatctgtggaacattcaaaagctctctgggaagcaggaagattcttcatagttcagaactgtccctgccattgaagatctctagaatccttggctcctgcctactatgaatcagcagggcctccttgtaccaaccaagaacctgcccacctaccaaatattaaaaatgctatccacaaggtggtatcatttcttccaggagctagtgctctaagctttaaaatgtgctgtgcagagcaggcttcaaggatgaacaatctgtgtagtcatcagggttccctgctctttgaaggaccctgtgcctgaatactctgttgttactctcctgaatttcttaatgatttttgaata

SEQ ID NO: 133975 - DNA, 595 bp, Homo sapiens
aacatctccacagtgaactccctaacagatagctcagggatctctcagctagtgtggacaggaaacatcaaggacattacataagctccccctcattccgccccagaatctagatgtaatcaagaggacagagagatgctccaaatttgcttcccacctaccagaatagggactctgctctgtattaacctataaataaagtatgttgcttgtgctcttgagctatcatctgggattcatacctcctaataaatgccactgaatattatgaataaaggtatatgtgcacaggagtgtgtgcatgagtatgagtgtgtatgtttgttccaagcagagatagcagcattttccaaggtctggagataaaatgagaatgtgcatgtggagaactacaaaccattcatgggaaagtacacaaatgggctgtttttttcaggtcgggttcccaatgataccgtcttttttctattacacagtgacgtgtgtaaggcaccaaatcatgatgctaggaaaaacatcttgatatgtaatgccatacccaccatctaggtaatggtactgcatatctttggtccttccgcatgtgccagagggt

SEQ ID NO: 133976 - DNA, 339 bp, Homo sapiens
acaaagtcttagtaatattatgaaaatagtttttaccttgcaaacttcttaaaataatcttggagctccttcaagaccagactgagatttctgcattaagttataaaagttttcgggcgggcgcagtggctcacgcctgtaatcccagcactgtgggaggccgaggcaagtgaatcatgaggccgggagttcaagaccagcctggccaagatggtgaaaccccatctctactaaaaatacaaaaaaattagccgggtatggtggtgggtgcctgtaatcccagctacttgggaggctgaggcagagaattacttgaacccgggaggcagaggttgcagt

SEQ ID NO: 133977 - DNA, 684 bp, Homo sapiens
ctgctagtgtcaattttttttgcattttctgtagtataatgatagctgaaatctgactttattattgttgtaatgcccaattctaggtaaataaattatgcccacagccgaatcaatcacaacccattattaaatttgagttttctattaataagattacaaatgttttagtctcaaaattgtgtaaaacaagatcaatttttaagttcctatccatttaatagtgaatgtgttcaaaaaaatatgtatttttaataaggcaaaatgcatgataccaaacacagcattgttaggttggtagtattttggaattcacgatttggctttgataaaagtgacttatggactcttcaatatagctttccagtgaatatatattgaatgttgaaagaccactcattaaaattaaatttaaaaataaagtaaatgctctatgctgtgagccatacaaggcataatatcaacttcaacaagaaatggtctgcaaacacaccatatttgccaagtatcataacagtctagaaacttctgcttctgtgtcacagatcatgaaattaggttattaggctttttttgatatctgtaaaagccctaattaagccctttaatactctaattgaaatagatataagtgcttctggatgataccctgtagctggtccagcttctttagttgcagactga

SEQ ID NO: 133978 - DNA, 787 bp, Homo sapiens
gtgcggactgaagggaaggctgcgggagtgtgcttcgcgtcctctgtagtcgactaccgcagctcttctttgcattctggctctttaataatctcccttcgccctttctttaaatcagttcccaccctcccaacacctgtaatctttctcccctctggactccctcctccccgaatcccccgcatcagaatcttcctttggaatctactgcaagaaatctggctggattctcagattaaggacttccagaatcctatcctccctagaatccccctccttggggatcctctcccagaatccttttcccctcagagccccttcccctcagaatctccctttcaccagaatgtccttcctttcagtttcctcttcccagaatgtttcccatccttctctcagatggccaaccccaaatgtccctcttaagagtgctcaacttagaccccccttttccctgaatctccctccattcggtcctcgtcccctcagtcacccttcccagaatctttctcttgtcaggacccagtacccctggaatctccctcctccagaatctccctttcccggcaaatccccctttcccggcaaatccccctttcccagaacaccccgccccgcaaatccacaaaaacttttctctcagagacccgtccctcaaaatctacctttctcctgagtttatttcccttccgagactcctcttcccagcaactgccttccctggagttttccctccgttagaatccccctctcctaagagaccctcccccaagaattaacctcttcc

SEQ ID NO: 133979 - DNA, 317 bp, Homo sapiens
cttaccctgtgcagacattgtggctcataggaggagggtgttttggacatgagggttaagggctcttggggggcgggtggagaagccggggtgcagctaagatgaagctgctgagatgggtgtgaattggggcatttgcagccctggcatgagttcccgaggcatagtggaaggaagggttagaagaggagagggcagaggaaggacggagtcagatccaggtagagatgagagaaccccagaggatggatgttgcttggaggcccttcagcctgggcagacattgtggctcataggaggagggtgttttggacatg

SEQ ID NO: 133980 - DNA, 670 bp, Homo sapiens
gactttgtaaaatacaaggatgtaatttaggaggagtagcttaataggacgttgacacattagcgttaattggtttatcagaatagccaatcattaccaagtttctggagtgactagaacgggaaataggcaagtttgggagaactgaaacctgacttaggctgggtgcgggaagccttagacacacacacatacaagttgggcggaaagtggtagtataagagaaaagatagtgcaagtactttagcttgaatctagaatttaagttgggactaaccttgcttcattctgaaatttagatcgtttgaattacattattttaatatttattaggttcactttatgatttaagcatattaaatttagtcgaaaaatttaaaagagccatagatgggatattcagcttattcccataaagcatgcatgctgttcacttgtaggaaagatgatgactgtttctaacttcaggtgagtcatgcgtgattgaaaatgggagtacctcctcttacctctgacaatcctggttttttgttttgtgtatttcatgattgtttaaaacaattttttgaaaaatcggggaataccttttaaagtactcctgttcttttggggctagattgatgaagagaaaaggagcagtgagaaatatttcctctttcacagatattac

SEQ ID NO: 133981 - DNA, 204 bp, Homo sapiens
taattgtttcttttcttttctgctccccatatattgctaacagtttccttttgaaatacatggtcaggtggactctgcttattattgtcgaggctacctgtctataaacaaatctgtatatagtccttaatatgttaaataagtaacacatctttttactaccatgatattacagtgttaactcttgcaatttgcttgcccacc

SEQ ID NO: 133982 - DNA, 656 bp, Homo sapiens
cagcctgccaagtagctgggattacagacaggcatgtgctattacacctggctaatttttaaagttttttttgtaaagatagggtctttctatgttgcccaggctcgtcttgagctcctggcctcaatcgatcttcctgccaaggttttggaattacaggtgtgagccaccatgcctggcctgctttgacatattttatagtgtgttaattacaaatagtcttcatatgccagaatataagagcaagtgttatctactttttagatgggaattgcagaagctgcatcaaaagtatgctttgaggtatatatagtgaaacagagcctttctgaagagaattatatcaaactaattacaaccaagaaataatagtatgaagcggatgctgtttggaggacaggaaaatttatcgggaaaattacataatccctctgattccactatccagagatagccattattattaatatttggtatgtacatccttatattatttttttcttatgcatgattttgtatatatggttatttttctttccataaaaatggtattaaactgtatatactgttttgtagcctacatatttcatatagaagtatattgttaacattttccatgtcaataaatattctatggcttaaatgtcttatgactg

SEQ ID NO: 133983 - DNA, 415 bp, Homo sapiens
ctgggggcagagagtgaagtggggtccctcccagcctccccaacaaatcagagcttgtttgctgcaaagctggaatgaggcccaccctgatggggcctatcttcttgccaccacaatcaagtcttccagaaggcaaacaggtaaggggaggaatgcaatctgccagacaggaagatgcaatggctgatcttggacaaacagctccaggggtggcaggaagttgttttgacatctgtcttctcacgtcaaagagatcctcattccaagaccacaggtgcctctggcctccagtaacccacatgcaggttatataaaagacatgccgcaccgaccatgctacaacacagctggccttgggacccccaaacctaccacctgcctctccctgtaaattcaaaggaaagcatggacactc

SEQ ID NO: 133984 - DNA, 272 bp, Homo sapiens
agaagctatgaaggtttgccttgttggagaacacagcctgggaaaattcagggggaattccacgtgagctgaagtcaatctgcacaatgatggagttctccactcacattctccagtcacattcagggactagggcacagcctagcggacgcagaaaatagagtccaagtggagaggagtttggccaggtattaggactgaggggcagaggaacaggagttgggggaatggggttcagtgcactagtggaggtgacagcccaatcacagtag

SEQ ID NO: 133985 - DNA, 871 bp, Homo sapiens
cagaagcagaaaatgtggggtgggtgctgaaggaggaatgtgaagaatattcctgagaccgtgtacatgattccaaccaatcaaagtacaaaagtacataaaggctttcagaagcagaaaatgttggggtgggtgctgaaggaggaatgtgaagaatattcctgagaccgtgtgcatgattcctataggggaaggcagggtttggaaaagagtttgaggccaatacattggaacagtactgaagagttagggctggtaaagaggagaggattgagatataatgcaggaagagagagggagagatgtggaattggaaaagcagagaatgaagagaaacttaagtactggcagtgtttccatgtgtgatcctatgattcaaattctgtatttttgtcataggaacctggttgagtttgtcagtctagctgttttaataacactaacaaatagtttacatgcttattagctgtttgtaatcatgtcactaaaaaaaaaaaaagaaaacaaaagaaaagagaaagaaaaagaaaaaagcgaagaagaaacacaaaggccagcaaggacgacataggaccaaaagacaagacagaggcaacgcatagacaacataaggactgaccacccaaagacgaaacaagcgacgggggcggcgaacagaaataaacgtacgggagggggcaacacaagggacgtaccccacatagtaaggtaagagggggccgccagtaaggtgcaagaatgcgttaaacaagacgcgcggggcggggtaacataccagccaggtggggaggatacagcggtgacgcgtgcgggaccccactgagggggggagagaggacacaccccacagcaagaccggcgacgaaacctg

SEQ ID NO: 133986 - DNA, 748 bp, Homo sapiens
ctgctatgctccatcaaaaccaactagatgggagcttgttcctctgctgcattgtacagtgactggtctcacccagcacttccatgtgagaatgaacaccctcttaacaagaaattttgagtgttttccttttattcacagctgaatgcaatagctcactggttttcaattatgtttgattatttgtgattaaaaactgtatgtatttttttggcagtcaagatttctgtacatatatttaagaaatagttcattaactgcttttcacaactgtgtactaacatattttatacttttttaattagctgagaagctatattaaaatatctcattgcaaaaaaatgaactttgttatctgataaaatgaattttgcacttcagaattgtcttgaatattgttgtcattgcaaatgatttttatcttcatttgtagagtttcaccaaaataatccttttggaattttattaggatcaaattgaatttattggttaatttgggcctaattgtcatttttaccttactgaaacttcatcagcaatatttcagtaatgtcaatattttcttctacaaagtcttatgcatattttggtatatttatttctagacattttatagttggattaggaatcaaaagtagtacatttttaaaagtacatttcaaatgatttgcaatggcatataaagatgatagtacacatttatcttatatccaatcaggaaatttgttgcagttcttacaagttctaa

SEQ ID NO: 133987 - DNA, 135 bp, Homo sapiens
tttttcacagtgactgtggcattttgtgttccaatcagtgatgtatggggggtccagttcctctacctctttgtgactctagccatcccaccaggtgtgaagtggtatctgattttttttttttttttttttttg

SEQ ID NO: 133988 - DNA, 283 bp, Homo sapiens
ggtgaggacactgaggcctggaggggactgtgacatcggagccactctcctggggtctgccactcctgtcgcctcccatacaaacctgagtggccacgtgaccctgggggagcgctacctaactgtcccaaggagaggatgatcactgctggcctcccaccagccatcagtcccccactgactgacacccctgagtcagtctccaccccaggactgtttctttcactctttgccatggccttgggccacttccgggggcttggcaaggcaggaggcgtggaac

SEQ ID NO: 133989 - DNA, 672 bp, Homo sapiens
gaaatactatttttttcaatatcagattaataaaactgcattgaaagcatacaaaaagagatactatgcactaatttaaaagagcatgagtttgtacaaactctggtaggcaatttgtcaacttcagaattttaattgggaaaagtagaattttattttgaagttcaaaaactcggcacacaatgtctttccctccagattctattatacacatagaacaatgtaaatgattcttaaaaaaaaaaaaaaggtgaggcttttgagtggatgaaataattttgtaaaaggcaaaacagggaagagtgttcatgaattgtagcagaagatgctgcatgttatatgcgaatgaccgaagggttttaaaaatggaatctagtctgcccaaaggatccctagagaagttcaggcttggagttggcttatgtacaggctgtggcttctaagaagacatgatgaaaagcctcttgaagcctttgtatgtgaaagttatgtcagtagcccttgccaaaagcctcctcactctcccctctcttgtataagtaaattgaatgggatccttatttcacaccattaacaagtataagttctaactgaataaaaatctaaatgtaaattactaaagcaaaagtattagaaaaaatatagtgggatatgttaacgactttggtgtca

SEQ ID NO: 133990 - DNA, 257 bp, Homo sapiens
gtaaccaacactcagctcaagatacaggatgttcccatcagcacagagggctccctcttgccccttctcagttgctgtcccctcacagttaaccaggatcctgacctctgtcaccatggattagttttgcctgttcttgaacttcatataaatgggatcattcagtatgtgcgcgtttgtggctggcttctttcattcaacagaatcctgtgagatttagccacgttttgggtactggtagctgtttatttttctgg

SEQ ID NO: 133991 - DNA, 146 bp, Homo sapiens
gattgctggcgacaggaagggacaaagaggaaggggtggaaaagaggcttctgctttcttttaacaacttcccaagggttctagaccaccgttatgcttgtatctccttggccaaatgcagtttcacatctagcagcatatggccg

SEQ ID NO: 133992 - DNA, 204 bp, Homo sapiens
ctttggggtaggttttgagcaattctctggtgtcactttaattgactccatgacatcctcctccttcttccaggtttgcagttttgctttctggtttttggcactgtatatttgctccttcaatcagcaagagactgccaaagactagacttgtgaggacatgactgggcacagtgtctcacgtctgtagtcccagcactttgg

SEQ ID NO: 133993 - DNA, 527 bp, Homo sapiens
aaaaattctcacctattatgtcttcaaatattgcttctcccccattctctcttttcacttttctcagactccaactggatatgggttggaccttcccatgctatctactctcttactctcccttctatgttgtcatgttatcattcattcctttgtttctctgaacttcattctggatggtttcttctgtactttagctgtgtttggcactaaagattaaggtgatgtaacttaagattaaggtgatgtaacttacaggaaatagctggccagtcctcattttcaaaccaatcaagtaaaagagatttctgttaaacaaaagcacacttcattttaattcaaataaatgtgttgatacacatctctgtgataactatctcatttttataataataattctaacttagagaaggcagccgggggcagtggctcatgcctgtaatccaaacactttgggaggccgaggcgggtggatcacttgaggtcaggagttcgagacctgcctggtcaaaatggtgaaaccccaa

SEQ ID NO: 133994 - DNA, 413 bp, Homo sapiens
ttttagtagagacggggtttcatcatattggccaggctggtctcaaactcctgacctcgtgatccgcccacctcggcctcccaaagtgctgggattacaggcgtgagccaccgtgcgcgacctgaatacttttcatgatggcaaaatctcaccggcaacagaagaaaaaccaatgtttttaaatttactgaccagaaaacttgactgagagttgaattaagtgcctgttgttgtgtttttcagtgaaatgcaaatcttacagatcacttcttacagttaggaatactgcacttgtttgtgtaatattagaacaactgtagttttcctatcttagggcagaggttcagtattccatggggagaaaaaaacagtaattatctttgttactcttcttctttagaggaatattctag

SEQ ID NO: 133995 - DNA, 499 bp, Homo sapiens
ggcatgtagaagtcatctatgtggattatttctgtgctgtttggaatttggaagctgaggcacagaaagcaaaaataatttactcaggaccacaatgctgcttaacagcagaagctagatgcctatccatcataccaaagtgctttgaacataagtgttgtcaaaatccatctctcccaatggatcctaaaagatacgttttcatttgtttagatgatgaagaggaaattcattcttttaaaaactctttgtcatttctatttcccccttttatcttaagatgctccagctgcttcccatattatgttccaccactatgttttccttttattttaacatgcaccacttcaatttccgaaaacacagtgtaatttatcaatcaataaataaatctggacagaaacacaaagcacatttttctccaggagcattccctattcacaagcacagggagaggaaactcagtggcatcttgagcaaacatatgcatcaatacaca

SEQ ID NO: 133996 - DNA, 457 bp, Homo sapiens
accaaagtcccacccaggaatttttctgagaagctaccactaagtcaagctctgtcccctgctattctcactggctgctgaagggctggacgtcaatgaccctttctatcacccggcagcctgtgagggaaggttgttagatactgagagttaagggcttggaagaattaaaagcttggaaacaaagcctatgaattcctcagagcaatctttagaaagtgactctcacaggcatgtggaattgtcattccataatatcttgctaggaattcatcctaatagcaaattaggaagaccctcccgccacgctgaccactgctgcctgagtcagagataagcatccaattcaatagagaaggactgtcttccccagacttgggatgagacagagagtgtttagtccatctctcttcaagggctaaagctgtgagacgtaaaacatgggctatatcctggc

SEQ ID NO: 133997 - DNA, 306 bp, Homo sapiens
ctccatgaggatgtctgttgggcatgtaaaccttcacactccacaaatgatctaatcttacctccaaaacctgctcatcctgtttgtcttctccatcctttaagttgctcaggccgaaaactttgactcacctttgccacctctttttctttcctgcccctcactcaacttttcagtcaattctggtaggattttctgtcttctttgttcatagatgtatctccatggcctaaaaccataattagcacaagcctattagcaaagtccttcaaaatatatccagaattttattaagtctcaccactt

SEQ ID NO: 133998 - DNA, 584 bp, Homo sapiens
tacagctgcagcagtaagccacatatattttatttggccttgcaaattttctgttgagttctaggagctgtggatttttgagatatttggctcaaactcaaaatgaaaaaatcattttaaaaaatagaaatgcatttcattctttaaaaatgctaaaaatatatgatgcaaaatgtcatagtttggctgtaatagcaaaattcttagaatcaatcagtcaaaaataactgtgttatttaggcgcaatttgaaggcatacaaactaaaaacagtattttaaaaccagctataagagcttgatggcttctctacacactgatagctatttgccttataaaaataacaattgaacgagcacagggaacaggccgccacagaaaaggttgccttttatgtagcactaacatgcactcagtagcatttaccgacttagtctggggcaggggcaagaggatgcttcaaaaacaaaataggctaccctctttcgccactgttcttactatataacccccttgcagtaaagataagaaacaaactaaaattcacataaacaccccaatttggaaattgttttatatatgttt

SEQ ID NO: 133999 - DNA, 234 bp, Homo sapiens
tgcacttcaggctaagtaaaagagtaagattctgcctcaaaaaattactaattaaagttttccagattacattgtttaagaaaaaggaaaagaaaaaaatcttttttttattttcaaatgggagaatagagcctctcatttctaatttgtattgccttctgcaaaaacttagtctaggcccatggtcttgaactactggacatctgaattttggtaggtgctggattcaggcaa

SEQ ID NO: 134000 - DNA, 427 bp, Homo sapiens
tacatttccagcaggagatttaggaagggtctgtggacagagaagtagatttcccaggatctaagaaaagaaggttggtttactgtgggtattctagctgtcattataactgtgttattttatttatttacaaagggatcatgagccagaaccaatcataacaatcaaatgaacccactcactgtttcagcctctgatggtggctaagagaaaacagcaagtggggagcaccccccctcacagtcgcctctattatgttgtaccagaagctgggatccagcaccctcaaacgtagaggcttgtactagcaagagtcacatggacagtgggaaggtccattctaattattttgttagtaattcagtctgttctatttattcttataatctagcacattccaaaacatatttgttttgagaatgataaa

SEQ ID NO: 134001 - DNA, 294 bp, Homo sapiens
catgaaagcaactctatcagtaagaagctggtttcacagaaaaatggggaaactacctcaattcagcttgctgattttctgacattgctacctccctgcccattatttttgtgtttctatatggaaatttgaagcaggtagcttctcaagctctacatagaccaaactgaagaaagatcacttgaatacacaaactggtgcagaagaacattcagcatataaagttactaccaagctcttgcatcaagaaaaaagagtgagatttttgaactctatacatcataaatggcatgc

SEQ ID NO: 134002 - DNA, 346 bp, Homo sapiens
ccgttttggggactatggaagggggaacatgaaggcctcacaactggggtgcagggaagagttgagggaactgaaatggaatagtgtggactgagttagagagaggactctgaattttacaggaaaattttgcccctaggttttgcatttgacttttatgcaaagaagagaaactagataaaccaacaacaaagtaacaatagatctgattgatcagaacagtgaattccagccccgtatcaaccatgtttgagaaggaggcttagtggccatatcaggacagggaagtaggaggaaaaaagatacaaaatgcccacttggcaacagcctcaagggtaaagtaaga

SEQ ID NO: 134003 - DNA, 1438 bp, Homo sapiens
  misc_feature (1)..(2): n is a, c, g, or t
nngattatgggcaattctgagcttgaactgggacataagcttgtctctcccaaatataatagctgaaataagtgtatgtgctggcatatcacacacagccatctccttacagaataagaaatttagtagcatattcttcaaaacacagttgtgttgttgtagtatgtattttttgtgcgtacatactacttcttcaaaatccactctgtagtttacactaaagcacatctgaattcagaatagccacatttcaattccttagtagccaaacgtgaatagttcctactatattgcatgttgaaatggtcatatctaattttcttttgaagtttcaaggtactgtgttcactgccatattgtaaatatattcttatacagttgaccactgaaaagtaccagtttgaactctgctgatgcacttatgtggaattttttcaataaatacagtcagctctccttacctgtggattctgcatccactaccaaacacagatggaaaatatagtattcgtgggatgcaaacccttgtacatatttcctatggcatcggaccccaaagggctgactatggacttcagtatgtgtggatttgggtatgggtactgggggctggtcctggaaccaatctcatgtgtatacctagggacaattgtatttaatttttacaatttgggaaattaaaatgcatggattatatttccaataaaacaagcaaactgattttaagataatataatgtttttgatgagctatatagctcagttaaaattataatctagtacatttttacatgtaattgtgtataagctgccacaatagtaatgataactcagtggtattcagtaggctcttctcatgtgacaaaacaaaatgggagagaatagggataattatagctagcttaatgttacagatgtgcacagaatgaatacaggttattttgtttgcaatctcagcttttctcgatcttatttaggtaataatgatctatcttgtggtcataaagatattttcctgtattttatcataaaagttttagaattttacttttcatatgtaggcttttaatgtacctaaactttatttttgtgtattgcatcaaaagaacctagtttaattcatttctcttggataaccagttgtccccatgcttaatgagtagtgtatttttccccactgacttgtaatgccacgtttgtgtgtatccagtttctctgtgtgtgtggtcctatttctgtgccttctattttggtgccttaccttaattatcagtctgtgcactgattccacatagtattaatcattctagctctaaaataatgtttgatatctgatagggaaataccttcccatgtaattttgtcttcagaattgtcttgactattcttgtccctttgtcccttcacatgaatttagaattaatttttcttatttgacc

SEQ ID NO: 134004 - DNA, 280 bp, Homo sapiens
ctaatgtctatagcagtttttgcactacactggcagaatttgatttgagtcatggtgaaagagaccatagtccaagaaagcctgaaatatctactatctgatcctcatcagaaaatgtttgccaactgtagtctatacctttgcacgtcagagaattgcatcagggaagaactagaagccctccttttgcacccccacaaccctgccacaattcagtgaacaaacagaagatcagagagggaatgtgacttgaccaaagtcacacagctggttcatagga

SEQ ID NO: 134005 - DNA, 404 bp, Homo sapiens
tctttataataacaccatccattgttaagcatgttaatactatgctctcttcacaatgactttgctagactctgagctccaaggtggtctggcccattttgttttgttcaccactgaacaaccaatgccagcctgatgatgtccagactatgttccataaatgtctgtgcatgaattgctactctgatccatcacattttgttgtaatttaaccctcagagagaaatcgtcttctaagttttgtaggaaagatggtttttttttttttaagatggagtctcactctgtcacccaggctggagtgcaatggtgcaatctcaactcactgcaacctccacctcctgtattcaagcaattctcctgcctcagcctcctgagtagctgggattacaggcatgcaccac

SEQ ID NO: 134006 - DNA, 770 bp, Homo sapiens
cagaagaaaaatgactatatctggaagttcagaggtgcttccaagagcaacaaaaatggcaaatatatcattcaataaattaatactctctacacaaaataaagtctgtcatttaatatttatacatgacagatttaaaaataaatgaaaccatgtcatatgatatggttaggttttgtgttcccacccaaagctttttttgaattgtaatccccagttgttgagggagagacctggtgggaggcgactggatcatgagggcagtttcccccatgctgttattgtgatagtgagggagttttcatgagatctgatggttttataaatggcagttcccctgggtttttctctttgtttctccggctgccttgtgaagaggtgcctgcttccccttttgcctttcatcatgattgtaagtttcctgaggtctccccagcctgcagaactgtgagtcaattaaacctcttttgtttataaattacccagactcgggtagtgtctttataccagtgtaagaatggaataatacaacatctaagttgggagaatcaaatagaaataatatacattaagatttttacagatgcagaaaaggcctttgacaaagtttaacagccctgcatgctaaaaactctcaataaacaagatattgctggaacacatctcaaaataataagagctatttatgacaaacccacagccaatatcatactgaatgggcaaaaactggaagcattccctttgaaaacgagcacaagacaaggataccc

SEQ ID NO: 134007 - DNA, 244 bp, Homo sapiens
catccaactggtagccactagcaccaatctaggagccaagcagggaactgctgggcttaaaccaagagactcggaagcaagaaaaatgtctaccttctccagctagagcacagattaggacaaattccactcaaaaaaaaaatggaaaagatctcattcctcctgttctgaacccataaatcattatttcttggcccatattcacgcttccaccatccacagcccccttcatgccacctgaggc

SEQ ID NO: 134008 - DNA, 171 bp, Homo sapiens
attttaatatgtatattacagctgaaaagaatcatctagtaagggttatatctgatttcctgaggcctcattagcaaccaaaagttgcatttaaaaattacaaaagcatatctccatcgagaaatggcctttttatgttgtctacttttcccccagaggttccaataagta

SEQ ID NO: 134009 - DNA, 346 bp, Homo sapiens
tctgtttggctatttcagtgcctccagaaagggttgagaagataatggatcagattgaaaagtacatcatgactcatctctgtaaatatgcgttctgtccagaaccccagtgagcctggaagactgggtgctatgggaaatgtcatcaatccaatgctagtgaaagatgtgactggggaatgctgaaaaatgcgcacccctgggaggaatgaggaaagatgacatccactgacttgttatttttttgagaaggagtcttgctctgttgcccaggctggagtgtggtggcacgatctcggctcactgatgatgagaagaaagatcttgccattcaaaagaggatcag

SEQ ID NO: 134010 - DNA, 436 bp, Homo sapiens
gatcgagctcgcacctctgaatgaaagtgacactagttctctttcagtaaacttgggatagtcttgttccttggagccctagctgcaaagcctctgggaaaagtctttggtgaataaggcagaggaggaatgattgtacctgttagccatttgactgggggcaacagggtgctatgaaccagtggtagctgaataactcttctctgtccagtcatgattatcatgatcatagtgatttgctgccaccaattcctgaaaaatctgccaagggcagcataaaaatgtacctgggtaagagcttcccagctctggcaaaataagagagtggggcaaagaagaggaagagtgaagggagggacaaacagcaggatttggtgacactctcaggagaaatattgagaacacctacaagacagagacactattgtcagaagag

SEQ ID NO: 134011 - DNA, 315 bp, Homo sapiens
cacgtcctgatttgggcaggtcggtgcaggctatccgggacagcgtccttgtttttaggaaacccacacaggagaatctagaggcactctctgcagtctattctcaaattattccggaaaaaagggatgtgtgtatgtggagagacagacagacaaacatgtcggaatgttaattcagggaatctgggtgaagagtatttgggaattctttatactgtttgggagcatctctgtaaatttaaacttacttcaaaattagaatataacgccaccaaaaccccctctatcactcactccgcattcctagataacaac

SEQ ID NO: 134012 - DNA, 437 bp, Homo sapiens
tatgagaggctgcttggatttttattggaaatagaatacaaataagaggtgttgcggagtttaagaagtatttatatatttgcaaataggttagcacagataggaaagaaagctacctcatgtagtcattgaaaaaattaacataaataatcaaatcttttagtaaacatagaactgcagtgtagtaagatgctttctctttcatggtagtgacacctgtagtcacttctggttttattgacccaaatttaaaaactcctatcagtgtgcagtgtagtgtcagttaaacctagcacagcctctttgttatgcagcaagtgcctttttctaagacattcttggaagagctacctgattataacaataagtctggcacagatttgacaaaacagcttcatttagctgtaattggaatgaatgtggcctatacttttttt

SEQ ID NO: 134013 - DNA, 203 bp, Homo sapiens
ctgcagcactctgacggggaaatcacactccaggaaaacagcccggaggcagagcagtgcctcaggcaatcaacacgtttttcactaaagtttcccaatctcatttctgaaggtatttctgaaaagcagcgtggcttcatagcaggcccagcgatggaaaccacaatgccaaggctgaaagcccagaagtgcggcctcagctt

SEQ ID NO: 134014 - DNA, 496 bp, Homo sapiens
taatctgctttacaagaacaaacacttagctttaatattggcatgcgttgttaaacatttattacaagtacttcttatcaggaccaacaagacttctgcttagcaataatttgccagccctttaaagttgtttatgaatttcagagcacttaaatggcgtttttatgtgaaggttttgaaatcgacgggagaaagggcaaatgcgagcatctgatttgtttgtaccagtgctgcttggaagaggactgggctttgaggagacactcagcatttcttgtcgcgtgtaggattgaatgggtgcatcaatcaaatggtgctgggattagcggttggcttgttgggaagaaaacagctcattgtgtttctcagtggcagttccattggcaccacagccaagatgatctttccttgctcaggtttgtgctgtgcactccggacattcagcttccctgactcctaccccgtggaagtttgtttctgacttgtttccagatac

SEQ ID NO: 134015 - DNA, 787 bp, Homo sapiens
caatggtagcttccactagaaatgttcaaggttggcaacaaaagcctgaattcccacgtggcacacatcagttggaaccaagcggcacactcccttcagacagggtgcgtctcactggtttgccacagtcgtcactactccctaatgtcacaccagaccagctttcctcactcccaactcccactgcaagctcactctggccagcctggtttcagtttgcaagatggcactctgacccaatgagtctgcagaacaacactaactcgggtcttttgaaaaggcctcaaaaacgaaagtaaaaatcatggtttaataaactcaccatgatcctgataccaataacctggctcaagagaagaggctctttctgtacaaagcagctttctccaattctgtttatttttgaagagattttatttttaggccaattagaaactaaccatgctgttgctctgcccatataacatagtccattctcctcagcacatttggatctgtgtgtagaaaagatgacaatgaggaaaggagtatcaactgatacccagtactcccccagtggatgtaatgtgcaggtgaacagctactcagagggtgatgtgaggccagttagagcccagactcaaagaatgagcctgctcctgaaatgtcttccccatgaaacttggagcaaaatgctaacgaaccctctctgagcgtatgcaggaggaaggtaaggttaacaacctccccacagccgttctttctctccgtacagcctttctttctctccgtctttatttcagcaccc

SEQ ID NO: 134016 - DNA, 631 bp, Homo sapiens
aaaaaagaaattaatatggaacgtttctcaggtccatgctgagcttgaaagaaaaaataatacagcaatatcttcaatccaaaatatgccttgaatttaagttggtaattaaaatgtttgtttaaaaaaagtcgctaaaattagagacaaagacccattgtttgttattactgctgactgcatatctgtgtgtggagaagggtgtgaggagacagtcacaggcctgtgatattgtaaagatttatcacccacccccaaagggttttgaggcacccacctgcattttcagcttggatctaagtcaaggggtgggacaagaccatgacaggttttggggtttgtttattttttgctaattactcgtggacacttcaaataccaaatatatcagaacagaaaggcacctgctcaacccagcccctgccatcctctggcaatggcctgacatctctagatgattttctagagattgtggaaccttggagcaatgcctgtgtgcatttttaaaggagggaagcatcccagaacatgccagttccttatagagtatcttgaatagttaccacctctaaccggacttgtgaatttttttcatgtttattcttttcccgtctaggattgagattggtta

SEQ ID NO: 134017 - DNA, 259 bp, Homo sapiens
tgggatcattctggttacttccccagaggaatattttgttgtttttagggacccagcccaacaggctctggagtgctgtctaggcctttgggcctctgatggagtggtcgggcaggagaacaagggcttccttaccaggaggaacttgactctgatgctggtcctgcccttttctcactgtgtaatttgctgcatttttaagttctctgtgtttcattttcttcatttataaaatgtagttataatgccttcatttcag

SEQ ID NO: 134018 - DNA, 350 bp, Homo sapiens
ggaggttaaaccttactctagtccaggaaactgggttgatatttaaacaaggacgacttcagtgaggtaattcatgttatgtctgttgacacagtcatttgaactgggaaaaatcagttactgggaggagtggcccttttcataaggagaggttttcctgtagttgattaacttaaatgttggggcagtaggtgataggttaaaatggggagagttaaaaagtaaacctctctctcaaatcatttttaagcatttgagattgtatgtctttttcttcgtcctgaaaaggtttaagtatgaagagacaaaaaaggaaatttgtattagaaactagaaggcttatgacaggt

SEQ ID NO: 134019 - DNA, 322 bp, Homo sapiens
cagagtctgctactttttttgttgtttttgttttttgagacaggctctccatcacccaggccggagtgcattggtgtgatcacagcactgcaaccttgacttccagggttcaagcctgagcagattcaaggttctctggtccatctcactgtgacagtggttctcatcctaggggccgtttttcccccagggaacatttggcaatttctggagacatttttggttgttatgcctggggcatgtgctactggcatctagttggtagaggccagagatgctgctgagtatcctataatgcacaggacagcactgctacaaagaa

SEQ ID NO: 134020 - DNA, 798 bp, Homo sapiens
atttgtggcattatcatcattatgaatgcctctttggggttcccagaggctgatgttctccgtgcatctgctcacaggaccaccacacagcaagtttcctgactctcaggccaggattctctttctgatcccataatgtctcttttaaaaattaataagctgagtgactagcagataatttcccaaggaggtccctacaatttccccactcccacacacatttattttctcttccttggcagagtgcaaacttcactacaggccaccgaacaaaataatgtcttcttttaaaatcattaagctgagtgaccaggcaactcgaaatatagcagggtgtttcccagggaggtcaggtcaccactttccccaccccctcctcatttatcttctcttctccatcagaatgcaagctgccacacaaacttttgggcatatgctcttttggcctcctggataggcaggtgttagccacaggaaacaagcaactaaacaggctgctcttggtgccgattggccatgggttaatgagaggtttcatttaactctaggtggtcggtggtgttccaccccacctctcccagagtatgtcattgtcctgaatgagaaggcctgagggcaatgcttagaaatgagtttaagctgttacacatcaactaaggttaaagtcctctgtgcttctgtcccccttattgcctactctataccattcctcttagcatatactgccttgggctgtttttattttttctgaagcatgtggcctgtatcccttagtgaaaccctgtagccccttgaaca

SEQ ID NO: 134021 - DNA, 288 bp, Homo sapiens
gtggaagaatgttgaatataagtttcactcatttttaaatgatgctcacggctgctcatgctatgagttttcacagatgaatatttaaaataagtgtctttctcatttttataccccactcctttatccaatcttgttcagactttgaaaacatgtatcttcatatttgcttcccaacctttaaaaagctattgtcggaacgaatcttagggtattagttaatatttgaatgtgaactccttgtagcttaccctgtgtttctttctgggcacatttgtaactaaaggg

SEQ ID NO: 134022 - DNA, 141 bp, Homo sapiens
tacctgggcacacaactggcatactgcgggcattctgaaaatggagttgatatttctggtaggctttctcaaaggggcaaacactgagtgggagtgaattagaggcaaggagacatgacatgagaagtgcaaaacagagag

SEQ ID NO: 134023 - DNA, 394 bp, Homo sapiens
ggacttaggccacttagtgaatattagaaagcataaccattttgtgttttttatacatatgaatgtcccaatgtgataattctcagtttaagaaatgtgggaaagataggctgggtgttacggggctgtttcaggtttgccaggtgtatttagagaaagaaattgcagttagtgaattttcccatcatctattttgaagaacaaagtttttgcccgcattttccccatgttccttagataaaagttacatcagacggttccttgtgactgtcaccactttacattagacacagatatcattcatgatctgaacgtgacactgcgagcttgggagggaaagaagggaagtagtatcaagatatgggcccagtttcagaggagtaattaggtgtct

SEQ ID NO: 134024 - DNA, 510 bp, Homo sapiens
tggttcttgtctccatgatctgcctctttagagagctcaattctctttttaatgaacacttgggggcttggtctgttgctgcaacaccctgcttctctcaagcttcaataataaagtgagtgtgttaaggaactatgagtagagaaccataagatactcgcccatctcccaaatatctcccataccatcatctgtcaaaggtacctgaaatacctttttgtcttcaggaatctccagatgaaaatgctaacgtcctaagaaagaataagaccttgaggcttaaataagtaatatcagccaacaccttcatttggaagcttgggtttgtggaaacataatggaagggagatgatgggaggatgagcaggatgtgacagggactccctaaaagggaagtaggtgtgactgtatgcttctcagttttcttccatgcccaccctggctgataccacatagtttctgtttcttattttgaattggcagtaggaagtcagctgcattcctaggcat

SEQ ID NO: 134025 - DNA, 415 bp, Homo sapiens
ggaccatatggacctgctgcagttcgtcttttctaataagagtactgaggctttcatttaattaaacagagctcacttcgctattcaggcaaagttaatgacaagtaatacagattcctttatagggccttatgacaatacaactgatttaagtcctttcccgtgttcctattatctttcaggccacatgtcaactgctttccctgacacgaatatggggagccacctccctctggtcctctctcccatcaaatacacctctgattcgaattgaactttctctgagtcttgacacccatcctatcccctaggataagaccaaggcacttctcattaatctattgtatcttctaatacctgatctaagaattgtcattatttgacaaaagccaacagtgaacctaccagggaatac

SEQ ID NO: 134026 - DNA, 765 bp, Homo sapiens
ccggtgaggagtggcgccgtgagagtgctgatgatttgctttgtggtcttttttccacaggtctgttttcctggctagactttgaggtgctcaagagtggacacgttcgtctttatgtccttcactgtgcttagcaccatgtcatccatgttcaataaatgggtgttgcccataaatgcaagaacaaactaacaaatgatactctacagcaacgatggggtctttggcacatctgcagggcctgaggcctaggctctgttttagggtgatgcacatttaatggagacccactctgcacccccagcagatttcttgagctttatgcaaccgctgtggtcctgatgacactgtgaatcacatgtctaagtctcatctcatcttcctcatctatacaggtgatagtgatcatcatcgctgctctgtctaactcacagtgttgggaggttcaaataatgttaaccgtggagggtgtccaggttcttggcatcttgaacaaagaattggacaaaactcacaaacaaaggaaagaatgaagggttttattgaaaatgaaagcacgctccacagtgtgggagtgggcctgagtgtaggggctcaaaggccctgtttacagagtttttatgagtttaaataccctctacttggagtacgctctatgtaaacaaagagggtgaagtaaagttacaaagtcatttagtcggtgtatgccctatggagagggtatcttatgtttcctgcctccagaccctattttcctgcctcaat

SEQ ID NO: 134027 - DNA, 234 bp, Homo sapiens
gggtgatataaaaacctacacatataagaactcaaattggccctttgacccaacctcgtgttggaaaaggcttttcacttctcaaaatatttgcacatctattagaagtattttcagagtcatatttgaggagtagctatttagggattacaaaatatcagtcaggtgagatgtgtccccttaaacaccatataaaaatggttcaagaaacttaagaggggcaggaggataata

SEQ ID NO: 134028 - DNA, 109 bp, Homo sapiens
ggagctcgggagatttcctttgcatttgtaggattgccccaggatacacacctcaaatgaaactaaattgtgctttatgacttcttttttttttttaagacacagtctc

SEQ ID NO: 134029 - DNA, 349 bp, Homo sapiens
actcaatggccaattcattttgcaaagtactcttctgactgagtcaccaacaccgcaagactgtctggcccctgagttcccacatggagccccatgacttggggttgctacttggtgaatagaaagttttaattttgatttcacaggatcccagcagccatgagaacattaaagccaagattctgatagaatgagcaaatcaaactcagagagccctttcctaattttcttttttaaggaagttggcagaggggcaatgtgacaggagctgagtaccagctttgtcactaccagctagctctacagcccaggcaactactcaacctccctgggcctcagtttcctcatc

SEQ ID NO: 134030 - DNA, 275 bp, Homo sapiens
aagtctcaaacggcacctgaaattctgcattccaatagactatcaggagaaactgatgctgctgaatctcaaaccatacactgaggagcaggactccaaatcagggcagaccacaatctgtttcctgaggatgggcctttgttagcagtgagtaatggacagagacttatctagtggctcaatacaatcaacatactcaggttagtctccactcctaccttcacctcacttatgacagacacacacaaacacacacacacacacacacacacccc

SEQ ID NO: 134031 - DNA, 842 bp, Homo sapiens
tattttctagcttcataaaatcaaacacttttccaaaaatatgtttccagaaaaatctttttaacttaaaaaactgttcattgaccagagatttgagggtcgagtcaaaacacactgtgacgtgccaggtccttcatctgacccctgctttaacctcccaaagtgttaggaacatcatgaacgctgcttggaactagaataatccaagtttgaataccacttccacttcaaggaagacttaggtagtttgctttctgggactcagttttataatccatacagcaggtaaaatattaactatataatggcgttaagaattaaattagatataaaacctttcaggagcaattattgatttgtaatcccaattttttttggtccagaaaataagacattcccttctatttgttaacatgtgttcctatcatgctgtcatgttcatgttcctcttttccattagtatatgagatcttgatagacacaatgtttttcatctttatggctgaagtgcacagttcctggcatgtaataggcatgcagttttgttgcacaaatgaatagataatctgctttgatgccagatgcctgaaaatgttgcccatagtatgtgtttattacaatagaaagtcccttgaatataaaatttgatgcaaatggtctggttgattctataccatcatcttgtaagacttcagagggttttcccacacttttcaaaaacatgtatctattttgttgcaagctagaaggactagtccctactctattcatttataatctagtttgggattaagccacatcagtaagtaaccaagtactgtaagcattcagccagatatccc

SEQ ID NO: 134032 - DNA, 406 bp, Homo sapiens
cctagaccctcctccctctcccccagaggcatagccttcatagtgctggaaatgttccatatccctccattgtgccgtggtgggaaaaagacagggaaagagccctccagggaactggcatttgttgtggcctgcactggctggttcctggagtaggatgtgtgcatcattagccctgcatagcacagtagctgtgaggaagtgaccgctcaggtgttgggtgatgtgtctagggtcacattgcctagaagagtggcagggctgcgcttgctgcaggcttgcttgatcctgaagccctggttcctctcaccatgccctgggctgcagaactcacttctgggccttgtaaggccgctggtgggtaatggtgacagtgggaggagtaatacctgaacagaggctgccc

SEQ ID NO: 134033 - DNA, 278 bp, Homo sapiens
gctatagagtgcaacaggagtgttctcagcagattcctgtagtttcctgaccaaacaaaagtttccattttgttttcacctgcttagcctggaccttggttttatgtgcattcaaagatgacatgttatttaagagcaagttgagctgttgatgaatgaatgatggaaacaactttcagccaagcctgggttacttttcattcctttccctccaaaatcagaaaacatctcaattgttccatatttcttcctgtgttgactcattttgtgacctctgc

SEQ ID NO: 134034 - DNA, 453 bp, Homo sapiens
gctgtgttggtctttgcaaccttccttaattgtatgattttaagattcattgttgtttttagttgtgtaacaccaatctttttggacctctggaattcatactattgaagtaatgcagtcccagatttgaatttatctgtttataactgttaggaaatacttagagtgagccaagtgtaatggctcacacctgtaatctcagcactttgggaggctgaggcaggtggatcgcttgagcccaggagtttgagaccagcctgggaaacatgaagagacccagtgtctataaaatacaaaaaagcctggcatggtatctacatgcctgcagtcccatctactcagaaggctgaggggggagaatcacttcagcccacaagttccagagtgaggtgaaccgagatggtgccactgcactccagcctgggcaacagagtaagaacgagaccctatctc

SEQ ID NO: 134035 - DNA, 630 bp, Homo sapiens
cagttccggaaccacaagtctaacaggtttattaggatcacactggtgactgagttaagaccaggctgtatggggcaaatacaaaggaagagcctccaagaagtaatctgggtgagagaagactgagagttgcagcaggctggtcacagggcagatgatgagaaattgctggatccaggatgtatttgggagaacccagcagaaatcattcttagtgccatgattggagagtttcctgaggcctcccttgacacagaagctgctatgcttcctgtacagcctgaagaatcatgagccaattaaacctctttactttataaattaaaaagcaaaaaaaaaaaaaaaaaaacaaaaaaaaaaaagagcagaggaggagggagaaagagagaaaaaagagggcggggggggggcgaggggcggcgggggggcacctggaaacaaaacagagtagagacaaggggcaaaaggggtacaaaagaagaacacgaagagagaaaacagagaacagaggaaccaaaaaaaagagcggagggagagacaagaaaaaggccacgggggacaacggggtgtagagaaagcacaagggaggaacacagagaaacagaggggataaaagagggagaaacacga

SEQ ID NO: 134036 - DNA, 753 bp, Homo sapiens
ataaaagttctgtgagctttatttctttggaaaccatacctagaagtttacaaacacatctggggtacaattgggacacgtctactctatgtttcacctctactcacatccttgtagtgtttcttataggcaaggaaaatacttcatattgaacatatgataagtggcaactttgctgagactaatttataagaatagaagctgaaatattatccatggtttccaaagaaaagcattttttcctgaatagcccacttccaatctatcattcttcactttgttgcttatgtatatctctatcttcatttccatatatcaaatattacctatcctcaaaggctcatcccaaatgcctctaactttctgaggcccttattgcttacttctctttagctctcccatgcaacgaaagtcattgacttgtatataccacccgcccacaataaatttttgtgcacttcttttgtaaagcttattacttaatttgcataattgtctataaatttgtctaatccctctgctaggtatgaactctttaagtgaaagaactttaatactgtgtcttaggacaggacacagtaggcacacagtaaatatcgttacgcaaattgaatctcttttattgtgaacaggaatttttttccagaattttccatactatttacagaatgatagactgataaatgcatcactatattcaatcgaatatatttttaatcgattaaaaaacaatcgatttaaagacaatcgaaa

SEQ ID NO: 134037 - DNA, 515 bp, Homo sapiens
tcactctatcccactggcatagtgagtgtgtgaacaggggaacaagatgtgttttacagtcagtttcatccacattcaagcatttcttttccagattttcaacataagaagttttgttgtttttgttgatattttgggtagtggtggccaatgtctgttgcctctctcctgtatctctgcccctagaggcccctgggacacagatagaaaggaagcagcttccccaaggacttggacagcagacaagctggctaggggagcagggggcaggtggtgaaacaggggaaaagctcatttctatgacccatcagggaagctgaacaaaatctagaaatgtcaccaggataactgcatagggagatacagcatccttgacagctctataactattatgcagaaaatagcaacagcagaatcaactaaggttgtaaaggaacattgaaaccattatgaatggagatctaaaagaagtgatcagaaaagcactacaggatttggcaagcaccctggaaaaa

SEQ ID NO: 134038 - DNA, 407 bp, Homo sapiens
tctgagatttccatactgacctcagacccttggaggaaaaacatgttttccaattacattgcaatacatggagactgaccctcagttggtaattccaagttctagtgttccctttctgaacagattgctgtttttcccgtgttatatggaaaggggaaggaacttgaatagccagtagaattttgcaaaagggcagcaaagttgatttaagatttactataaagccaccgtaatcaaaacagttggaattggtgaaagagtagacacataaagcagtggaacaaagcaaagagtcctcacatatatggcaattaatcttcaacaaaagtacaaagaaaattccatgttgaaaggatgggatagtattttcaacaaatggcgctgtaacaattggacatctacatgca

SEQ ID NO: 134039 - DNA, 257 bp, Homo sapiens
acattaatgtcatctttctgatcaagcttaattcaaatttttgtcgaagagaacagtcaaattaatgacattatgatatcagatttctactttggactacatgggcctaaagtaccatgtgtcttttgcaacgtcagcagttgctgttaggaatattttcttttgtgaggttttttttttgtttttttttcttcagtccttttcgtccttatgaacccatcactaggcacatagagacattcattgttgactgactc

SEQ ID NO: 134040 - DNA, 322 bp, Homo sapiens
tgcaggaggtccgtctgggcatggctcccactccccactgacatcaacacctcagcccaaagagcagaatccactgatgctagaggaagatggaagggtcataaccccaccttcccagggagacttccctgggcctcttgcctgaacaggcccctcgatccatgctgtagactaggggtcttaacaggtcagtcataagtctcatcttgcagtctgggccctggagctggcctttccttttgttccttgccccctccacgatcacttaggcctgacagaacctgaaaccctgtcaccccaccccaggaagcatcatcacctc

SEQ ID NO: 134041 - DNA, 225 bp, Homo sapiens
catacctggaccttctggatttcgactggtgaaattaaatgaggtcatccgacaagtgggcgagaaggagattgaagaatgctggggatgaagacgggttgcggggagacactccccagggaggggcaggcaggagataaggtctgtctctagccgggtgctcagtagaacacacaggccctgtcagtgcgtctaagggctaagtgcctggctgccggctttact

SEQ ID NO: 134042 - DNA, 330 bp, Homo sapiens
gctacaatgtgagattggaaagaattttatacttaggattatatcctgggacattttcttcattcttcctgaatattgagatatttgggtggaaaagttcaagcagcagcagtggaatccattcccaccttcactggggtgaggagcagttggaaaaaagccccagacctgacctcagcctgccttggctctgccacaaacctgcagtgtgactttgagcaagttgccttcctctttgggcctttggttcctctgttatcaactggggaggaagttaacatctatcttgctatccacccaacagctctatggagttgtcacctttatcat

SEQ ID NO: 134043 - DNA, 105 bp, Homo sapiens
gtggcagcaccggcaaggggctgggggaagagcccacgccagcctacgtcacgcaggaagggagccagtggccaccccaaacacacctctcctcctcacacctgg

SEQ ID NO: 134044 - DNA, 473 bp, Homo sapiens
atccccgatgccgggcggatgcatagatgggtgggtggatggatgagtggatggatttataaatggatagacagatgggtggatggggcgaggcacagtggcgcatgcctgtaatcccagctactcgggaggctgaggcaggagaatcacttgaacccaggaggcagaggttacagtgagctgagatcatgccactgcactccagcctgggcaacagagtgagacttcgtctaaaagaaaaaaaaaaagacagtggttctgaaactttttgctctcaagaccgctgtaccctgaaagatgttaaggagatctcacagggctttcctttatgggttgatggctctggatattatcatattagaaactagagctgagacattacaaatgctcatgtagcctctgaacaattccattgtacactagtgagatggtgagactgaaaaacacaagtaattcctcagtgttattatgac

SEQ ID NO: 134045 - DNA, 129 bp, Homo sapiens
ttccttaaaatatccttctttattgtttttctcgtattaaatcctcctattggtgcttggaggggacggagatagtggagtgggcttattttctatgccctgtgatttttgctgtgtcacaacctgttc

SEQ ID NO: 134046 - DNA, 574 bp, Homo sapiens
gtgttacagtacctcccggtcattttctttttctctctctctacctgcgctcttcgagtgtcagaaacctttaaagctgttactatggaattgcaaaaaagagatcaagtgactctttcactatgctggtttcccttgtgacccagatgaagaatcaattcagaattcagttcctcccttggcattgcaagacacagaagaaactgtcacttcctaacagcctagtactggagtaaattcagtatgaaggaagaaagcgctcctgcgtgttagaaccttgcccatgagctggaccgaggacaggagatggactccaggaaaattggatttcttcaagcagcctcccttggaaatggaatatctttaaaatcttctttgcagaaagacagttagaatgtattaatcagaatagttgaagacttattttcctttttattttttttcaaaatgagcattattatgaagccaagatcccgatctacaagttccctaaggactgcagaggcagtttgagacagtgtctccctatgttgcccaagctggattcaaacaatctgcctgcctcagcctccca

SEQ ID NO: 134047 - DNA, 421 bp, Homo sapiens
aattgaatcatacagaattttaataactttaaatagtaaattttagaagtatatatgtaaaaacttcatgatttcatattttgaggcaatatgttattgcctgctatatgtggctttatctagatagtgttttccatcttgtcaactcatcacaatttgctcttttttccctttttacttgactggcccactctgccatgagaaaatgtggtctagtccaaattattttttaaaatataaaaagttataggttgaggctgggcgcagtgtctcacgcctgtaatcgcagcactttgggaggccaaggtggcagatcactggaggtcaggagttcgagaccagcctggccaacatggcaaaactccatctctactaaaaatacaaaacctagttgggcatagttacacgcacctgtaggctg

SEQ ID NO: 134048 - DNA, 228 bp, Homo sapiens
gcaacaagtaacgagactattttgtattttggagaattcatattatggagaacctaacaatttaaagacactgggaacacttgcccctcagtatagtactgtcaagggaagccatacactttttgtagacatgggtaccaaaaatacccaattctaagtggttgacagatgttcactttgaagtgtgaagttttaaaaatacgtgaataaattggttattgaaacatc

SEQ ID NO: 134049 - DNA, 401 bp, Homo sapiens
gccccaacccagtgtcttttcccaacatttactcattcattcattcagtcactcaagtctagtgtataattcatgctgttcttggtgttctgagataaagaattataagaatgtcatcgccaggcgcggtggctcacgcctgtaatcccagcactttgagaggccaaggtgggcggatcacttgaggtcaggagtttgagaccagcctggcccacatggtgaaacctcgtctttactataaatacaaaaattagccaggcattgtggcaggcacctgtaatcccagctactcaggaggctgaagcaggagaattgcttgaacccgggaggctgaagttgcagtgagccaggatggcaccactgcactccaacctgggcaacagaggaagactccctctcaa

SEQ ID NO: 134050 - DNA, 341 bp, Homo sapiens
ctaaatcatggtggattcccgcctcggcttccctccaagagccaacacggagatgggaaggcagcttcaccagaaattactaagcattttccagccccccagatgaacaaattatagggtacaaaatgaatgaaaacagcttttttactcgcccagccataaaaactttgctctccagattttaaagccagggagcagggtggtgagcccctcagcaggctgaggcatggaaagccaccgtcccctgcaccaacctcatggagagccactgtcccccgcaccaacctcagaactccagtcctcagcctggtgctcacctcagaccctcaccacccacacag

SEQ ID NO: 134051 - DNA, 806 bp, Homo sapiens
tactaacctattgttagacatctctgaatagtctgtgcacatcttatgcccaagatgacatgaactgagttctgtatctccaccccaccctgcaaaccatatttccttcagtgcactctgtgtttctgttaatgttacctccattcatgcagtaatgcaaactgagaatctgcaagtgattcttaagttcattttccttgcatctcacactctgctggtcattacagtttgttgaatctacttattcagtacttatcaaaagtgtcctcttttttccatgcctcttgacatgtattcagggctgatattcagctcatgcacaaatatgtcatgttgacttatgtccattctatgttttggcttctgatatgatgtgtgcctatacattccagttacatatttcaggttatcattagatacacttctctcttaatattgataaaacaacagacagaaagtcagtgaagatgtagaaaaacttgacatcatcaaccaacaagatttaattgacattcatagaaaactattctcgacagcagcagaatacacattctttttaaatgcccacagaataattaccaagataaacgaaaacctgggccacgaaacaaacttcaactaatttaaaaatatttgaagtcatgcaaagtctattttaagaccacagtattttcaaactaaaaattaaaaagagttaacaggaaaatccccaaacaattggaatctaatcaatatacttctaaataaataatccataggtcaaataggaaatatccaggaaaacacacacacacacacacacaccc

SEQ ID NO: 134052 - DNA, 476 bp, Homo sapiens
gatattcttactaacaattttaatttatttcaatttaaggaaagcaatatgaagaacatacattaaatattttcccctccatgttaatgtttcagttaagtagacgaaggaattcagatttagtcttcatgtaaaacaggtaactttgctcaggaaaagaaaaacctacctgttttctatgactcgtgacatatattctctggtagtccttgtgatcagacatacacataccacatattgattacaaatagggtattaaacaaagtaagtaactctagaccctaccaccacttcagtgacccgaaatccactatttaccaacaatagctagtaatagcaatttttggtcacataattaagcagcattttctttccctgattatttaagaaaaactaagtaaatttatctcactgaagaatattttaagccttaagtcaacattaaatttcttgttattgattataaaccagtatac

SEQ ID NO: 134053 - DNA, 157 bp, Homo sapiens
aaaaacaagaaaacaaaaaaacttcttaacttgattttactgccactagggggtgcctggtaattgagtctttgtattaatataatttctttctaggggaagaaatggtataaactaagagcagcaaaattaccatatgagtgcctataattgtaaa

SEQ ID NO: 134054 - DNA, 132 bp, Homo sapiens
acacagactttgagttgattgttagaattatgcttaagaatttaaaggaaatcataaatataatgaggaaaggagtggaaggaaaaggacaacatcaaacatttagagctgaaaatgcagctcttttatcaa

SEQ ID NO: 134055 - DNA, 274 bp, Homo sapiens
gttttaccatgttgcccagactggccttaaactcctgagctcaagtggtcctcccacctcagcctcccacagtgctggcattacaaggtgtgagccacggtgccctggccaacgtggctttctaataaggaatcatccctgtgtctcaggcataaacttcctttttttttttttttttgggggggggtttttctttttcccccaggctgggggcccagacccttaaaatttgttacccgagccttcaatcccttggtttaaggggtccttcttc

SEQ ID NO: 134056 - DNA, 411 bp, Homo sapiens
aaaacccatccctacaaaaacacaataattaggcaggcatgatggtgagtgcctataatcccagctattcaggaggctgaggcgggagaatctcttgaacccaggaggcggaggttgcagtgagccaagattgcgccattacactccagcctgggcgacagagcgagactccctctcaaaaagaaaaataaaaaagaaaaaagaatattaggaaaaatatcttaatgcaaaatatattaattagtaatctgccaacactgagatgtactataaggccaagaagaaaaggaatgatatctagagtcttgtcattttttaagtcattgcttttagagatttttttaacctcacatatatttttgtttcttagcataagagggaggaaaatcaaaagctcaaatagagaattta

SEQ ID NO: 134057 - DNA, 514 bp, Homo sapiens
gcatggctagttgggaggtcattatagtcacctagggaagaaatggtggtggcttggcctaaggtggttatagtggagatggaaaggaactgttcggggaggaacaatcagtaggtctttctaaaaggttggaagaagtaggaagtaaagaaaagaatcaaagagggcattgccatttttgcctgagtagtgggtgaatcatgttctgagaaggaataccatggggaattggctgctaaaccaaggttttctattgggccatgttaaattagagaggactattagacaaccaagtggaggtgtcaagtgaacgattaaatgtcagaatcgaactcagagaagaggtcctctcttggaactggagatactaatttaggggtagtgttagtgttcatttgcctgttggcactctgattcatttcctgctctttcatgctctactctgtatggcttgaggatgaggtgctaccaggagagtggggtgtgcaaggttgacccacacaaactacatctc

SEQ ID NO: 134058 - DNA, 316 bp, Homo sapiens
ctcagctatttgggagactgcagtgggaggatcactgaactctggaggcagaggttgcagtgagccaagatcatttcctgcactccaggctgggtgacagagtgagactctgtctcaaaataaatagatagatggatagacagatagatagcttttaaaggtagatttttccaataaaagtaatatatgtttatggtaagttttcaaatagtataaacatgtctcctcccaatttttccagttctgaatggagaataatgaaccattgttatatttctatacacaaatttctttcttggacaactttatataacag

SEQ ID NO: 134059 - DNA, 452 bp, Homo sapiens
tacaaaccttgattggattctgggtcaaattttgaagaaagcagtggctcacgcctatggtcccagtgatttgagaggctgaggcaggaagactacttaaacaccggagttcaaggctgcagcgagctatgattgtaccactgcactccagcctgggcaacagagcgacacactgtctggattaaaaaaaaaaaaaaaagaaaaggaaagtaaagcaggaacttcccacagattttgaataaaagctcaaaattaaaacagaggtaaaaccaaaaccaaggggatatgagaagaaaaaaaaaaaggacagttaaacagatgtcagaaaactcaccagaaaacaaaattgctacagagcatatgaaaattgtttttccaagaattaaagctacttaatgaattcctgactcacagaaatcatggtaataataaatgtttattgttttatgtta

SEQ ID NO: 134060 - DNA, 416 bp, Homo sapiens
gatgagcagggcactggcttgcaagctctgggtgcagttccttttagtcgcactgttgaagtgtgttaactaaatctgacagacgtgaatctggtcacgtgaatacctgggataatgtccgtttattattaaacacatcatttcctgagattcttagcttgatgtttaaaatcatctctcttgctaggaaattaataaaatatgcatctgacacaattatgtccacacctacaatcctgatgtcaaacaaaaagccccacaaatctagaaactagagaacgttgtatataagaaacaggtgagaaagaggcaactcactaagcttattgattaaactttgaaagaataaaacatatactgtgggaaacatcggcaattgaaggaacaattgctgtacttgtgaatcaaattcattc

SEQ ID NO: 134061 - DNA, 460 bp, Homo sapiens
agaactgacaagcaaattcggtaaagttgcagtatacaagatcaacttacaaaaatcagtagcatttataaatgccaacagagaaaaaactgaaaaggaaatcaaccccatttacaaaacgtacaaagaatatataatacctaggaataaatttaaggaaggaagtgaaagatctgtataaggaaatgaggatgaagaccaaatatatatttcacgatattacagtcctacgttttctttatccattcattcactgatgtgtgcttaggttgattccatattttggctactgtgaatagtgctataataaacatgggagtgcagatagctcttcaatatatatttttttcttttggatatatacccagcaatgggatatattggggcagttctagttctttttgttttgttttgttttgaagactctccatactgttcttcatagtggctgtactaattt

SEQ ID NO: 134062 - DNA, 676 bp, Homo sapiens
ggctgagacgatggggttttctaaatatacaatcatgtcatctgcaaacagggacaatttgacttcctcttttcctaattgaataccctttatttctcctgcctgattgccctggccggaacttccaacactgtgttgaataggagtgatgagagagggcatccctgtcttgtgccagttttcaaagggaatgcttccagtttttgtccattcagtatgatattggttgtgggtttgtcataaatagctcttattattttgagatatgttccatcaataccgaactaccttgacgtcacaaggcaccagcagtacccatgattgcttttgcatcgtcagtgtagcaatgatggcagatggcaaaatggcaaataacatcttaggattattatgaaagtatttttgacgttattactccctgaatgggtcttgaggacctccagaagtctgtgcttcacccagtgagaacagctacaagacacctatcctggaggtatgaacgagaaatactgactgtggggaaaagaccgtggctattaacaaaaatggcttgttttgcctcaaaatttaccatgttgagcaagctggcagttgctaaagtttggccttaccttctccactgacaacttgcaatgagtatgcacattttaacattatgatagaagctattttttga

SEQ ID NO: 134063 - DNA, 424 bp, Homo sapiens
cttcagcagttatcctccgtgcccagcgttgtttcagctgctcctgctcactccacgcccccccactccccagctcgaatcagtttgaatcagatcctctggtgtaattgtcatgagcagtctgggtctctccattctgaaagccagattctaatagtgtacccgatgtaaacaacaggactaagcactgacttttgttttttgaaaattgtcagttaaaaaatttgtgagccttttttttaggattacagtaataatgtaacaggctcattgaaactggaaatcacaaacagggtttaaagatgacagagcccttcatctttcagcatttggagctatcactgatgctttttaagggctgtggatacctctcctgtgctttttttttttttttttttggagacagagtcttgctctgtcgccc

SEQ ID NO: 134064 - DNA, 405 bp, Homo sapiens
aagcgatcctcccgtctctgcctcccacagtactgggattacaggcctgagcctctgtaccagctccatcaccccttccctcagatgtttttctctgtagtttctaataaccgagtgattgcacttttcctgctcttagtgcagaaatgcatgcttatacttatttcgtgcctttgtagtctgcttcggctatttgggcaattgtttctattttatgttaggcaggatactttcaatctttttttttttttttttaattgagatggagtttcgctcttgtcgcctaggctggagtgcaatggtgggatcttggcttactgcaaccttcgccacccaggttcaagtgattctcctgcctcagcctcctagtagctgggattacaggcacctgccaccacacctggc

SEQ ID NO: 134065 - DNA, 505 bp, Homo sapiens
agtgtcacattgtgaaaagaacatttggaatggggcatcttattgccaccatcttggaaaatatattttactacagtgactttcataggacagacactaaataaatgagatttcttcaagccaaagtgggaacaggtccacctaggcaagagaaccaaatgtgaaaaagtacatggtttgtttgggaacaggtcggccttgttttggagcgagaatcctatggtagagggttgtaaagagatgatgctgagaacgaagggttggaccagattgtgaagggccttttatggggaagccataaaggtttgtaagtagttaactgatgacaagttctttgttgagaattggtgggaatgtgaagggtggattttgagcagtggttctaaactgtttcactgcttctcatcatttattacccaaagaggatttttagcccaaagatagggggatataggagggatgagggggagcaggtgtagtacttgtatcagaatctcattttgag

SEQ ID NO: 134066 - DNA, 272 bp, Homo sapiens
aaactaacccttgtctgcctggttgtcctactcagaaagagctttctgcaatcacttactctcccacctgctcaggcgactaatgttgggccatgggaaggaaggaaatccagcccagtggaaaggcttctctcatcccatactccaaagaaccttaacctggttgtcacgagagcaggacaggtgctggagagccctgcccttccaaagtggatggaatatccacccatctgcttcaaagccatgaggcccaggtttggttgtaattggaa

SEQ ID NO: 134067 - DNA, 732 bp, Homo sapiens
ggaagtttgatttttaatgttttgaggagctgccagaactgttttccacagtcgctgtaacttttcgcattcccaccaacagtgtacaagaattctagttactctgcatcctcaccaacacgatattttctgggttttcatgagagtagtcatcctactgagtgtgaggtggtaattcattgtagtttcaaattatatctccctgatgatttagtgaggttgaacatcttttcatgtgcttattagccatttgtatatcttctttggagaaatgtctattcaagtccttttccaatctttcaatttagttgtttgcttcttttcttgttaagttttaggaattctatatatattttgatattaatcccttaatagatatgcgatttcaaatattctttctcattccgtaggttgcctttttattctatcactcatatcttttgatgaacaaaacttttcattttcatgaaatccaattttttttcttttgttgcctgtgactttggtgtcattgccaataaatcactgtcaaatgcaatgtcatgaagcttttgccttatgctttctaataacagctttatagttttagtcctatgtttcgatctttgatccattttgaggtcattttgtacatagtattaagtaagagtaatgtcattcttttgcatattggtgtccagtttttccagcaccatttgttggaaagactctcttttctccattgaatggtct

SEQ ID NO: 134068 - DNA, 404 bp, Homo sapiens
taacattccacaggggaggagatggatgccaggagaggtgagatgattcttattactcttccagggtgaggttagtgatggacactgggctggaacctggctctgatgtcctcatcccgtgatgcacagcagggtaagaggcactgaatgtagcaccatggcttattggagggaggcatccatgtgtagcttgagtctgaggatgagattctattgttgaagtcctacaacatattaataaattggcagccaactagactctcacagtttcctatggtcttccctctgctgagtgctcgtgggaagctgagttcagctgcctcacatttgtgggagtctgttagcagtgtgtaggtactggctgaggttctgtgtgagtgatccctggagagcagtgggggtgg

SEQ ID NO: 134069 - DNA, 362 bp, Homo sapiens
  misc_feature (14)..(15): n is a, c, g, or t
agctcggtaccccnntctgactacgcggctactgcagcctttgcccctcccgctcgcacagggcaggatgtgaccttttttcctcgttgatgccgccactgaacaccttaacccgattttacctcagtcacagctgtgctgggtggcatgaccccctccctaggtgtaatgcggggtcccacccacgtctccccggggacagcccctctcactccccttgcagagagcctggggaggggctgagggaggatgggatggttcactaggaatgtttttaattccaaaggcagtgacatctgttcgtgggggccttaccaccaggctctgtttatccagccgggggagtcttgcaggtcgtctga

SEQ ID NO: 134070 - DNA, 375 bp, Homo sapiens
tgttctttcttcccacatgtctgtgtagacagtactgtagaaggcctgtcgatttcatttttcaaattaaagtataatttaaatacagtaaaatttaccttatttaatatctattttgacaaatacatgcagtcatatagccagcacagtcaaggtatagaatagttccattacccccccccccccttgcaaatatcctttacccttttatggtcaactttgtcccccatttccagcccctggcaactactgatctgtttctgtccctatcattctgctttttccagaatgtcataaatagaaccatacagtatgtagtcttttgagtctggtttctttaacttaatacaatgtttgagggttatccacatcatc

SEQ ID NO: 134071 - DNA, 419 bp, Homo sapiens
tgtgtctcggaaaaaaaaaaaaaaaaaaggcaaatcccggccgagcctttggctcacgcatgtgatcccagcacttttgggaagctgaggctggaggatcacttgaggtcagaagtttgagaccagcctaggcaacatagcgagacccccatgtctacaaaacaataattagccaggaatggtggatgagcctgttgtcccagctactcgggaagcagagacgggaggttcgcttgagcctgggaggtcgaggctgcagtgtgccctgatcgtgccactgcacgttagcctgggcaacacagcaagaccccgtgtcttaaaaaaaaaaaggtaaataagagttggggacacttttctgcgagttggagaaaccaaaccccctcgacgagtcttaagtagtattctcaggttgtctggcc

SEQ ID NO: 134072 - DNA, 526 bp, Homo sapiens
aaactccaggggggtcacgggaatgtccccactcccgccatagcccacgcaggggcagagcccacccgaggccagggaggtgtgcctgctgctgccccacagccgcagggaatggcgttctcttcctctgaagccggggcctgaagagtgccctcctggggaagatgtggaccccggggctgccatggagacagggactccagaggccgattccatgccctgcttgagcccctgagtctagtgggacctgagagcctcccctggggtcttcaccttggtgaggaagcaacttcccttttctgctcaatcgagtttaatgtggattctgtcacttgcacctgaaggaggcctaattcacaggaaggccatggctgaacagggtcctcgcttcctccatgggggtggggccgcagggacacaggcagatgaaacagcaactctagccagagggaagctcccggtgaggaggccgggcaagcccggcacagctgctgcagccatctgggcctcacacaccacgctaggc

SEQ ID NO: 134073 - DNA, 2863 bp, Homo sapiens
tatgatcaaattagactgtgcctggttgggtggtaagatcactctgaaagaaagctcactgtgaagagatgaaaggtggaggcagagctgtgaggtcatggggaaaagcctgctttccttataagtcctgctgttcatgttggaataaggatctgctcttccttgtttccatgcattttgcaggattccaggtaccattaccacactcttctgacccatgaaaccaactggctgctcacacatcaccaaacaggttgggggttagccttcagcacaggtggatacatctgggattcactgagattcctgccctctcctgcttcctagtggtttgggacaggccctctgcccatcgtcagcagttttttgctttcatacaaacctggaaggcactggcatctgcctaggaaagtggatctgtgaagaacagatgaactcaatcctttctggagtctgacaaagaagggataggcttccttgacattgcctgtcctgacaaggcctccctgacattactcctccaatttcacagttaccttctgtaaatctattttctcatctactgaatagaatcaggcgccctttttgtcttcccacctcttatctcttggcaattttaaggggaattaatgcaagaacaactttagtgtctcttgggaaaacaagccaaccaaatacaaaacccattaagcctactagggtgagtcctcttaacatgggaaggcgatgattatgcaaacaccggagttccctcctcttcagttcctaagaataaagaacaggtatcaagaactttctttaaagttagtgtaactatagttaacaaagtatccattgaagtttagtgcctgtaggactgagccagtgctttatcaacccaacacatcatcaccatgtgcatactctagaaaaaaaaatagcttccttaaaagttacagaggctcttaacgtgttaaaaccgaaaaatcacatttttcttgatttcaaatatgttctacggccttactgttgggatgatatttagtatgtaacttagcattccaatttctcaagaatttttaggccgggtgcggtggctcatgcctgtaatcccagcactttgggaggccgaggtgggcggaccacgaggtcaggagatcgagaccatcctggctaacacggtaccccgtctctactgaaaatacaaaaaaattagccggacgtggtggagggcgcctgtagtcccagctactcaggaggctgaggcaggagaatggcgtgaacccggtgagcggagcttgcagtgagccgagattgcgccactgcactccagcctgggcgacagagcgagactctctcaaaaaaaaaaaaaaagaatttttagcaaaacatcctgtttttacttaaaattcttctcatatttattatagttagaaggcaaagatcaagatgacctgccgtttgactgcttttacatcaaactctgcccagtatttgcagcacaactcaggggaagggccttagcttacaggtactcccagccttcatctgcccctgcagagcagtggctgtcagccggatgcggcacttttctgtattttcatccacacagctgcccagccagagttcgcaacactggatatttacaccaaataattgtggttgacttgtctgaagccagctgacaaaaggatcagcttttcccacttgtattttttaaaaagagggattgtgatcattgtcacagagtggggtgctggcctctcatatatatgatatatatatatcattttatatatatatatatatcatatacataatttttactgctgtctctagttttaagtcccaacaataggaaggccgatcagctatattgatatatttaaggctgtacttaactaatttgggctgaggatgaatatatcagccacagcacattaaagaatgagccaaggatttgtcatggttggtcactttttaaagtatttgattactgcaactggagaatgaaaagtgtatattggtgacgccaacctcagtttctgagcactcctgctctgtggtgagaatcagacaaaaattcatcggggtgaaaaaaaaaaggcattacctgattcacacccttgtcttgctagccctcttccattcatttctcacacagcactttgctctgttaaatcctctctctgtctcagaccattgcttgccccttcaaagggtatggttcaggctcctttcaagacatttggagtttctctctggggaaagagagccccctactggtttggcttcagtctaggtccaccatccctctcgatctggcatcttggagattaatttaaaaggcaagctcaccacaatgtaagcctatggtctggccaaccttgcttttgggaactgtgacaccaaagcccccaggactatctgcctctccaggagccagatagaatgacatgcctttttcctaattgtccacattccacccccaacccactgccactgtgggccaagccatccatcttgcaatcttcatctaaaacagctctcatttcatgccagttttgctcaaacctgcaccgtcacaagatattcagaagatgaaaacgtagaagacacccctgaattaaaaacacttacatagcagtggctggaattactccaaaacgtgcccagtgatcgcactgtaacatgggattttctcacccaaataggcaactcatgcttcctgagtgtaatcaaagcatgtggtgttttggggccatatgcaccaggtttctattttagaaaccttcagctgtcttgcttatgtaccgtatgtaaatttattctttttaaaaatcacttttatttgattttgacttattaaatgctttaaaagcca

SEQ ID NO: 134074 - DNA, 3289 bp, Homo sapiens
tatgatcaaattagactgtgcctggttgggtggtaagatcactctgaaagaaagctcactgtgaagagatgaaaggtggaggcagagctgtgaggtcatggggaaaagcctgctttccttataagtcctgctgttcatgttggaataaggatctgctcttccttgtttccatgcattttgcaggattccaggtaccattaccacactcttctgacccatgaaaccaactggctgctcacacatcaccaaacaggttgggggttagccttcagcacaggtggatacatctgggattcactgagattcctgccctctcctgcttcctagtggtttgggacaggccctctgcccatcgtcagcagttttttgctttcatacaaacctggaaggcactggcatctgcctaggaaagtggatctgtgaagaacagatgaactcaatcctttctggagtctgacaaagaagggataggcttccttgacattgcctgtcctgacaaggcctccctgacattactcctccaatttcacagttaccttctgtaaatctattttctcatctactgaatagaatcaggcgccctttttgtcttcccacctcttatctcttggcaattttaaggggaattaatgcaagaacaactttagtgtctcttgggaaaacaagccaaccaaatacaaaacccattaagcctactagggtgagtcctcttaacatgggaaggcgatgattatgcaaacaccggagttccctcctcttcagttcctaagaataaagaacaggtatcaagaactttctttaaagttagtgtaactatagttaacaaagtatccattgaagtttagtgcctgtaggactgagccagtgctttatcaacccaacacatcatcaccatgtgcatactctagaaaaaaaaatagcttccttaaaagttacagaggctcttaacgtgttaaaaccgaaaaatcacatttttcttgatttcaaatatgttctacggccttactgttgggatgatatttagtatgtaacttagcattccaatttctcaagaatttttaggccgggtgcggtggctcatgcctgtaatcccagcactttgggaggccgaggtgggcggaccacgaggtcaggagatcgagaccatcctggctaacacggtaccccgtctctactgaaaatacaaaaaaattagccggacgtggtggagggcgcctgtagtcccagctactcaggaggctgaggcaggagaatggcgtgaacccggtgagcggagcttgcagtgagccgagattgcgccactgcactccagcctgggcgacagagcgagactctctcaaaaaaaaaaaaaaagaatttttagcaaaacatcctgtttttacttaaaattcttctcatatttattatagttagaaggcaaagatcaagatgacctgccgtttgactgcttttacatcaaactctgcccagtatttgcagcacaactcaggggaagggccttagcttacaggtactcccagccttcatctgcccctgcagagcagtggctgtcagccggatgcggcacttttctgtattttcatccacacagctgcccagccagagttcgcaacactggatatttacaccaaataattgtggttgacttgtctgaagccagctgacaaaaggatcagcttttcccacttgtattttttaaaaagagggattgtgatcattgtcacagagtggggtgctggcctctcatatatatgatatatatatatcattttatatatatatatatatcatatacataatttttactgctgtctctagttttaagtcccaacaataggaaggccgatcagctatattgatatatttaaggctgtacttaactaatttgggctgaggatgaatatatcagccacagcacattaaagaatgagccaaggatttgtcatggttggtcactttttaaagtatttgattactgcaactggagaatgaaaagtgtatattggtgacgccaacctcagtttctgagcactcctgctctgtggtgagaatcagacaaaaattcatcggggtgaaaaaaaaaaggcattacctgattcacacccttgtcttgctagccctcttccattcatttctcacacagcactttgctctgttaaatcctctctctgtctcagaccattgcttgccccttcaaagggtatggttcaggctcctttcaagacatttggagtttctctctggggaaagagagccccctactggtttggcttcagtctaggtccaccatccctctcgatctggcatcttggagattaatttaaaaggcaagctcaccacaatgtaagcctatggtctggccaaccttgcttttgggaactgtgacaccaaagcccccaggactatctgcctctccaggagccagatagaatgacatgcctttttcctaattgtccacattccacccccaacccactgccactgtgggccaagccatccatcttgcaatcttcatctaaaacagctctcatttcatgccagttttgctcaaacctgcaccgtcacaagatattcagaagatgaaaacgtagaagacacccctgaattaaaaacacttacatagcagtggctggaattactccaaaacgtgcccagtgatcgcactgtaacatgggattttctcacccaaataggcaactcatgcttcctgagtgtaatcaaagcatgtggtgttttggggccatatgcaccaggtttctattttagaaaccttcagctgtcttgcttatgtaccgtatgtaaatttattctttttaaaaatcacttttatttgattttgacttattaaatgctttaaaagccaaaaaaaaaaaacagacacaacccctccatcctagccacacaaacaagaacggggcggcgggccaccagaaaatatattcctcccgccggagcgggcgccacaattcgatcgcacacgcacccactttcgtcctaagacaagacggggccccccaacacagagcggcacactatcaatatcacgaacgacagagcgcgcgccgcgccttctacacacacgcgacgcgaggacagaaaaactcgccgcacctgcggcccgctagcaggaaaccccacacactctcggcggccggcacaactggcccgacgcccccacccgaactaactccccgcggaagataatacctaccgaggcgacagtggtgcgccaccacgccagcgtatggcgccggcaaaatgcgtcccgagtgatatgacaaacaaaacg

SEQ ID NO: 134075 - DNA, 3339 bp, Homo sapiens
cgcttccagcgccgctgcgggctcttccccgctccggatgaaggcccccgggagaacggcgcggaccccacggagcgcgcggcgcgggtccccggggtcgagcatctccccgcagccaacggcaagggcggcgaggctccggccaacgggctgcgcagagccgcggcgccggaggcttatgtacagaagtacgtcgtgaagaattatttctactattacctattccaattttcagctgctttgggccaagaagtgttctacatcacgtttcttccattcactcactggaatattgacccttatttatccagaagattgatcatcatatgggttttggtgatgtatattggccaagtggccaaggatgtcttgaagtggccccgtccctcctcccctccagttgtaaaactggaaaagagactgatcgctgaatatggaatgccatccacccacgccatggcggccactgccattgccttcaccctccttatctctactatggacagataccagtatccatttgtgttgggactggtgatggccgtggtgttttccaccttggtgtgtctcagcaggctctacactgggatgcatacggtcctggatgtgctgggtggcgtcctgatcaccgcactcctcatcgtcctcacctaccctgcctggaccttcatcgactgcctggactcggccagccccctcttccccgtgtgtgtcatagttgtgccattcttcctgtgttacaattaccctgtttctgattactacagcccaacccgggcggacaccaccaccattctggctgccggggctggagtgaccataggattctggatcaaccatttcttccagcttgtatccaagcccgctgaatctctccctgttattcagaacatcccaccgctcaccacctacatgttagttttgggtctgaccaaatttgcagtgggaattgtgttgatcctcttggttcgtcagcttgtacaaaatctctcactgcaagtattatactcatggttcaaggtggtcaccaggaacaaggaggccaggcggagactggagattgaagtgccttacaagtttgttacctacacatctgttggcatctgcgctacaacctttgtgccgatgcttcacaggtttctgggattaccctgagtctcaaacagttggaaactagcccactggacatgaaagccaagacataggaaagttattggtaggcaaatcttgacaacttatttttctttaacaacaacaaaaagtcatacggctgtcttgctactaccagataaatgatgctgctgtgtgaaaggaagaactgtctcatagcggtcattggtcgtccgtggtggttggttgtgctacagttgaacccaggctaaagaccataatccggatctttaaaggcacacaccgcgccccccccccccgcgcccggcccctgctcctctcgctgttgcacgggctttggatctagtcatgggctggcaggaattgtggcctggcttaggaatagctatgagccccactgggttctggagagccagtagagatggggtgatctgggaggctggaggtagagcctttcttttccgttacaaccttgcctagcatggagttatttctaaaatgggaactttggtctaggagaaggggtggcaccatatgaaacggcattccttggacagggtgacttccttatcgtttatttggtgattttttgttttgttttgtttgagacaggatcttgctctgtttcccaggctgtattgcgccactgcactccagcctgggcgacagagcgagactctctcaaaaaaaaaaaaaaagaatttttagcaaaacatcctgtttttacttaaaattcttctcatatttattatagttagaaggcaaagatcaagatgacctgccgtttgactgcttttacatcaaactctgcccagtatttgcagcacaactcaggggaagggccttagcttacaggtactcccagccttcatctgcccctgcagagcagtggctgtcagccggatgcggcacttttctgtattttcatccacacagctgcccagccagagttcgcaacactggatatttacaccaaataattgtggttgacttgtctgaagccagctgacaaaaggatcagcttttcccacttgtattttttaaaaagagggattgtgatcattgtcacagagtggggtgctggcctctcatatatatgatatatatatatcattttatatatatatatatatcatatacataatttttactgctgtctctagttttaagtcccaacaataggaaggccgatcagctatattgatatatttaaggctgtacttaactaatttgggctgaggatgaatatatcagccacagcacattaaagaatgagccaaggatttgtcatggttggtcactttttaaagtatttgattactgcaactggagaatgaaaagtgtatattggtgacgccaacctcagtttctgagcactcctgctctgtggtgagaatcagacaaaaattcatcggggtgaaaaaaaaaaggcattacctgattcacacccttgtcttgctagccctcttccattcatttctcacacagcactttgctctgttaaatcctctctctgtctcagaccattgcttgccccttcaaagggtatggttcaggctcctttcaagacatttggagtttctctctggggaaagagagccccctactggtttggcttcagtctaggtccaccatccctctcgatctggcatcttggagattaatttaaaaggcaagctcaccacaatgtaagcctatggtctggccaaccttgcttttgggaactgtgacaccaaagcccccaggactatctgcctctccaggagccagatagaatgacatgcctttttcctaattgtccacattccacccccaacccactgccactgtgggccaagccatccatcttgcaatcttcatctaaaacagctctcatttcatgccagttttgctcaaacctgcaccgtcacaagatattcagaagatgaaaacgtagaagacacccctgaattaaaaacacttacatagcagtggctggaattactccaaaacgtgcccagtgatcgcactgtaacatgggattttctcacccaaataggcaactcatgcttcctgagtgtaatcaaagcatgtggtgttttggggccatatgcaccaggtttctattttagaaaccttcagctgtcttgcttatgtaccgtatgtaaatttattctttttaaaaatcacttttatttgattttgacttattaaatgctttaaaagcca

SEQ ID NO: 134076 - DNA, 904 bp, Homo sapiens
accgccattgtgtgggcagatggtatgtcagtctgtcaggggtgatcggtatctggaggtgacactgttgcgtcagtagcaggtacgtagaatggaacccagagtcctgcccctttccacctacatgcattacctgattcacacccttgtcttgctagccctcttccattcatttctcacacagcactttgctctgttaaatcctctctctgtctcagaccattgcttgccccttcaaagggtatggttcaggctcctttcaagacatttggagtttctctctggggaaagagagccccctactggtttggcttcagtctaggtccaccatccctctcgatctggcatcttggagattaatttaaaaggcaagctcaccacaatgtaagcctatggtctggccaaccttgcttttgggaactgtgacaccaaagcccccaggactatctgcctctccaggagccagatagaatgacatgcctttttcctaattgtccacattccacccccaacccactgccactgtgggccaagccatccatcttgcaatcttcatctaaaacagctctcatttcatgccagttttgctcaaacctgcaccgtcacaagatattcagaagatgaaaacgtagaagacacccctgaattaaaaacacttacatagcagtggctggaattactccaaaacgtgcccagtgatcgcactgtaacatgggattttctcacccaaataggcaactcatgcttcctgagtgtaatcaaagcatgtggtgttttggggccatatgcaccaggtttctattttagaaaccttcagctgtcttgcttatgtaccgtatgtaaatttattctttttaaaaatcacttttatttgattttgacttattaaatgctttaaaagcca

SEQ ID NO: 134077 - DNA, 1314 bp, Homo sapiens
cgcttccagcgccgctgcgggctcttccccgctccggatgaaggcccccgggagaacggcgcggaccccacggagcgcgcggcgcgggtccccggggtcgagcatctccccgcagccaacggcaagggcggcgaggctccggccaacgggctgcgcagagccgcggcgccggaggcttatgtacagaagtacgtcgtgaagaattatttctactattacctattccaattttcagctgctttgggccaagaagtgttctacatcacgtttcttccattcactcactggaatattgacccttatttatccagaagattgatcatcatatgggttttggtgatgtatattggccaagtggccaaggatgtcttgaagtggccccgtccctcctcccctccagttgtaaaactggaaaagagactgatcgctgaatatggaatgccatccacccacgccatggcggccactgccattgccttcaccctccttatctctactatggacagataccagtatccatttgtgttgggactggtgatggccgtggtgttttccaccttggtgtgtctcagcaggctctacactgggatgcatacggtcctggatgtgctgggtggcgtcctgatcaccgcactcctcatcgtcctcacctaccctgcctggaccttcatcgactgcctggactcggccagccccctcttccccgtgtgtgtcatagttgtgccattcttcctgtgttacaattaccctgtttctgattactacagcccaacccgggcggacaccaccaccattctggctgccggggctggagtgaccataggattctggatcaaccatttcttccagcttgtatccaagcccgctgaatctctccctgttattcagaacatcccaccgctcaccacctacatgttagttttgggtctgaccaaatttgcagtgggaattgtgttgatcctcttggttcgtcagcttgtacaaaatctctcactgcaagtattatactcatggttcaaggtggtcaccaggaacaaggaggccaggcggagactggagattgaagtgccttacaagtttgttacctacacatctgttggcatctgcgctacaacctttgtgccgatgcttcacaggtttctgggattaccctgagtctcaaacagttggaaactagcccactggacatgaaagccaagacataggaaagttattggtaggcaaatcttgacaacttatttttctttaacaacaacaaaaagtcatacggctgtcttgctactaccagataaatgatgctgctgtgtgaaagga

SEQ ID NO: 134078 - DNA, 1730 bp, Homo sapiens
cgcttccagcgccgctgcgggctcttccccgctccggatgaaggcccccgggagaacggcgcggaccccacggagcgcgcggcgcgggtccccggggtcgagcatctccccgcagccaacggcaagggcggcgaggctccggccaacgggctgcgcagagccgcggcgccggaggcttatgtacagaagtacgtcgtgaagaattatttctactattacctattccaattttcagctgctttgggccaagaagtgttctacatcacgtttcttccattcactcactggaatattgacccttatttatccagaagattgatcatcatatgggttttggtgatgtatattggccaagtggccaaggatgtcttgaagtggccccgtccctcctcccctccagttgtaaaactggaaaagagactgatcgctgaatatggaatgccatccacccacgccatggcggccactgccattgccttcaccctccttatctctactatggacagataccagtatccatttgtgttgggactggtgatggccgtggtgttttccaccttggtgtgtctcagcaggctctacactgggatgcatacggtcctggatgtgctgggtggcgtcctgatcaccgcactcctcatcgtcctcacctaccctgcctggaccttcatcgactgcctggactcggccagccccctcttccccgtgtgtgtcatagttgtgccattcttcctgtgttacaattaccctgtttctgattactacagcccaacccgggcggacaccaccaccattctggctgccggggctggagtgaccataggattctggatcaaccatttcttccagcttgtatccaagcccgctgaatctctccctgttattcagaacatcccaccgctcaccacctacatgttagttttgggtctgaccaaatttgcagtgggaattgtgttgatcctcttggttcgtcagcttgtacaaaatctctcactgcaagtattatactcatggttcaaggtggtcaccaggaacaaggaggccaggcggagactggagattgaagtgccttacaagtttgttacctacacatctgttggcatctgcgctacaacctttgtgccgatgcttcacaggtttctgggattaccctgagtctcaaacagttggaaactagcccactggacatgaaagccaagacataggaaagttattggtaggcaaatcttgacaacttatttttctttaacaacaacaaaaagtcatacggctgtcttgctactaccagataaatgatgctgctgtgtgaaaggaagaactgtctcatagcggtcattggtcgtccgtggtggttggttgtgctacagttgaacccaggctaaagaccataatccggatctttaaaggcacacaccgcgccccccccccccgcgcccggcccctgctcctctcgctgttgcacgggctttggatctagtcatgggctggcaggaattgtggcctggcttaggaatagctatgagccccactgggttctggagagccagtagagatggggtgatctgggaggctggaggtagagcctttcttttccgttacaaccttgcctagcatggagttatttctattttagaaaccttcagctgtcttgcttatgtaccgtatgtaaatttattctttttaaaaatcacttttatttgattttgacttattaaatgctttaaaagcca

SEQ ID NO: 134079 - DNA, 525 bp, Homo sapiens
agttattcattaagaaaacaaatacagaatttattccaaaaggtaaaaaaggtgaaagaagatacgtaacatgagtagtatggttgttggaagcattttttcgtattttcacttcaaagttttagaactttacactttctttgaacatgtactgtaaaataaaacaatgcaaaaattgtgttttaaatatcaaattagccatacttgattcaaattatacctgtatacaaggaaacactcattggttcacactgttcttttctctccttcccaaaggatgtgctgggtggcgtcctgatcaccgcactcctcatcgtcctcacctaccctgcctggaccttcatcgactgcctggactcggccagccccctcttccccgtgtgtgtcatagttgtgccattcttcctgtgttacaattaccctgtttctgattactacagcccaacccgggcggacaccaccaccattctggctgccggggctggagtgaccataggattctggatcaaccatttcttccagctt

SEQ ID NO: 134080 - DNA, 2929 bp, Homo sapiens
cgcttccagcgccgctgcgggctcttccccgctccggatgaaggcccccgggagaacggcgcggaccccacggagcgcgcggcgcgggtccccggggtcgagcatctccccgcagccaacggcaagggcggcgaggctccggccaacgggctgcgcagagccgcggcgccggaggcttatgtacagaagtacgtcgtgaagaattatttctactattacctattccaattttcagctgctttgggccaagaagtgttctacatcacgtttcttccattcactcactggaatattgacccttatttatccagaagattgatcatcatatgggttttggtgatgtatattggccaagtggccaaggatgtcttgaagtggccccgtccctcctcccctccagttgtaaaactggaaaagagactgatcgctgaatatggaatgccatccacccacgccatggcggccactgccattgccttcaccctccttatctctactatggacagataccagtatccatttgtgttgggactggtgatggccgtggtgttttccaccttggtgtgtctcagcaggctctacactgggatgcatacggtcctggatgtgctgggtggcgtcctgatcaccgcactcctcatcgtcctcacctaccctgcctggaccttcatcgactgcctggactcggccagccccctcttccccgtgtgtgtcatagttgtgccattcttcctgtgttacaattaccctgtttctgattactacagcccaacccgggcggacaccaccaccattctggctgccggggctggagtgaccataggattctggatcaaccatttcttccagctttcatacggctgtcttgctactaccagataaatgatgctgctgtgtgaaaggaagaactgtctcatagcggtcattggtcgtccgtggtggttggttgtgctacagttgaacccaggctaaagaccataatccggatctttaaaggcacacaccgcgccccccccccccgcgcccggcccctgctcctctcgctgttgcacgggctttggatctagtcatgggctggcaggaattgtggcctggcttaggaatagctatgagccccactgggttctggagagccagtagagatggggtgatctgggaggctggaggtagagcctttcttttccgttacaaccttgcctagcatggagttatttctaaaatgggaactttggtctaggagaaggggtggcaccatatgaaacggcattccttggacagggtgacttccttatcgtttatttggtgattttttgttttgttttgtttgagacaggatcttgctctgtttcccaggctgtattgcgccactgcactccagcctgggcgacagagcgagactctctcaaaaaaaaaaaaaaagaatttttagcaaaacatcctgtttttacttaaaattcttctcatatttattatagttagaaggcaaagatcaagatgacctgccgtttgactgcttttacatcaaactctgcccagtatttgcagcacaactcaggggaagggccttagcttacaggtactcccagccttcatctgcccctgcagagcagtggctgtcagccggatgcggcacttttctgtattttcatccacacagctgcccagccagagttcgcaacactggatatttacaccaaataattgtggttgacttgtctgaagccagctgacaaaaggatcagcttttcccacttgtattttttaaaaagagggattgtgatcattgtcacagagtggggtgctggcctctcatatatatgatatatatatatcattttatatatatatatatatcatatacataatttttactgctgtctctagttttaagtcccaacaataggaaggccgatcagctatattgatatatttaaggctgtacttaactaatttgggctgaggatgaatatatcagccacagcacattaaagaatgagccaaggatttgtcatggttggtcactttttaaagtatttgattactgcaactggagaatgaaaagtgtatattggtgacgccaacctcagtttctgagcactcctgctctgtggtgagaatcagacaaaaattcatcggggtgaaaaaaaaaaggcattacctgattcacacccttgtcttgctagccctcttccattcatttctcacacagcactttgctctgttaaatcctctctctgtctcagaccattgcttgccccttcaaagggtatggttcaggctcctttcaagacatttggagtttctctctggggaaagagagccccctactggtttggcttcagtctaggtccaccatccctctcgatctggcatcttggagattaatttaaaaggcaagctcaccacaatgtaagcctatggtctggccaaccttgcttttgggaactgtgacaccaaagcccccaggactatctgcctctccaggagccagatagaatgacatgcctttttcctaattgtccacattccacccccaacccactgccactgtgggccaagccatccatcttgcaatcttcatctaaaacagctctcatttcatgccagttttgctcaaacctgcaccgtcacaagatattcagaagatgaaaacgtagaagacacccctgaattaaaaacacttacatagcagtggctggaattactccaaaacgtgcccagtgatcgcactgtaacatgggattttctcacccaaataggcaactcatgcttcctgagtgtaatcaaagcatgtggtgttttggggccatatgcaccaggtttctattttagaaaccttcagctgtcttgcttatgtaccgtatgtaaatttattctttttaaaaatcacttttatttgattttgacttattaaatgctttaaaagcca

SEQ ID NO: 134081 - DNA, 273 bp, Homo sapiens
cggcttcccaaagtgctgggattacaggtgtgagccactgctcccggccgctggctgtgttctagtattgaggagagatgggagctgctggcagctctccgtcctggtgaggcaggggattaggggcagcacagaggaggaatttggagagtggagtgtttaagatcttcgtggagcttgctgggagatgtctgaggggtgggggcaccttctccagcatcacaccagccgccccctccgcagttctctttgatgcagtactctgaagaattc

SEQ ID NO: 134082 - DNA, 387 bp, Homo sapiens
ctgggattagagacatgaggcacgtgcttattttgtatatatagtagagacagggtttcaccatgttggccaggctggtctcaaactcctgacctcaaatgatccgcccacctctgcctcccaaagtgctggaattacaggcgtgagccaccatgcctggccacacctcagtggttttctaactgtgcccacagagctcttaggtctcagccagggtctctggaggtccctgttccatggggctcaggaagaaggagccagacgccaactgggctcttgttccctctgcccctgcctggcaatttgtgtgtttattcattcacctcaccggacaaacatgccccaggaccatgttacatgccaggcctcatgcgggtcatcagggca

SEQ ID NO: 134083 - DNA, 276 bp, Homo sapiens
gaatggctgtttttaaaaagattcttcagatgactctaatgtttagctcagggtgtgaaacactgccttagcagaactagggacaagagggaggctggagaggtttctgtaggttttcttcagtctgtttatcaggagacagtacagaatgggactctgcctttttcccccagtcgttctgatgttttgctgccaaaatagatatacctgcaatgtcttgtttgtctttatttggaaatagtagacagtattgatatggagtggatagtggagtac

SEQ ID NO: 134084 - DNA, 363 bp, Homo sapiens
gcatgagccactgtgtccagccaatttttattttaatggtattcttctttccctattattttacctggacagacttaacccagaggatagaggaacctcatcatggatcctggtccgcttttagcttaacagcatccaaagacaaagggtcagagatggtagcaaccctagtgtggttgattacacagtagtggtgttattttgttgtcataggatgcaaatatcaaagttgtatctcttaagatctttctgtgtcagtacataaaagctttctcagtctttttaatgctgcatagtattctacacagggcactattctatactttaaccagttcccattggtagacacatttttttccagtc

SEQ ID NO: 134085 - DNA, 529 bp, Homo sapiens
attcgtatctgttcacccaaaattggacacttactgtgttccagacctaatctaagctctttacatgttttatctcatttaagcctctccacaatcttatgaggtatgtatgcactgttaccattcccatgttagatatagaaaatccaggcatagagaagataaggtctcaaagtcatgaagctaacaagtggtacagccattatttgaacccagtttactccagatcccacactctaaatcacaatgcagcatggatgcctaatattctcaggtcagtccatcaacttccaagtaaatgagtctccaaaagcatcaaaggtattatttccttaaaatgattaaatacatggatttgctttcaaattcatgtttctaatactcaactataatatatcttaaatctctggaagtcctttaatcaatttttcagatgaatttttttttttttttttttgggaaaaagagtttggcagggtcacacttgtgggagggaaggggagtaattggggttcagggaaacctcggc

SEQ ID NO: 134086 - DNA, 239 bp, Homo sapiens
taatatcaggagaagcccctgggatggccttgcctgctcatttgatcaagccttcccattactcatgttttcagaaagtgctgcttgtcttcttttccatgtgccctgtgtgaaaacttaaaaagtttggagatggcagatcacgaagagccagggtaggaaagtcaatgtggttgtcttctgaacacccagcgtcttccattccagagcaggtggcagcagagagttgacactgcctc

SEQ ID NO: 134087 - DNA, 360 bp, Homo sapiens
  misc_feature (53)..(53): n is a, c, g, or t
cccggtggttccttgtcttatatagtgattcagttctctgaaacgggtttatngtccccattttaaagaagcagaaacagggctgcgcgcggtggctcacgcctgtaatcccagcatttgagaggccgaggcgggtggatcacctgaggtcaggagttccagaccctgttactccctgttcctgggaatattcactcagaatctggaaaactgtatatccccgacattacagaaggggttcctgcgtgaggtgagaaggagacagagaggtgatctctcaaaggtctttcagttgtatgattcagggtgtccaggttcccatagggatcattagggtttgattatagacaaagggaaaca

SEQ ID NO: 134088 - DNA, 228 bp, Homo sapiens
tctatactttgccactcctcccacctgtaagaatttacaagtccccatatgtgctgagcagtctctcccactctgttttagtttctgtcatgtcctccatggggcatgtcctccttctacttgtctgtctggccaatctgactttattttaaatctgagataaactgtgtcctgtctgaaaccttccctgatttttttcaaggtagaagtcatcatatcttttttttt

SEQ ID NO: 134089 - DNA, 910 bp, Homo sapiens
gatgcatcttatttctttataatgatctgggtttaaaccttgaaatcaagtcccagaaacacaaactttatgaatcaaatacttattataaatattaatgtaattgtcagaaaactggtagaataagaactttttcttagataaaaataaaaactgtgtgtgttgaatttgaaattagtcgccctttatacgtggggatatgttccaagaccccagtggatgcctgaaacctcagatagtaccaaacttcattgctgtcggttgaaacacatttctcatgtcttccactcatgtatttaatgccttttccatcttaactaataggcatttatcacgtttctttttccttctttataatttcatagatagaacatcgtttcttaccatagtaacctcagcgtaggatttttcctttcctgttcaagttaagaacgtttatcttttcacttaaagaaagcagtttatgccttctctttggcatatttaaattgccagcatcatttgcactttggggctattattaaataaaataagagttacttgaacacaacactgagatatcctgataactgagatctggtaactgagatggctgcctaagtgactaaagggcagatagtgtacacaatgtagatgcactgggcaaggggatgatttacgtcctgtatgggctggagtagggtggtaggaggtttcatcatgctactcaaaatggtgtgcagttaggttggtacaaaagtaattgtggttttgccattttaatgacaaaaatcacaattacttttgcactaaattagtatatgaactgtttatttctggaatttttcatttaatatttttgggctacagttgacctcaggcaactaaaacctcagaaagggaaattgtggataagggaaggactactata

SEQ ID NO: 134090 - DNA, 382 bp, Homo sapiens
caaaacaaccagttaaagtttggtgttcgcttctcacaaggcttgagatgtcctgtgctcaaaaccaggcaccaggaaggggagtggacaaagcaacaggaacagaggcggcagcagcaaagctggctctggaaaaatctttcaccttgcttcgctctatgggcttttcattccacagacatgcctgtacttcccattcacactagagcagtgagagagaacacaggtcctggagccagttgactgtggttcaaatcctgccacaccccttgctaactaggtgatcttagacaagtatttcacctcttggtatctcagtttcctcatctgaaaaatggggttgttgtaaggactaaacaatttacatgagacagcacatgta

SEQ ID NO: 134091 - DNA, 266 bp, Homo sapiens
agtttatcgatgccacttgccgggtggtcttgggtgaattacttaaccacccttagcctttttttctctgctgtagagtgactaacagagccttcgaacagggtctgggtagacttgggggcggtggagagtatctcgaagactttccaaaggcttcgaaagcacatgggtggttttaagagaagcagtgtgcagattcccaacctccactttctccctgatacggtttggaactgtgatctcacccaaatctcctgtcgaatggt

SEQ ID NO: 134092 - DNA, 355 bp, Homo sapiens
ctctactgaataaaagcagagtgacttacaattgagataggccaatctaaaactgaaaagtctaaaatgtcaaacttttaaaataaggggatgttcactgcttatttgactcattaaaaataaaaatacctagtgattgtgaatttaaaactgtagacttatgatttgtgcattttatatatgttattcttcaattagaagttcaagaaataataatgggaggcctgtattaaaccatttatataaaagtttctcaaccataatggaaagatcaagatgtctagcataatttgaaagtatgtttctatttgacagaaaccttggcttggaaaagttaaactctaaatatttgtac

SEQ ID NO: 134093 - DNA, 521 bp, Homo sapiens
ttattggttgtctggtagaatatagcatccattaattttcactgaatctgaaatactaggaacttaaaggcaccagtgaaagtactgggatatgcctaaacaataagagatagtcaaagttaaacacacagaaatattttctgccattcacctatgctctcctactgtaccccatccatttttactttccaaagaataaaggcaataaaattatccctccaaaatttgattgctagtatcaatggggatgtgtgagaatgtgttttacacagctaaaagcatctgtaagtatgtatttggaaaggtatcctaaaacatttattactccttaatattaaatgctcagtttttttgtttgttttgttttgttttttgagatggagtcttgctctgttgcccaggctggaatgcaatggcacgagctcagctcactgcaacctctgcctcctgggttcaaccgattctcctgcctcagcctcccgagtagctgggattataggcgtgcgccaccatgccccact

SEQ ID NO: 134094 - DNA, 257 bp, Homo sapiens
tttccagcttttgtgctcctaatctctatgcctttattcatcctttctaatatttcactcctacacattaactaaaactgtttaattaatggcagattcctcagtgaccaaattgactccctcattttgtatcccttctcctagaacgatctgtgacattaaattccaccattcatgctctgtatttttcattgcctttattgacgtctgtgaccataggacactttgctatgcctactttttaatttttcaccacc

SEQ ID NO: 134095 - DNA, 161 bp, Homo sapiens
tacacaaagaatttatgactaacatctcaaaaacaaatccaacaaaaaacaaaaatagacaaaagtgacttagtttaactgaaaaacttctgtacagcaaaggaaataattgagagaacagacaacctaacaatgggagaaaacatctgtaatctatgcct

SEQ ID NO: 134096 - DNA, 258 bp, Homo sapiens
cgactttctaatttgtaaagtgaaataattagtctgactaagcatccctttcattctgtaagtttaagcaagctgtgtgtcttaacggtagtgacaggtattcacgagttgttttgcgatgaaaagtgaagtgactggcttctgtttaatggctagaaaaccaagtgggagaattaaacaactgttaatgagttaatctgcaggtttaacaagattttttactttaggagtcgtttgctggtactctttaagcttttt

SEQ ID NO: 134097 - DNA, 450 bp, Homo sapiens
  misc_feature (442)..(442): n is a, c, g, or t
gactccactgggggttaactgtgcagccacagcttgttgctctatttattataatccacataacactgcgtttcatgtttgtctctcccaccagcacctaaaatccctaaaggcctgtaacttatttctctatcctagtgcctatcacagtgcctggcacctagtaggaactgtggcatggatatttcaatgaagaaaatctctttgttttcctcccagagtgctggctcttgcttgcttacttggcttattatgggttttgtattttacagcatcgacagtataaaaagagcaagacatttctgaagcataattaaatggatgaatgcataaatagatagaatcctcctggccccttagacgctctctcggtggggacgctctctcggtgggtaaagcaagacttgagggaatcgtgagcaaatgggcacatccgtacggncccggggt

SEQ ID NO: 134098 - DNA, 263 bp, Homo sapiens
tcctttccctgggccatcaagacatacttcctgaaatcttaaagacataatctctactcttatttatttatttagagacagagtctcactcttgtcaccaaggctggagtccaatggcatgatctcagctcacaacaacctccgccttccgggttcaagcaattctcctgcctcagcctcccaagtagctgggcttacagcagccaccgccacgcttggctaagttttgtatttttagtagagatggggtttcaccatgttgg

SEQ ID NO: 134099 - DNA, 268 bp, Homo sapiens
gctacttctctcattttacaggtgaggaaaatgatactctgaggggttaagtaactgtacagtcatatagctatgtaggcagtgccaatattcaaagtcatgaatgtctgagacattaactcaagcttttaggctaaggtgggaggctcgcttgagcccagctgctcaagaccagcctgggcaacatggcgagaccccatttccacatgcatacatatatgcatacatacataactcaagcttttatcctgaggagaagatagtgaca

SEQ ID NO: 134100 - DNA, 901 bp, Homo sapiens
gcagagatttgtatgttactgaagttaaactggtataaatacaaattagaatgttacaactttaagatgttacatttaactgcaaagaaaatagcaatcaaatatatagctatttaacaaaaagaaatgagaaaggaatttaaacatgtcactacaaaaaatcaaccaaacaaaacaagacagtaatgcaggaaatgagagacaaaaaagctataagacatgtagtagaaaatagtagcaaaattacagaagtatcttacaaataattactttaaatgtaaatgtattgacccctctaatcaaaaaacagagattggtagactggattttaagaaaccatgatccaactatatggtatctacaagagactcactctagctgcaaagacacaaataggttgaaaatgaaaggatggaaagggtatttcacacaaatagtaaccaaaaaagagcaagagtggctaaactagtatcagacaaaatagactttaaatcaaaacatgcttacaagagacaaagaaggacattatatattaataaaaggttcaatacagcaagatataaaaattatacatatttatgtacctaataacagataatcgaaatatatgattgaaaggagaaaaagacagtctatgataatagttggagacttcaacatctcactctcagtaatggttagagcaaccagacagaagataagtaagaaaacagaggacttgaacgtacagtaaaccaactggatccaatgggcatacagaacattctacccaacaacagcaggatacacattcttctcaagtgcacttggggcattttccaggaccatctgttaggctgctaagtaagtcctaatagattttaaaaggtagatatacaaacatctgtctgaccacaagata

SEQ ID NO: 134101 - DNA, 395 bp, Homo sapiens
ctgcttcagctgctgggacagcagttggatgccagtcatcagccatcagttccttcaggtatgacccgagctgcgggagctgccttgcccaaggtcacgcacttgcagagactgaccacatccaaggactgatccaagaggaggcacaaacatctggcttgctctgcccaaggtggaatgattctgatgggccatttttaccttcagagctccccttgggatccgaagaggctttggttgggcctgcagtatggatgcacttctctctgtgcccactcctgcttccctcccttccattcctcaggggttaattctaagtaaatgtcatgcacactaaaatccatctcagagtctgtttcctgtggatcccaatctgaaaagacatttctaactag

SEQ ID NO: 134102 - DNA, 741 bp, Homo sapiens
ttgagccatggcaccaagaggaatgggtgtgtttatgaaatcaaatttagttcataagaatattccatcctttgattgtgctgaacatgggttggataaatcaagggtcaaatcatgtcctgtgcaaccttgtagttgcagtaaaagcttaatgtagcacaagtgtgagtcccttctcctaacagcagcttcataaagggaatctactatactcaccaaagcaaacaaaaaaacctccaagcttttaaaactcttctcttgagtttctatgctaaagctaaatgtgtttcttttacaaaaggaatctcctacggggaaatctgaagcaattgggtcacttctttgttttattccagtagttgttcttttttgccatttaaaaggcatgtcccagatttatcaattagaggtttgccttactatgtctcactgacatataaatgcacagaagtttcaagccaaacttgacatgactatgggaagagaagagaaatgcctgattttcaacttctatcttgagagcattgtgtattcttaaaatggtcctaatcacctctgtctcctatatgcaacattttattagctagtcctggattgaggactttaaaatgtttgatgtggcttgctctaaatagagagagtcatacctttcctaagctcctccagattcagttgattaaagcagcttgctttagtaattatatttcaaaataatctattttcacttatttttaacatata

SEQ ID NO: 134103 - DNA, 510 bp, Homo sapiens
atttggaaaaagcatattttcaggtatgattaagttaaggatcttgaggagagattatcctggattgtctccgtgggcattaaatcctggcacatatatccttataagagggagataaaggagatttaacttcagacagaagagaaggaggccctgtgaccaagaaggcagagcctggagtggtggagctgcaagccaatgaatgccagcagccatcagaagctgcgcaagtcaaaggatggattttcccctcagcctctgagagcactggctctgctgagacctagatttcagcccagtgatactgattttggacttctgatatccaaaactgtgagaaaataaatttctgttgttttaagtcaccacatttttggtaatttgctctaacagccacaggaaagtaacatacatgcctacctgggtccagttgtgtcctgtgactcctgctttcctgggacaggcaggctgctccgtgcctcctggccatcctactgggtgctggacgct

SEQ ID NO: 134104 - DNA, 2871 bp, Homo sapiens
tctttgagaaatgtgaactggctacatgctctccccgtgatggggccggagctgggctggggacaccccgcggcggcgacgtctgctcctctgattccttcaacgaggacaacactgccttcgccaagcaggttcgctctgagaggcccttcttctcctccaacccagaactggacaatctgatgatccaggcaatccaagtgctgcggttccacctgctagagctggagaagggaaagatgcccatcgacctggtcatcgaggatcgggatggcggctgcagggaggacttcgaggactacccagcctcctgccccagcctcccagaccagaataatatatggattcgagaccatgaggatagcgggtctgtacatttggggaccccaggtccatccagcggggggctggcctcccagagtggggacaactccagtgaccaaggagtcgggctggacaccagcgtggcctctcccagttctggtggagaagatgaggacttggaccaggagccacggcgaaacaagaagagggggatcttccccaaggtggccaccaacatcatgcgagcctggttgttccagcacctctcacacccgtacccctcggaggagcagaagaaacagctggcgcaggacacggggcttaccatcctgcaagtcaacaactggttcattaatgcccggagacgcatcgtgcaacctatgatcgatcaatccaaccgcacagggcagggtgcagccttcagcccagagggccagcccatcgggggctataccgagacagagccacacgtggccttccgggctccagcatcagtggggatgagtttgaaactcggaaggagaatggcattatctatagaggctgatgcgggagagacccagcctccggctgtgacccccagcctcacacctggctctggttcccgcctggtcctctggcttcaggatcccacctccaaaggcctctccgctcaacgcctacctccctagggccctgctgggacatgggggcctgagtgcccacccaaggggctctcaaggacaccggcaaggcctccaggctctgagccccgcttctgccttcacctctgcctgggacccgagctgggctcctgggccttggtccccagaagatggcagctagggcctcgccgcgaggacagagaagggacagggtggctgggcagtcagggaaggagggtcgcccggatccgacattttggagagattctttcaccctcctgtcccccccacctcccttctctaatttcttctttttttaatgataaagtcttaaaacacagaaaaaaaaaagacttcagagaattaggtagatgaagcactttatacagtatatatcttcagcttaaatttgttttgagtattttttttatttttaagtaggcaaagatttaaaattttttatttttagtaaatgtttgaagcaaactaaaaagacgtgggcaatatttaccaaaacaaaacagaacccaaaaaattgtacatcttgatcttagcaaatatccttattgtagagacacttaataaagagatggtattttaatatctgcagttctgaggtagggtgtaacttagttctacattgtgatttaggaatttttaaacctttcttcttcaggggagaagtgacccaggcctcgagtttagtgctaaagccactagtgtacttatgctgtcacctaaccaccacatgcgacatggaggcagaggctaaatataggggctttcttaagaaagtgagaggaaattagcaagcattattagtgtttgactactgctatcaagtgaattcaaaggaaacaggtttttatgccatatttaagttacagaaaccaggcatgcttagaatagtttctaaggtgacagagtgagactccatctcaaaaaaaaaaaaaaaaaaaaagaatagtttctagaggttattggagaatagaaagctaagaaaacttggtatacatttacaattgaaatataattacactttttactctcagaatattattcagattagacttcctgtttatcttttatattcttgcattgatataatgcctgatccttcaaagttctttcacatattatatgatcttctttatgaaaaaaagtagatgctttattctgatatattcagtttcccactttaggcaaaagtggattaatagaatgatgaattcaaagtagatgaggaaaatcaggcacagagaagtaaaggtaggtacagacccaaattcacacaagataatgacatcaccagcgtttaagttgatcatcaaaggctgggctggatttgtcttgctgtatgtgtcaggaaatttatacctattacattttccattttctcaaaataagtcacatgattgtaatgtttagctgcaacttttctcctaataaatagtgtcatgaagaatgttatagtgcgaagtttgtacatttcagggtcagttatacaatgtgaactctttatctacgggaatgagaatggaggatcattgaaggccatgatataaacaaatttgcatgttgaagcctgtataaaacatggtacagtgagtgaatgcccccatccccaagaacactttatacatattaaatggatatatgattactgtgcaaaaattcattctggaaatgaacatatatttgagcactaatatgtaatgtacatcttctgccctaaggagaaaataaatcataaaacttgttttacattcaaaattactttcccgagcatgtcttagagtaatctacgtgttgatgtatgtaaattgtattttaggtaggcaaagaaacaagtctggttatttatgtaaaaactagtctaataaagtgagtggctttatcactt

SEQ ID NO: 134105 - DNA, 2430 bp, Homo sapiens
tctttgagaaatgtgaactggctacatgctctccccgtgatggggccggagctgggctggggacaccccgcggcggcgacgtctgctcctctgattccttcaacgaggacaacactgccttcgccaagcaggttcgctctgagaggcccttcttctcctccaacccagaactggacaatctgatgatccaggcaatccaagtgctgcggttccacctgctagagctggagaagggaaagatgcccatcgacctggtcatcgaggatcgggatggcggctgcagggaggacttcgaggactacccagcctcctgccccagcctcccagaccagaataatatatggattcgagaccatgaggatagcgggtctgtacatttggggaccccaggtccatccagcggggggctggcctcccagagtggggacaactccagtgaccaaggagtcgggctggacaccagcgtggcctctcccagttctggtggagaagatgaggacttggaccaggagccacggcgaaacaagaagagggggatcttccccaaggtggccaccaacatcatgcgagcctggttgttccagcacctctcacacccgtacccctcggaggagcagaagaaacagctggcgcaggacacggggcttaccatcctgcaagtcaacaactggttcattaatgcccggagacgcatcgtgcaacctatgatcgatcaatccaaccgcacagggcagggtgcagccttcagcccagagggccagcccatcgggggctataccgagacagagccacacgtggccttccgggctccagcatcagtggggatgagtttgaaactcggaaggagaatggcattatctatagaggctgatgcgggagagacccagcctccggctgtgacccccagcctcacacctggctctggttcccgcctggtcctctggcttcaggatcccacctccaaaggcctctccgctcaacgcctacctccctagggccctgctgggacatgggggcctgagtgcccacccaaggggctctcaaggacaccggcaaggcctccaggctctgagccccgcttctgccttcacctctgcctgggacccgagctgggctcctgggccttggtccccagaagatggcagctagggcctcgccgcgaggacagagaagggacagggtggctgggcagtcagggaaggagggtcgcccggatccgacattttggagagattctttcaccctcctgtcccccccacctcccttctctaatttcttctttttttaatgataaagtcttaaaacacagaaaaaaaaaagacttcagagaattaggtagatgaagcactttatacagtatatatcttcagcttaaatttgttttgagtattttttttatttttaagtaggcaaagatttaaaattttttatttttagtaaatgtttgaagcaaactaaaaagacgtgggcaatatttaccaaaacaaaacagaacccaaaaaattgtacatcttgatcttagcaaatatccttattgtagagacacttaataaagagatggtattttaatatctgcagttctgaggtagggtgtaacttagttctacattgtgatttaggaatttttaaacctttcttcttcaggggagaagtgacccaggcctcgagtttagtgctaaagccactagtgtacttatgctgtcacctaaccaccacatgcgacatggaggcagaggctaaatataggggctttcttaagaaagtgagaggaaattagcaagcattattagtgtttgactactgctatcaagtgaattcaaaggaaacaggtttttatgccatatttaagttacagaaaccaggcatgcttagaatagtttctaaggtgacagagtgagactccatctcaaaaaaaaaaaaaaaaaaaaagaatagtttctagaggttattggagaatagaaagctaagaaaacttggtatacatttacaattgaaatataattacactttttactctcagaatattattcagattagacttcctgtttatcttttatattcttgcattgatataatgcctgatccttcaaagttctttcacatattatatgatcttctttatgaaaaaaagtagatgctttattctgatatattcagtttcccactttaggcaaaagtggattaatagaatgatgaattcaaagtagatgaggaaaatcaggcacagagaagtaaaggtaggtacagacccaaattcacacaagataatgacatcaccagcgtttaagttgatcatcaaaggctgggctggatttgtcttgctgtatgtgtcaggaaatttatacctattacattttccattttctcaaaataagtcacatgattgtaatgtttagctgcaacttttctcctaataaatagtgtcatgaa

SEQ ID NO: 134106 - DNA, 1159 bp, Homo sapiens
tctttgagaaatgtgaactggctacatgctctccccgtgatggggccggagctgggctggggacaccccgcggcggcgacgtctgctcctctgattccttcaacgaggacaacactgccttcgccaagcagtatggattcgagaccatgaggatagcgggtctgtacatttggggaccccaggtccatccagcggggggctggcctcccagagtggggacaactccagtgaccaaggagtcgggctggacaccagcgtggcctctcccagttctggtggagaagatgaggacttggaccaggagccacggcgaaacaagaagagggggatcttccccaaggtggccaccaacatcatgcgagcctggttgttccagcacctctcacacccgtacccctcggaggagcagaagaaacagctggcgcaggacacggggcttaccatcctgcaagtcaacaactggttcattaatgcccggagacgcatcgtgcaacctatgatcgatcaatccaaccgcacagggcagggtgcagccttcagcccagagggccagcccatcgggggctataccgagacagagccacacgtggccttccgggctccagcatcagtggggatgagtttgaaactcggaaggagaatggcattatctatagaggctgatgcgggagagacccagcctccggctgtgacccccagcctcacacctggctctggttcccgcctggtcctctggcttcaggatcccacctccaaaggcctctccgctcaacgcctacctccctagggccctgctgggacatgggggcctgagtgcccacccaaggggctctcaaggacaccggcaaggcctccaggctctgagccccgcttctgccttcacctctgcctgggacccgagctgggctcctgggccttggtccccagaagatggcagctagggcctcgccgcgaggacagagaagggacagggtggctgggcagtcagggaaggagggtcgcccggatccgacattttggagagattctttcaccctcctgtcccccccacctcccttctctaatttcttctttttttaatgataaagtcttaaaacacagaaaaaaaaaacttggtttgagaatccttttatctttaagagcgcaagattaaactgct

SEQ ID NO: 134107 - DNA, 2663 bp, Homo sapiens
tctttgagaaatgtgaactggctacatgctctccccgtgatggggccggagctgggctggggacaccccgcggcggcgacgtctgctcctctgattccttcaacgaggacaacactgccttcgccaagcagtatggattcgagaccatgaggatagcgggtctgtacatttggggaccccaggtccatccagcggggggctggcctcccagagtggggacaactccagtgaccaaggagtcgggctggacaccagcgtggcctctcccagttctggtggagaagatgaggacttggaccaggagccacggcgaaacaagaagagggggatcttccccaaggtggccaccaacatcatgcgagcctggttgttccagcacctctcacacccgtacccctcggaggagcagaagaaacagctggcgcaggacacggggcttaccatcctgcaagtcaacaactggttcattaatgcccggagacgcatcgtgcaacctatgatcgatcaatccaaccgcacagggcagggtgcagccttcagcccagagggccagcccatcgggggctataccgagacagagccacacgtggccttccgggctccagcatcagtggggatgagtttgaaactcggaaggagaatggcattatctatagaggctgatgcgggagagacccagcctccggctgtgacccccagcctcacacctggctctggttcccgcctggtcctctggcttcaggatcccacctccaaaggcctctccgctcaacgcctacctccctagggccctgctgggacatgggggcctgagtgcccacccaaggggctctcaaggacaccggcaaggcctccaggctctgagccccgcttctgccttcacctctgcctgggacccgagctgggctcctgggccttggtccccagaagatggcagctagggcctcgccgcgaggacagagaagggacagggtggctgggcagtcagggaaggagggtcgcccggatccgacattttggagagattctttcaccctcctgtcccccccacctcccttctctaatttcttctttttttaatgataaagtcttaaaacacagaaaaaaaaaagacttcagagaattaggtagatgaagcactttatacagtatatatcttcagcttaaatttgttttgagtattttttttatttttaagtaggcaaagatttaaaattttttatttttagtaaatgtttgaagcaaactaaaaagacgtgggcaatatttaccaaaacaaaacagaacccaaaaaattgtacatcttgatcttagcaaatatccttattgtagagacacttaataaagagatggtattttaatatctgcagttctgaggtagggtgtaacttagttctacattgtgatttaggaatttttaaacctttcttcttcaggggagaagtgacccaggcctcgagtttagtgctaaagccactagtgtacttatgctgtcacctaaccaccacatgcgacatggaggcagaggctaaatataggggctttcttaagaaagtgagaggaaattagcaagcattattagtgtttgactactgctatcaagtgaattcaaaggaaacaggtttttatgccatatttaagttacagaaaccaggcatgcttagaatagtttctaaggtgacagagtgagactccatctcaaaaaaaaaaaaaaaaaaaaagaatagtttctagaggttattggagaatagaaagctaagaaaacttggtatacatttacaattgaaatataattacactttttactctcagaatattattcagattagacttcctgtttatcttttatattcttgcattgatataatgcctgatccttcaaagttctttcacatattatatgatcttctttatgaaaaaaagtagatgctttattctgatatattcagtttcccactttaggcaaaagtggattaatagaatgatgaattcaaagtagatgaggaaaatcaggcacagagaagtaaaggtaggtacagacccaaattcacacaagataatgacatcaccagcgtttaagttgatcatcaaaggctgggctggatttgtcttgctgtatgtgtcaggaaatttatacctattacattttccattttctcaaaataagtcacatgattgtaatgtttagctgcaacttttctcctaataaatagtgtcatgaagaatgttatagtgcgaagtttgtacatttcagggtcagttatacaatgtgaactctttatctacgggaatgagaatggaggatcattgaaggccatgatataaacaaatttgcatgttgaagcctgtataaaacatggtacagtgagtgaatgcccccatccccaagaacactttatacatattaaatggatatatgattactgtgcaaaaattcattctggaaatgaacatatatttgagcactaatatgtaatgtacatcttctgccctaaggagaaaataaatcataaaacttgttttacattcaaaattactttcccgagcatgtcttagagtaatctacgtgttgatgtatgtaaattgtattttaggtaggcaaagaaacaagtctggttatttatgtaaaaactagtctaataaagtgagtggctttatcactt

SEQ ID NO: 134108 - DNA, 100 bp, Homo sapiens
tatcattcttctgctcagggaaattttattctattatttaattttatagctcatctttaccttcacaacttttatcttcatgataatcttttcaactaat

SEQ ID NO: 134109 - DNA, 348 bp, Homo sapiens
atcactgtgtcgacggctcagtattgagaacactgttatcaagctgaaatgttaaagtaataagaaaatattgtaaaacttcaagcgataggccaggcacagtcgctcatgcctgtaatcccagcacgtttggaggccgaggcaggcggatcacttgaggtcaggagttcgagaccagcctggccaacacggagaaactccatctctactaaaaatacaaaattagccaggcatagtggtgcatgcctataatcccaactactcgggaggctgaggcaggagaatcacttgaacccgggaggcagaggttgcggtgagccaagatcatgccaaactctgcctcagaaa

SEQ ID NO: 134110 - DNA, 388 bp, Homo sapiens
ctggtcctccctgctgccccagctccactccctggaggggatcacagcagtttctttttgacatttatttccagatttctaaatgacacatttctgctgctatttctagtcgtttccatttaggatgttacttccctactttctctgggacacatcagctcatctcttccttccttgttccatcctcctgatggagttatgtcactgtttattgtttttaatcattgagtgtttacctaattgcgggtgacgtgaatatgcatgagctaccatgattgcattcccttgttggcacaacttttgggtttccttggagttaatacattgtgattgtttaaatcagtttcctagatgtcttgtctcaaatttactccagtttcctcttccc

SEQ ID NO: 134111 - DNA, 1016 bp, Homo sapiens
acaggccgacagatagaggaccgtgtggccctgctcctctctgaggaagtggaattgtctagcacgccaccacttcctgccagcaggattttaaaggaagggtgggaaagagcgggccagtgtcctcctccacctgaacgcaagcagagctttctgtgggagggcagcgcactgactggggcctgggccatggaggacttctacacggccaggctggtccctcctctcgtgccccagcggcctgcccagggccttatgcaggagcccgtgccgcctctggtgccacctgagcactcagagctgagcgagcgaaggtcacccgctctccacggcacccccactgcaggctgtggctccaggggcccgtcgccttcggccagccagagggagcaccaggccctgcaggacctcgtggacctggcgagggagggactgagcgccagcccgtggcccggcagtgggggcctggctggctcggaagggactgcagggttggacgtggtgcccggcggccttcctctgactgggtttgtggtgccatcgcaggacaagcacccggacaggggcggccgcaccttggtaagaactggctctggcccgcgctctctggtcccggccatcccacttgccatgtgtgtggtggggttggctcaccgctggcctctggcccccaacgcaagtgcagtggcctctcaaggcctctgctttccagaaggctgccacatcctgacatccgtgagcagagccacggacccacagccacctcagcgcccctctgggggctctgccacgagacttctgccttttctgtctgtgactccatggggcaccttggggttgaggccccagagcctgccctgtcctgggtcccaggagtgtagagggaccacagtttctcagcgcggttgccccatccaggcacgctctgctcgttcctcagtagttgggagctcaccaagggcttgctctccctcccctctgtgcgggtcctgggctccagagcacagctgagcagc

SEQ ID NO: 134112 - DNA, 722 bp, Homo sapiens
  misc_feature (454)..(454): n is a, c, g, or t
  misc_feature (576)..(576): n is a, c, g, or t
gatcttcggtggtggagacggggtttcaccatgttggccgggctggtctgggactcctggcctcaggcagtccacttgcctcagcctcccaaagtgctgggattataggcctaagccaccgtaaccagccagaattttttttttttttaaagcaccagaacatgggggaaagattgtgtctttaacaaatggtgctgagaaaactgtataaccacatacaaaagaatgaagttggacccttaccttacaccatatacaaaaacacaaaacttattaaagattaaacataagacctgaaaaaaaaaaaaaaaaactctcgaactagtttcctcttcttcttcttctcagatgtgccgaagggaaaaagggccaggggaaaagaagggtggctccgggccccagctgtgtcgtgaaaaagcagggggctaaaaaggtgggtgaacccccgtgtttngggaaaagggcctaagattttgggcttgggacgggacttccagcccaaaagagacctcacccgttttgtgaaagggccccgttatatcaggttgcaggggagagagccatcctcttataagngggctgaaagtgcctcctgggattaccagttcccccaggcctgtggaacggccacaaggtactcagctgtttaggtggcccacaagttcgaccagaagacagcagagaaaagcggactgttggccgggcgaaaaaaggtgttgcag

SEQ ID NO: 134113 - DNA, 313 bp, Homo sapiens
caaatggtgctgagaaaactgtataaccacatacaaaagaatgaagttggacccttaccttacaccatatacaaaaacacaaaacttattaaagattaaacataagacctgaaactatagtgctcctagaagaaaacatggggaaaagcttcatgacaatggatttggcaatgatttcttggatatgacagcaaaacacaggcaacaagacaaaagatagacaaatgggtttgcaacaaacttaaggatagctatacagcaaaagaaatgaccaacagtgaaaaggcaacctacagaatggggaaaaaaaaag

SEQ ID NO: 134114 - DNA, 631 bp, Homo sapiens
  misc_feature (525)..(526): n is a, c, g, or t
  misc_feature (528)..(528): n is a, c, g, or t
cattatactgaacaagccgaacccgtgggatgtaactataaaaaacaattttttgtccacgactagcctttaaagttactctgtagccatagttaatgttcctgaactttcatttaggctaatgatcatgactttggtcactcccaagttataaaaacaatctgacttttaaaactgaaagatccagctgggcatagtggctcccacctgtaatcccaacaatctgggaggctgagacagaggatcacttaatcccaggagctggagaccagcctgggcaacatagggagaacccgtctctacaaaaaaatttaaaaaaataaaaaaacttagccagatgtggtggtggcggggagggtgttacttacctcacatcagtgctaataagaggtcagtgtcaataaggggtagatctgtttccagaacagatctgcctaatcccaaagttgatgccactttattcacaacaaaatgcctccatgagcacattcttcgaaaaatcattctcattcatttttttattannancacaattgtaaccattatactgaacaagccgaacccgtgggatgtaactataaaaaacaattttttgtccacgactagcctttaaagatactctgtagccata

SEQ ID NO: 134115 - DNA, 373 bp, Homo sapiens
actcagtcatggaacctgggtcctgcctccagctctggcactaatatgtcatgcaaatttcacagctttgcaagagcttttgttaaatcaagggttgaatgatcccttagagctttcccaactctatgattatcaagtatgtttttcagctaacgaaaaacagaaaaaaaaaatgtgagaactagaagagctggggtctttcattagattttctagaaataagaggttcttgtaagaaactaagactaataataggatacttacaagatcacagggcattttgaaaagcaatttaaacttaaactgcaggtgatggagaagaaattgtaaaatacaaactgaattttaaaaaatcctaacaattaataaactt

SEQ ID NO: 134116 - DNA, 314 bp, Homo sapiens
cagacttggattgcctcataggaataaggagtccttggacagcatagtatatgcttttacccaacaatccagtacaatatcatgattaacctatttaaattatacattccctcagttactctactggcttgcctaatgtttcacagtgtctaatggaaattctacatatactaacaatgggaccgtataggctaatttaaatgtcacatctttggttactggttgaagatattatttattataacaacatcaaataatgtttggtggtagaatctttcatggggtctgtgggggaaaagtcaggaagagagaca

SEQ ID NO: 134117 - DNA, 507 bp, Homo sapiens
tgactctagacgatcccgttatacttgctctaatgtgcacgccatggagctgttatggctcgatcttggatagctcaagctgtcctcccacctcagcctcctgagtagctgggactacaggtgtacaccaccatgctcggctaatttttatattttttctttgtagaaatggggttttgccatgttacccaggctggtctccaacttctgagttcaagtaatctacctgccttggcttcccaaagtgctgggattacaggtttgagccactgcgcctggcctatactagcttttgaattcctggaaaaaatataaaatgacagtatcaatttatctgactttttctcttttttatattaagccctccatcaagtagaaattgagctctttcatgcagggtatgatgcttcatgcttgtaattccacctctttgggaggcctaggcgaggggatcaattgaggcctggagttcaaggctgcagtgaggtgtgatcccatcattgcagt

SEQ ID NO: 134118 - DNA, 188 bp, Homo sapiens
tccacttctttgattattgtttatatttgggaaagctggaggagcatggttttgagccttttcctgaatccaagtttttctagcatgcgatcgttctgtagacaaggcgctgtgtctcggagtccgcggcgaccgtgcccgctgggagcgtctcccaagtccagcaaaatgtgcaactggttttatgg

SEQ ID NO: 134119 - DNA, 680 bp, Homo sapiens
gagataggagtccaacttcatcattttgcatgtaggtattcagacgtcctagcactatttgttaaagagactattctttacctatttaatggtcttggcattcttattgaaaatcagttaaccatacgtatatgggtttagtttggggcccacgattctatttcactggtctatatgtctgaccttatgtcagtaccacactgttttgaatactgtagtaaattttgaaattggaaaatatgagtccttccacattgttcttcttttttagtattgttttggctcttcaggaccttttgcaattccatataaatttgaggatcagcttttcagtatctgcaaaaatgcaattagaactttgacagaagggctgggcatggtggcttaggcctgtaattccagtgctttgggaggctaaaatgggaggatcacttgagcccaggagttggagaccagcctgggcaacatagcgagacccccatctctataaaacattaaaaaattagcagggtatggtggtgcacacctgtagtcccagctacatgggaggctgcattgggaggatcacatgagtccaggagttggaggctatggtgaactatgattgaaccactgctagattgcactccagcctgggtgataaagcgagaccccactccccacctgccgccaaaaaaaaa

SEQ ID NO: 134120 - DNA, 278 bp, Homo sapiens
cattagtcctatctctttaggggccatttcagatttttcttgacagtcttattttattcactctggttcagtgttgccaacccaacaattctcagccaagcctccaaaggaaatacaatctgcttgctgcgtcagatcacttggaaacagatacgattggcttggagtcactccatgcggggctgtaaaattgttctctccttctaagtgggttgggttaagcccaagctgaggcaagagatttccaaggaatacagagcagaggactgtagtaagtg

SEQ ID NO: 134121 - DNA, 235 bp, Homo sapiens
gatgaggctgtctcaggcacaccaggatgtgtggtcacttaaattacacaacttcttaactctgacagaatggtgcctgcccttgtggagtctacagtccactggatgggagacaagaaagtggcaatgctaatgcagcatgccaagtgtcaggacatgggggttttaagggaccatgagaagttgggagcacagagaagggcccctgatttggtctctgggggtcagggagggc

SEQ ID NO: 134122 - DNA, 295 bp, Homo sapiens
gcagtgagctgagatggcaccactgcagtccggcctgggcgaaagagtgagactccatctcaaaaattaattaattaattaattaattaaaaaataaaacaacactgtgatgttaaggccctattttccaggatttatcatgattggttttattgagtaaagcctgggcaaaagacttaggtgtcaatttcgaaagactcatttaagtatctttttagaagtaacattatgtattattattgttgttattattattaaagttctgtgccaatcattattctaaatgtttgacatt

SEQ ID NO: 134123 - DNA, 784 bp, Homo sapiens
gggctctgaggactgccagcacgctgtcacctctcaagaagaatccaggtggggctatcaaacaacagaagcagtgattctggaataaaagcattttttttgtctaagatgaaaagttactacagggaactctcttgatctattgttttatactgttaaagaaagtacattaatgaaatgtgtcagggtaagatggcagtctcagcacatcaaatgatgcaggcaagaatatagcaaagtaatatctatcagcaggtcaataacttagaaaagcttgaaatgattgagaaatgtgcatggaagaaggtagtattctatagctattcaaggcaatgtatcaaagaagtgtaaaaatatacattagaatgggtcagttattcttagatcagaaggaatgggataaagaaatgatctgagaacagaatataggaattatgtggcttggaagtagagagagaaaagacatgaacatttatcaatgacaaaatgatcacaatacctttgaggtactggatttgagggaaaagattcttccaaataagtgatcactctgattaggactgaacaaaatgactgatttcactgctcagtcctcagactgccaacctttctacacccctgctctgagcgtgtgtgtgtgtgtgtgtgtgtgtgtgtgtgtgtgtgtgtgtgtgtggagataaaagaagagggtgtgggaatataagggggggggggagagaaaaagtggggggtgaaataaagagagggagaggaataataggggggggagggaacaaaaagt

SEQ ID NO: 134124 - DNA, 218 bp, Homo sapiens
aacaaacccaaaaaacagccagagaaggcaagagccctggaatggcctaaggtgggaaactgctgccctctcagccgcggggtccagtgtgtgatagtgaaatctctcgttatcttaaattctctcttcagggacttaaacagaaattaacagggctgggtgcagtggctcatgcctgtagtcccagcactttgagaggctgagagggggaggattgc

SEQ ID NO: 134125 - DNA, 367 bp, Homo sapiens
ttttgatatgaagtctcactctgtcgctcgggctggagtgtagtggtgcaatctcggctcactgcaacctccacctcccgggttcaggtgattctcctgcctcagcttcccaagtagctgagactacaggtgtgtgccaccaagtgggctaatttttgtatttttagtagagacaggaatttcaccacgttggccaggctggtctccaactcctgacctcaagtgatccacccgctttggcctcccagagtgctgggattacaggcgtgagccactacaaacctaatttaagttgtgtgcctcctatggagaagcctgaaactgccttctttgatttaggcctgatttcttcatgaatggattagga

SEQ ID NO: 134126 - DNA, 255 bp, Homo sapiens
tacaggtgtgagccaccgcgcccggccacttctgtctagttttaaaacattttcatccaaatggaaaccctatgcccattaagcagttgttccccatttcctcatctccccagtccctggcaaccactagtgtactttctgcgtctgtggatttatccattctagatatttcgtataaattgactcaagcactgtgtgtcctttagtgtctgagttcttccacttgccatagtttttgaggttcattcaggtagt

SEQ ID NO: 134127 - DNA, 405 bp, Homo sapiens
tgagctgtaatcgcatcactgcactccagcctgggtgataaagtgagatcttgtctcgaaaagaaaaagttatatgtacactatgctatagtctgttaaatgtgcagtagcgttgtgtcttaaaaaatgtgcatactttaaaaatgctttatttaaaaaaaattctcctgatcatcttgagccttcagggagtcatgatctttttgctggtggagggtcctgcctctatcttgatggctgctgactgagcagagtggtggttgctgaaggttcgggtagctgtagcaatttcttaaaataagacagtaataaagttgccacatcaatggactcttcctttcacaaaagatttttctgaagcatgggatgctgtttgataagcattttacccacagtagaacttct

SEQ ID NO: 134128 - DNA, 772 bp, Homo sapiens
ctcctgggttcaagtgattctcctacctcagcctcctgggtagccgggactacaggcgagtgccaccacacctggctaatttttgaagttttagtagagacgggatttcaccattttggccaggctggtttcaaactcctgacctcaggtgatccacctgcctcggcctcccaaagtgctgtgattacaggtgtgagctactgttcccagacatatgccatgatttctgtcacttctgggtatgcagctattgactgatttttttcctgattatgggtcacattttcctgcttctttatgtgtctagtaatttctgattgaatgccagacattattagtccatattgtgaagtgtttggattttattgcctccttaaaagaggggaaggaatttgaattatttgcaaattagtttgatcctttatgagcttcttttaagacttatatggcagattgaaagtatcatagctctcttttatctgcagggaatatgttccaagacccccagggggtgcctgaaaccatggacagtaccaaattttatatacactatgtatttttgcctatgataaaattcaatttataaattaggcatggaaagagattaacacctgataataaaattgaacaattataacaatatactttaagaaaagttatgtgaatgtggtctctctctctttctctcaaaatatcttatactatattcaccttttttgtgatgatatgagatgatacaatgcctatgtgatgagacgaaggaggtgaatga

SEQ ID NO: 134129 - DNA, 205 bp, Homo sapiens
tgagaagcagcttttcagctgtgacaggcaaggcccagcaggggaagtagctcactgtctggtttgatttaagatcactgccaaaaaattttcttcattaacttcacagttatctaagctctatgaaggcaggggtttttgtgttttgcttataggagtatgctcagggcctagaacagtgcctgggttatagtaggagctcaaa

SEQ ID NO: 134130 - DNA, 274 bp, Homo sapiens
tgaaatattctatcccagcagaaaatcttccagtgagtcaaatatctgctagtgagttgacaaaaaaaatctagagctctttccgtcagcacttggaaatattcttattgttactgttggatgacccctggtttgtagacaccgcctatagggcaatggttgggttcagaattacagagtgagaggcataagcatcaaagcacagagaaacatattaataaaagcctctgagaaataaaaatgagatcccaaatccaccaactgactgaacaga

SEQ ID NO: 134131 - DNA, 327 bp, Homo sapiens
ataagataaagtgtgtgcattaactagctgacagcagccactcagccaattatgggattcatgtctatcctcagtatcattcacaaatgtcagttcctagatgaagccacaccaccctaatcgcacacacccacatcctcctctgtatgaactggtttacaaagcgtgcttgcaatgggggctggatggaacattgttgggcaaaatgaagttgtagacaacatgctgccctcatctgcccacccacccccaccccacagctcagggacaagccagatgcctcccccagagaaggcaggtgcttccgaacctgcacatcctgctagc

SEQ ID NO: 134132 - DNA, 201 bp, Homo sapiens
cacgaaacttacatcctagtgagaaaggtggacaaataccaacaaacatagtaagtaaattatacaatatattaagtgacaaaaagctatggggaagaagtaaacttaagtagggtaaggcaatggggagtgtgtgtgatggaggggcaagctgtgatgttaaattagggtcaggaaatccttactgaacaggagattcga

SEQ ID NO: 134133 - DNA, 409 bp, Homo sapiens
cctgtttcttgttttcttccaggaagtcacattgcctgtgtcctcccagaacctaagagacaagagctggctggcctcaggggccagcagccaggctctcctgtggctgtgggacccccaggctttggagcaagcctgctctgagttctttcctgcaagggttcgggatcctcatctcactttacattgtcaagggcccaaccctcggagcctctcttcctccccgtctggtccctgcttctccactgtggggtttgcttcggctgtcccatctccatgctctcagccctctcctcctgtctctgactttggaacaccacctcaccttggctttcagctgtgtgactgccctcaccccaattctctcttgtcatgaatcaggaagccccaaaccttcggcagagcaatg

SEQ ID NO: 134134 - DNA, 343 bp, Homo sapiens
cgggtgcggtcccacccaggccacctgaattcagaatggcctggccagtatgtcagggctccttatcacaagcaacagaaaccctttctgcctgcccccaaaactcatatagggcgtgggcttctccagaggcagatgccggtcaagagacaggacagacatctatgagcatggggaggagtggactcccagcccggatccaggagaagcgctgttgggacaataggcagccagcacctgagtcagaggtgaaggtagcctctagcagcagttgtcaccaccccgcccgtgcctgtcccacccttcagtttgttccagcaaacttccacctgtgtgtacctgc

SEQ ID NO: 134135 - DNA, 707 bp, Homo sapiens
gtttagatacgttcacagagccccttcaatattagagcacagtgaataagagcagaatgaagctctcagaaaaataagaattgcattggaatcccacctccaccactcactgtctgtgtaacactgagcctcaaactttagtttctatgtctagcaaccggagactgcagtagtgcctacttatagttagaatcgtgagatcatgcactaagcacagagcttagggtcagtaagtgggctccttctttttctccctttttcttcttcttccatcgactgtctaaatcgcatcaaactcattattttggtcatatataatagatcctttatgtttttgatgatttgatttcagattctctttcttgacagaggttgatctggcctacgtatggtatgccaggaaggatcaatagggctacagaattttaggcaaggagaagataacttcttgtgctctcttatggtcaatttctctgttaaaatgtgaaattctgccattcctttaaggaaggtggtaatatcatgttgctttgattttaatgagatttgttcagaaggtagaaccctttgagggctccttcatgaaacaccaacctcagctgttttacattctgcaggtgttatgtaaatgccaaatattaatgttttactatctagtaaaagagatgaaataagatttttgttgctgcttgtttcataggctgcaa

SEQ ID NO: 134136 - DNA, 437 bp, Homo sapiens
gtgcaaaggtcctgtggggtggtggggaagtggggagtgggagcccgagtcgtgctagagtggagtgagaaaaggcagaggaaggtatgaggccagaggtaactgatcatgtgtggcttggcaggttatatgatcatgtgtggcttggcaggttagaggagttttctagggctgccgtaatgaaatatcacagagtgggtggcttaaataatagaaatttattttctcagttctggaggctggaagtccaagatcaaggtgcctgcaggactcgtttcctccgaggcctctctcctcagctcacagatgtgcatatgcagccctggtgtctctgtatgtcctaatctcctcttcttaaaagcacaatagtcagattaggttaagacccaccctggcagcctcattttaactcaattaccctccccccactccccact

SEQ ID NO: 134137 - DNA, 633 bp, Homo sapiens
agggtcaaaagtaatagtcctaccatctgtttgtgtggactgcagaattccctccacagcctgttcagcagagggactgctcctgagcccggagccacagcatcaccatattacaacacaggctgcagttctggaggttcagacttgcccaggcacagattatgacccttgaaatatcataacctcctacagaaacagcccgacattatgtgattggcttatactttaaagccttatactaataagttccattgtactcgtgaggaagaaatttgctggaagatagggaagattggagaatggctgaacttagaaagaacaacacttaaatagtgagttagaacatttagtacagggccaggcacggtggctcgcacctgtaatcccagcactgtgggaggtcgaggcaggcagatcacttgaggtcaggagttcgagaccagcctggccaacatggtgaaaccccgtctctactaaaaatacaaacattagccgggcatgatgttacacacctgtaatcccagctactcaggaggctgagggatgagaatcgcttgaacccaggcaggggaggttgcagtgagtggagatcgcgccactgtactctagcttgggcaacagagcaagactgtc

SEQ ID NO: 134138 - DNA, 574 bp, Homo sapiens
gatcctgaaatgaaaccaattttatcctcactttcagagtactttagtgtagtagaggacgtatgcataaaaatgtactatggaaattcacaaaattaacggattctcaaagcagctattgaagattccacaactccagttagtccttgctggtcattaaaagggacaccagaaaaacaaataactaataaaaaatacgagttaaatggctataatgcccacctgtttggaaaaaaaaaaaaaaaaacaaaaaaaaaaaaactttttggggcgctggcggccccgaaaaagtttttaaaaaaacaccttcgtggtgggcggcacgcgaggggcccccaataaagtgacaaagcaaaccgagggcccatacgggttccccagaggaaaaactcgcggcgcacaaggaacaacatgccgggggattctcccaaaattaaaaaaaagcccggggggagaaccagacggttttctgaaacaaaatcccaaggggagacgaggagggccacaaaacggggaaccataacaaaaggggatccaaagcagaaacctgaatataaaattaagccccatcgtg

SEQ ID NO: 134139 - DNA, 766 bp, Homo sapiens
ctctatttgtcaaggtttgtttgtttgttttacattactgactccattttgattctgacaacttttacaatatgatacagcaagctttttcagatattcccagttttacatgtatatgtgtgtgtaggactgtgcagttctatcacatatgtttgtgtatccactgctatagtcaagctacaagacagttccaacagcataaggatcccttgtgttgtttgtcctcttataaccactcgctacccctaacctcctgtcctggtctctaatcctcggtaaacactagtctctagctttataaatttgtcatttcaagaatattagataaatagaatcatccagtcttttttttgtttttttgctgaatagaatttattgtgagggaaggaaaaaaattttcatccaccctcttaggttcagtgactggggcttggaaattaaataacaaaagacagattaacagtagtaaaaggtttatttcctatgcataatgagcaagtacctggctcattaaatagttaaagggttttgtttatatacctaccttaggtatataaaggaagggggagaaagggcctctataggaaaaacaaataggtctctttgggaaagacaaacaggtagtaagaaattgtgtaatgatatttgcctattcatcttcagggccaaaaactccccaggagggggaatttctaatagcctcatttcccagaggttgctgctttagtcagttaagggaagctcctagaaggcttttcctccactt

SEQ ID NO: 134140 - DNA, 460 bp, Homo sapiens
acaaaaagtctctgtgtctgctacctaattctatcacactgatctcttctgcaggcatagtcattggttcttccctttattcttatggcaggcaacactttgatgttactcattcattcccccatatatatatccattcatcaaactcttttcaagttaggtcctggggatactgtggtaaactggacagacatgtttcatattctcagagcacatacagtctagagggattttgtacactggagacttaaagcagacttggcttagacaaggagtcagaagaagcttccaggcagaaatgattttaagttaagatctgtggtggtgagaaagttctcttctggttcactatggagggtagaggggagggaaagatgatggtgtcatggtgcaagatgaagctggagaagaaaccatggccagaacacatgtatatattattgcaccttagattttctcc

SEQ ID NO: 134141 - DNA, 219 bp, Homo sapiens
gcctccagaaccctgaggcctccacagcacaatgcttccttcctagtggtgggaggggcaagatacaataattggtcctttaaagaggatgtcctggcatgccccactgcaagggtcccctcaaatatcacagatgtggcaggtccctgaatctctacagggtgagtttctcaccctctgcagtgtgtgtgcctcaccaatgccttgccacttcttggc

SEQ ID NO: 134142 - DNA, 241 bp, Homo sapiens
ggatcagagatctctggggagaagccaggtgattgtaacctatagtctaggttgaaaaccactggtattacatgatgtctgagttctttgctgccgctacaattcactagacatatagggtttggggttcatttttgtttttgtctctgggggatgaaaatgttctaaaattagattgtggcaatggttgtagaatcctatgattaaactaagaaaccactgaattgtacattttaaatga

SEQ ID NO: 134143 - DNA, 217 bp, Homo sapiens
gcataccaagatgaacagttgcacatatacacaccactcctgtagcaatacagcaataatttaaatgacagataataagagcctgaattaagtcataattagaggaggcagaggagatagaatatcaagataattaggaagtagaatctaaagggtttggctactgattagctgtgggagtgggaaggtggaggagtcaaagatatctcagatttcc

SEQ ID NO: 134144 - DNA, 607 bp, Homo sapiens
catggtggcgcgcgcctgtagtcacagctactcgggaggctgaggcaggagaatcacttgaacccaggaggcagaggttgcagtgagctgagatcatgccactgcattccagcttgggcgacagagagagactccgtctcaaaaaaaagtaaaataaaataaaataaaatactgtgcatccaagcagtggaagaccagctgtgaaatgacatacagccttaaaaaaaattctgtctatatatctccacttgtaggtagagaaatgcaaacatgtccatgtgttcatatgttcacagcggcattattcataatagacaaaaactggatgcagcccaagagtccattaactggcaaatggataaagtgtggtatatctatacagtacaatggaacattattctgcaataaatgaatactacaatgatgaaccatgaaagcatcatgctaagtgaaagaagctagacagaaaaacaacagtgtatgtccagataaaacgtccagaacggtgttaaaagaaaaacactggtgcttgctatggcagcacatatactaaaattggaaccatacagagaagattagcatggcccctgcaaagagataaaaaaaa

SEQ ID NO: 134145 - DNA, 492 bp, Homo sapiens
caacaaaagccacatttaaagttttgttttgggagtctcgctctgtcgccaggctggtgtgcatccaagcagtggaagaccagctgtgaaatgacatacagccttaaaaaaaattctgtctatatatctccacttgtaggtagagaaatgcaaacatgtccatgtgttcatatgttcacagcggcattattcataatagacaaaaactggatgcagcccaagagtccattaactggcaaatggataaagtgtggtatatctatacagtacaatggaacattattctgcaataaatgaatactacaatgatgaaccatgaaagcatcatgctaagtgaaagaagctagacagaaaaacaacagtgtatgtccagataaaacgtccagaacggtgttaaaagaaaaacactggtgcttgctatggcagcacatatactaaaattggaaccatacagagaagattagcatggcccctgcaaagagataaaaaaaa

SEQ ID NO: 134146 - DNA, 243 bp, Homo sapiens
tcacccagattccttcagctacttcatccgtgtatattggatatactttcctgcctgtttcaaattttccacactaaaaggcaagcaggcaggagggggcaggggtgtgggtttctaaggacagacaaataggagagctgaagcccagctgcctgatcttcaggcaaaatacagttaattgttcaacgagtttatgaaaggatgctgggttctcattttgaattcctttcttccttcagtaat

SEQ ID NO: 134147 - DNA, 194 bp, Homo sapiens
ttgagcactaaaaaactgtattgcacgaaaacccatccctaaagtctccaaaacagccacattgttagaaaagtatccaatgcataataatttcattgaatatttgccaaataacatttttagatggacaaacatatctattctattaagtcaatacaaaataaatagcatcaaacaaagaactgatagtgatt

SEQ ID NO: 134148 - DNA, 346 bp, Homo sapiens
tgcggctaacaccccgtctgtgtatctcacaccagccaagggctttgttttcctcctgtcactttgttcatatttctttcatatgtcacattgacagcatgaacaaagatgagaacaccacaattggctcccggtcaaccatgttagatggcaacttgccttcaatatggtgaaacacatcagttaagactagggttgtgagtggcagcgttttctgcagggacacttgatcttttagtaaatatggggtgctctctttcaaagaagctgtctttcctggcaccccatagtaagacacggagcaactacattgcaatccattggtcagtggtgaagtaaggacgga

SEQ ID NO: 134149 - DNA, 573 bp, Homo sapiens
atatatacgtggcgtaaaatgtacatgaaataacaagtcactactcaaaaagtacattttttttctcctcagagccttattagcaattggcaatcttaaaatttcatctcctaagcagggtccttatcagatattccttgacccccctatgttaagtgtcttagccactcattgttaagccaactgctaaaatcttagaaaaatatttcagccttctcctaccccatcccccacccccacaagcttctagcttcttctacctacagcaaatgttaaaactggtcagaagttatattatttactctgagaataatagtcttttgcagttgatgcatatcttgtcacccaaccacagtaattataggtttgatgtgaactgcacactaattatttttattattccagaggtttcataagcaacaatcctcccttgctcccaaatactctcacactctgaggaagggctaacatctaaaaatatcatcttaagtatatccctgaagataaaataaatgctagcatatgcatttaatgtttgctcctcctgcccccatctttcaaccattcgcacca

SEQ ID NO: 134150 - DNA, 435 bp, Homo sapiens
atcatcccagggcctgcatcgtgcctgggagggacgtgctgccaagattcagaggccacctaaagctactggcctcacaaccccatggccttataaccccagggcctgcatcatgcttggcagggactgctgcccagatccaaggcttgcaaacctgtctctttaacattcagatgagctctgcctgagtctcctctgctctgtagagtaccagcaattaagagttaacttgctgagtagcagcaattaagaattaactctgggattctttgaaaacaggacaatgccatgtgcaaatctctttattctcctggatgaatgattaacgatagcaggagggaagacagcagagacattcttgccagaaatagatccacactcacccagccttccacagttccaagaaccaatcacatttcctaaaacaatattttc

SEQ ID NO: 134151 - DNA, 147 bp, Homo sapiens
attttaattatgttactaaactcaagtttattttcttctcaataccagtcacataacaagtgtctccaacaagcctggttacccttaaattagtaaatacaacccgaaaaataacattttatgtttacacaatttaatatacaattt

SEQ ID NO: 134152 - DNA, 794 bp, Homo sapiens
aagtcccagattgaggaaaaaaggaacatagtctctacctcttcctgagaggaaagtcagtcaacgtgtaagaggagcagtagaaacgcattagtccagccaacgtgaaagtggaccgtagatctaaaacattttgggtatgcagttcagccagcccttactgaggcagttctgccaatcaggattcaagttttatttcctaagagttataataggttttatttgtgggcattgatacaaaatacgctgtgttcaagctatggagcctgccactgtagttactagagttacggttcaaagctatttctgagagaaagccacttcatcctcaaaacccaagaggcccacttaaagtgatgcgaattctcatttcaggtttttaaattatactaaaagattctagtaagaaaattttaatatgtatgtattggtgttctttttacatttcatttaatgaaatgtctactgtcaatacgataaagcagaacccagtggagtaagaatacacgaaactgccaggcacagtgggtcatgcctgtaaacccagcattctgggaggccgaggcgggtggatcacctgaggtcgggagttcaagaccagcctgaccaacatggagaaaccctgtctctactaaaaatacaaaattagctgcggtggtggtgcgtgcctgtaatcccagctactcaggaggctgaggcaggagaatcgcttgaacccgggaggcggaggttgtggtgagccaagattgcgccattgcactccagcctgggcaacaacagcgaaactctgtctc

SEQ ID NO: 134153 - DNA, 312 bp, Homo sapiens
aaaatataattttatattatattgtaatttatatagttgccattttgggttcaacatggctgaatattgttcaattcgtatgattcgacccaacagactcagagttttacaattctcatttaaacacttggctaacacggatgtattctataaaaaggaaaataatctccttttgtatggataaataaatgaagggtccaatggcatttcagtgatgaaagatccattactgctgttcctcagtccctgaaacatagagcaccctcactgggtaatctgggatacagggggaatggaatgaccactttgtta

SEQ ID NO: 134154 - DNA, 545 bp, Homo sapiens
cgggtctctggaacagtcaagcctgttcttctgaacctgattttctggccctccgagattctattaaatatctaatattttttaaataaatttctttttttcttaaagtagctagaatttttaaaaagaagcctgactgaaaaacagtatataaaaagacacgcgaagagcaagaaaactttgataaaagagaagaagaaagaaaggcagagaattactcttaatcagaagactaggaacaattgaatgtttatactagatacggattaaacaaaggtttattaagctcttagtacataacatacatcgtgtgggcactttctcattcatttccttatttcatgctgtctacaattttatgagaaaggtagacttattatttttaaaaacaagagatttaagaccctaaaaagttgttgtgttgaacgaactaggaatcaaatccaggtttctactttcagtctcatggtctctgtgctacaccagaatgcccttcactacagtctcagctaagtacaatactgaaaattttgctgaatattaca

SEQ ID NO: 134155 - DNA, 373 bp, Homo sapiens
ctttaagtgtgtgcaagaagaacattctcagagatagttggagtgcctgggagcggctagaaaaaattagggaaatgatgccaagatttagccacaagtgatactactaacttaagaggctgctcctgatctcatgggggtcttaaattcttccctccagtccctctctcgtgggttgtattagaaagattactgcagcgactttaagcacaacaggttggattcagattagatttaaggagggacttccaaacaaatgcttttgaagacatgagcttgtaagtgaacagagagaaaggtatcatctaccttttagaagccttaagatgctgggcacaggtatattttgcattcctgaaaagctatctgctaa

SEQ ID NO: 134156 - DNA, 500 bp, Homo sapiens
ctaatcacttagctctttgcctggagcagggcctggcattcagcaggtgctcatatgtgagcggcgctggtggggaatcagggcccgcatgacccagagcagctgttgtaagacatgggtccagcaaagcattcctcatgctgctgcctgcacttaccctctaggaaggccagcctggaggagccacttctgcccttcaggcaaatgataactgagcacctgtctgtgcgggtgctaggtggaaaggtccagagatggcagtggcctggtccctgcctggggcaccttctctccaccaacagacacttacccagctggttaggcctgttctcaccccgcagtctgtagttagcacccaggctgggaacaacagcctgtgttcctctccctttccttggtaccttctcttcttgttcctttatttttttctgaagagataggatcgccctatgttgtccaggctggactcgaactcctgcccacaagccatcctcccacca

SEQ ID NO: 134157 - DNA, 121 bp, Homo sapiens
tgctatggaaatagttctactgtattttaaaatttgtatttttattgttatatttttgttactttttaaaaaatatttttgatccatggtttgttgaattcatgggtacagaatccatgga

SEQ ID NO: 134158 - DNA, 436 bp, Homo sapiens
aaatccagacctgtctgattgcaaagcccatacttgactctgaggccaccttcctgctgcagtgaaagtcatttcttccatttcctcagtagggatccagagatcaaggcaggagagaatctttgcttcctctacctccttttctttccccctttctctaaaagcttgtggggaaactggaagggaaagagaaagttctaattgacacctcccactccccagtttttctagagcttaaatagtatatggcatatactgctgtattgttttggttgcatttttcccacattgagtataagttcctttagaaccctatattgcatttctttgtatagcttttgtcttactagtatcataaacgatttactctgcccataccatgcagaacttggagcagacttcagaatttttagaatctaggatttatcctcttttc

SEQ ID NO: 134159 - DNA, 502 bp, Homo sapiens
tcagatttctctttcttacttcatctctcatatttcccacttctttaacacaggcatctttcctgcatttggatcccacctcagagcttttgcactggctgtttcctctgcctggaaggctcttccccaagatatcagcatggccttccctgatttcctttaggtttttacttaaatgtcaccttcccatgaaggtctttcccaatctcaaatggcagcccctctctaacttccattcctgctttatttttctctagtatttcccaccatctaaaatactgtacaccttatttctatatcgtttctttgcctgcttcccactagaatatgagccccatgaaggcaagactgttggtcagttttgctcactgctttacctccagtacaagagcagtgtactcactaagtatttgttgaatgactgtaaaaaggggctaataatacctactacctcgtggattattgtgaagatgaagtgagataaggcatgtgaagttcttgg

SEQ ID NO: 134160 - DNA, 1213 bp, Homo sapiens
acacctgtgtcttccacttgctgttttatttaactcacggctactgtcctaattttagggatgctaaaatagtttgttttaaaagaggtttgtttaagaaagcagtaggtacattatgtttactagacaggcccttggaccagctaagcgacagggaacctggtacattatgtttagttactgttttcttctcaaagttaaccaaagctaaataactttcctatgtaaaatgtgctgactcccaaaagaggagaaatgcaatggcttgagcttgcatgtgtcacaggtttgtggagccttcagccaggtgatggtcttcagctaaagagccagctgcatcttggtatctcttcctctgctaacttcctacttttagcaaaattctttcacttggaactctagctgatccttggccaggatcagatcctcaaaaggaaatattcagttagcagtggatattgtacaagatgtaacatggcttagaggaaagagtgtagacccagcgacagatcatcagtcactcaaatcctggttctctctcttcctccatctgtgactttgaacatgctacttggaggctcagcttcttcaccatcaacaggaggattacatctaatgcaggcaatcatctattacagatgccgaataaatgatatcaaagagcatagagaaacaaaaatcttttatgatgtacggaaaaaaaccatgctgatacagctggctattcagggtcacccagcagtcctccagcaaggtagaaacaccaaatcaatgagtttatgctagaatttttcacatggccactggaccattgtggaagtagactggttgaaatattcttagtatgacatagtaagttatatttgtttgaaccttatcctgtgaaagcattatctgtcccaaacagtatatgccttttatcagggacacattaaatataaatgtttaaccaaagaaagttgttcttataatgtaattataacagggatttataagagggaattataagagggattatgaaagggaattacttttgagcaaggggagccatttgggagtgcttcaagatacccaatatgatatacacaattatgatttgtcagtcaaaaataatattaagaacaaaaaaagagttaaaaaattctgatatgagtgtaatatacttaatatgtaggatgtctcaaatttccagtaaataaattttaatgtccca

SEQ ID NO: 134161 - DNA, 952 bp, Homo sapiens
acacctgtgtcttccacttgctgttttatttaactcacggctactgtcctaattttagggatgctaaaatagtttgttttaaaagaggtttgtttaagaaagcagtaggtacattatgtttactagacaggcccttggaccagctaagcgacagggaacctggtacattatgtttagttactgttttcttctcaaagttaaccaaagctaaataactttcctatgtaaaatgtgctgactcccaaaagaggagaaatgcaatggcttgagcttgcatgtgtcacaggtttgtggagccttcagccaggtgatggtcttcagctaaagagccagctgcatcttggtatctcttcctctgctaacttcctacttttagcaaaattctttcacttggaactctagctgatccttggccaggatcagatcctcaaaaggaaatattcagttagcagtggatattgtacaagatgtaacatggcttagaggaaagagtgtagacccagcgacagatcatcagtcactcaaatcctggttctctctcttcctccatctgtgactttgaacatgctacttggaggctcagcttcttcaccatcaacaggaggattacatctaatgcaggcaatcatctattacagatgccgaataaatgatatcaaagagcatagagaaacaaaaatcttttatgatgtacggaaaaaaaccatgctgatacagctggctattcagggtcacccagcagtcctccagcaaggtagaaacaccaaatcaatgagtttatgctagaatttttcacatggccactggaccattgtggaagtagactggttgaaatattcttagtatgacatagtaagttatatttgtttgaaccttatcctgtgaaagcattatctgtcccaaacagtatatgccttttatcagggacacattaaatataaatgtttaacca

SEQ ID NO: 134162 - DNA, 991 bp, Homo sapiens
tactactactaaattcgcgcccgcgtcgacgaaatgcaatggcttgagcttgcatgtgtcacaggtttgtggagccttcagccaggtgatggtcttcagctaaagagccagctgcatcttggtatctcttcctctgctaacttcctacttttagcaaaattctttcacttggaactctagctgatccttggccaggatcagatcctcaaaaggaaatattcagttagcagtggatattgtacaagatgtaacatggcttagaggaaagagtgtagacccagcgacagatcatcagtcactcaaatcctggttctctctcttcctccatctgtgactttgaacatgctacttggaggctcagcttcttcaccatcaacaggaggattacatctaatgcaggcaatcatctattacagatgccgaataaatgatatcaaagagcatagagaaacaaaaatcttttatgatgtacggaaaaaaaccatgctgatacagctggctattcagggtcacccagcagtcctccagcaaggtagaaacaccaaatcaatgagtttatgctagaatttttcacatggccactggaccattgtggaagtagactggttgaaatattcttagtatgacatagtaagttatatttgtttgaaccttatcctgtgaaagcattatctgtcccaaacagtatatgccttttatcagggacacattaaatataaatgtttaaccaaagaaagttgttcttataatgtaattataacagggatttataagagggaattataagagggattatgaaagggaattacttttgagcaaggggagccatttgggagtgcttcaagatacccaatatgatatacacaattatgatttgtcagtcaaaaataatattaagaacaaaaaaagagttaaaaaattctgatatgagtgtaatatacttaatatgtaggatgtctcaaatttccagtaaataaattttaatgtccca

SEQ ID NO: 134163 - DNA, 366 bp, Homo sapiens
aagaatataattttgacattagaaattgaagtaaagtggagagacatggggttagaaacaaggagagcacttaggagagggttcttgggaatggttctgtacactcaagctgctgctggcagaggctaaatgccacagaagctagaggggaagaatcagctaacctttggttattgaataagtttacaaaggtgaccatcaagtgacttagcaggactgaccctgagaataactatgtaatttttttaaatggcaaatgcaggggaaacaggtttatgtgaaagaaatagggacgatgaccacttcagacatgtttaactaaatatgctatgtgaatgcatcaagcttgtaatatacatgaggcac

SEQ ID NO: 134164 - DNA, 438 bp, Homo sapiens
gaaagagccagacatcgggctgtgccgcggttacgcgggggagccatctcggcacgcgaatcgggcagcaccagtaaagggtttagataactggcaaccccttatcgacaccaggcacgctcatccacgcaagcatccaatctcaacttatccaacaccaatctcaactttatcaacacagacacaacatacacaccaggcatccaatctcaactcatcatacaacaccaagacacactcatccaccaggcatccaatctcaacttcatccaacaccagacacactcatccaccaggcatccaatctcaactcatccaacaccaggcacgctcatccaatctcaactcatccaacaccaggcacactcatccaacctcaactcatccaacaccaggcacgctcatccaatctcaactcatccaacaccaggcacgctc

SEQ ID NO: 134165 - DNA, 777 bp, Homo sapiens
gtacattttcagttatttgacccttgatttaacgatgtagtcctctgtgcatgtttttgtgttgcaaagaagactcacattttagaatctttttttcatcctgggttatgagataatttacaagcagaatttgaatttcttcatacctgcaaacacagggaaaaaccatcaattttactttttatttgtctcagttatgtgtgctgtttagttttagtccagacataactttagttgaatgattttataacaaacatacatttttgagtttttatatttttggtctgaaatatttagcttgctatttttgaaacaagaagtgtaaaatgtatttttatttactctttttgatatatctctatttataaatattttagcattcagcaacctttctaaatgtttcaatacatgtactatctattaaatgtgtatgtatttccaaaaaaaaaaaaaacaaaaaaaaaaaaaaaacctttttggggcgcgccttgggcctcagaaaaagcttttcaaaacccttcgcgtgtgggcccgggggcccctgggcgtacgggcaaccgtgggccaagggggtcacctcaaggaaaacccgggggcaatgagaatcagagggcttggggttttcttcgcccatatttaaaaaagagccgccgggggaacaaacgcaagctttttctggagacagtttcccaggaagggaagctcccggaggggccactaacggggattcttatacaccaggggggatccacaggggaattccgttttaaaatggcc

SEQ ID NO: 134166 - DNA, 621 bp, Homo sapiens
catgcatagtagctcacggctgtaattccagcactttgggaaggcaaggcaggtggatcgcttgagcccaggagtttgtgaccagcctggacaacatggcgaaaccccttctcctccaaaaaaacaaaaaaattagctgagcatagtgccatgtgcctgtggtcccagctactctgtaggctgaggtgggaggatcctttgagcccaggaggtggaagttgtggcgatccaagatcataacactgtactccagcctgggtgacagagtgagaccctgtctcaaaaaaataaaaaattattaaaaaaaaatatgttgcatatgtataagagaacccataggtaaggggaaggcatacatttttctacccagttatgtgtgttttgcgaaaatgtctcttttatcaaaataacaaataattaggagtacaggctttagagttgagcagacctaagtagctgtgaaactgtgcaatttatttaacctctcaaagtctcagttttgtcaactgtaaaacaggaataataatagtatcagcatactaaaataaatcattcaataaacatttatcaaatgccttggaagttaaatgcaaagcactgttttccgtgtactggggataa

SEQ ID NO: 134167 - DNA, 402 bp, Homo sapiens
ctctctttgctaatgaccaccagcccagattctcagagaggttgactttgttaacacaagcagctggggttggtgagagtccaggtggtataaggaacatcacgtgcagactcagtaattaaagaaaagctggtgagggggcgagtgggcacggctgtctctaggagttcttttgaaatgggcttcacttctccctctaagcccgtcccttttgttctctgcctctgagagccagtgctgtctggctggttatgccgtctcccacggagtatgcctccttctgctcctcccgcaaaccatcgctgtctgactggttacgtgggccatctcccactgagcccgcctccttctgctcctcctgcaaaccatcctggctacttttgctttttttttttttttttt

SEQ ID NO: 134168 - DNA, 639 bp, Homo sapiens
gaggccattccattcctgttttcccccactttcttacagttctaggccccagaggctaagtgtagcactgggggttcttggggtgggtctcacataaaccacctatccacacacagcaactgcagagtggcctcctctcacacagcttggctctctctgtggaagtgtggggtacagggaggtcatcatccctaagttgttacccaggctacactctgttatcgcaggggccacacatctggggcaatacctgtttaggagccccggggaccagtcaggggtatgagtctatggagcatgcatgcacacacacacgtacacacacagaatggccactggccctgatggaggcagtgttgttacctggtcccaggagactgatctgacctccaggctttaccgaggggtaactctcactaatgccaactccctgatcatagatttggcattgacatgtgatctaagttgcattgctcactccagggtgcctgctccaggcatctctaccaacctgagtggggttacaacctaggaggaaccagcagcccctgaaggacctcctgcacatctcagctaccatgactcagaaataaagtcaggtgacccagtggctaccagccctgcaatttggtgggtgag

SEQ ID NO: 134169 - DNA, 647 bp, Homo sapiens
acatcacatgcctatttatatcctatgagatcttctgtgatactcatcagagaaattgataagactaggggcaagaaattaaaaatatatcttgaaggacagtggcagttttttaaaactttatccatgactaaaaataaaagcaatcaaggcaaaaatattttaattacttataagcaaggtagcaaggatcatataaagtcaactcctttcctttcatatatactcagggaataagaaacaaagacactttcctaactgtaaagattatgagagatgaatgtcatattgtagactattttctctaaattacaagtataagatggacatttgtttgtattacgtagttaacataggtactagctagaaccatatgcagtaggtcagtataacttttgaagtcctttccaatcctttgatttccactgttagtttgtcaaattacagctgttatctgacatttcttgaatagcagtggtgtacgaggtacagtgtagaaagtccaccatggttgtggttcaatcatttattctctaaaagagatgatacctttgtaatcaagataataatatcagatgattatggtaagccagacactcaaacagaaaatgagtaattcctgcaggagtatcttgctagcaaaaaaa

SEQ ID NO: 134170 - DNA, 863 bp, Homo sapiens
attgtttggaaaagaatgtttaagttgtgcataatatatatatatatatgccattatttttgttggacatttaggttcccaagtttttgatattttagaaaaattgtaatgaacattttgctaaatagatgtttgttctaatctctgtttatttttgaggaaagagcctagaagtggaattgcaggaatagtgaatatgatcatttttaagtttttttgttttttttttttaattgagacatggtctccctctgttgcctaggctggaatgcagtagtgtgatcatggctcactgcagccttgacctcctgggctcaagcaatcctcctacctcagcctcccaagtagctgggaccacagacgcacaccctgaaccccccgttttcaaacaagatttcgaattgtttgaggtcaggatttctcaaacgtgatttcctttcttggcattttgagtttttgaacaataaatttttttcccagaattttttaaaaaaacaacacaaaacacacaaaacaacaacaaaccaaacaaaaaacaacaacacaaacacaaaacacaacaaaaaaaaaaaaaacaacaatgcttgcgcgagaggcggcgcccccgccacgcagtatgtgttcgaacagacgcacgagggggcagggagaccattgagagtatatgagagtgagggagacgggtggtaagggaggaaaaaccatagcgcgcctacaaacgcacagtagagcacgaacaaagataacacacatgagggggtagaaaacagacagtattactaaaacaacgacgcaagatacttgagcggataacaacacgatcaccttatatacagagcacctaacggccacgtaatactaac

SEQ ID NO: 134171 - DNA, 317 bp, Homo sapiens
cttgcttctcctttcccctgtgtttgggaccctgggcggacctttcccagcaggaaaggctgcagggtttttcagcgggcgaggatgcatctagagccccctggtgtgccgctcccctagctgtgctgctttccccggcctcccagaaagtgtgtgggggaagacagcgtgggcattcagcaaggggtgctctcccctttgcctcccaccccatcctgctcttccatgctggcctagaactttggggccacattgtatctctaggattctttccctttcagccaggagtttttgtcagacctgggaaagtgggaccc

SEQ ID NO: 134172 - DNA, 317 bp, Homo sapiens
taaagttaataattgctagaagttgattaacatttttgcaaaattgtttacgggagcctctaatagagatcatattaattaaatttcacttgttttccctcccctttgttaccatctagtagatgtgctaataagcaacaaaatggacaaattgcttgataggagatgcagctaacttggactcttagaatcacacggtttgcctagttagaattaactgaaaacatatttttttaacttcaactagtatttatgcttgaacattgtcatggagaagaacttgttatattttatagcagaataaacagaaatagttt

SEQ ID NO: 134173 - DNA, 273 bp, Homo sapiens
gactgagcctaggatatagctagggcgaggaggttgcacatgaagaaccaaccaaagagagagatgaagatggtcagattacagaaccggaacacatctcacagaaacagaagccaagagaagaatttccaaagaaggtgattgctgttagcaaatgtaataacttgagatgtgtgatgaatgaatacagttgtttctagctgtaaagaagtttcacttcagcgagcgctgtggctcatgcctgtaaatcccagcactttgggaggccaagga

SEQ ID NO: 134174 - DNA, 232 bp, Homo sapiens
catcatctacctcttgtccatcatcaaaccttcctctctgggattatcttgctttcctcctgttgatataaatttctgcaaacatcagctttcatcaaaaaaaatcccacactggtgatctacaagaaaaactgtcctgcaggtgtgattagcacagtgtttaaattctctttaaataactatgagatctaacttctctagaaaaaaactgaaagctggccactgtggccag

SEQ ID NO: 134175 - DNA, 390 bp, Homo sapiens
gatagaatgcccaatggccaaagatgaaacaaatctcagcaacaaagtaaataatgcaccttaggattataacccaaaggataaagtaagtacccatgagtccatgtgtgtatatgacctgatggagcagtagcatctctcctatacagaaaaagcccaaataattatgtagataccccccgcccctcaccacttcaaggagatagagcttaactctccacctttcgagtatggattgtgcttagtaacttgctttaagagtacaatatgtaaagaagaaaaaaaatttatagtaacctggcaaacactatcttggccaggtgatcaaaatttgtattaatataatgagtgataagccctattaaaaatatgcacccttgatgtgatgaa

SEQ ID NO: 134176 - DNA, 1033 bp, Homo sapiens
cgcatcccttccctgtctttgtggattggcctgtcctggacatttcatagaaatgggatctcacggtgcgcagccttctgtgtctggcgtctctcactgagcgtgacgtcctcaggtgcgtcctcaggcgcatccgcgctgtggcctgcgccagcctcgctcctcttcctggctggtggtcccaccgcgtacacgtgccgccgcctgttttgctgctgcttttgagctgagaattgtttttatgacttttaaatagctagaaagggatcaaaacaagactgtctcacgatgtggaaattacatgaaattcacagttcagtgcctgtgagtagagctgaccggccgcagttcagccacacatggactcattaccgaagctgcctccacccaggcagcctgagccagcagctgtgaccggcaccctgtggcccacacggccagaagtgtttgccatctggccccccgcagacgcggtctgctgcctgtggtggagatcactctggaggcggctgtcatcggccactcccgggagccctctcctaccctcagtcctccatccctggagcagttagccccatacctgggccatgctggggcgggccctgcgcccaggacggatctcatgccttctcttttctctcccccggtgatttctccaagccagtggaatcctgaagggcttcgacccactcctcaaccttgtgctggacggcaccattgagtacatgcgagaccctgacgaccagtacaagctcacggaggacacccggcagctgggcctcgtggtgtgccggggcacgtccgtggtgctaatctgcccgcaggacggcatggaggccatccccaaccccttcatccagcagcaggacgcctagcctggccgggggcgcggggggtgcagggcaggcccgagcagctcggtttcccgcggacttggctgctgctcccaccgcagtaccgcctcctggaacggaagcattttcctttttgtataggttgaatttttgttttcttaataaaattgcaaacctca

SEQ ID NO: 134177 - DNA, 921 bp, Homo sapiens
ggggaggtcaaagggcgcggggcggtgcctgcgaagagccacacggcgcgacaagatggcggataaggagaagaagaaaaaggagagcatcttggacttgtccaagtacatcgacaagacgatccgggtaaagttccagggaggccgcgaagccagtggaatcctgaagggcttcgacccactcctcaaccttgtgctggacggcaccattgagtacatgcgagaccctgacgaccagtacaagctcacggaggacacccggcagctgggcctcgtggtgtgccggggcacgtccgtggtgctaatctgcccgcaggacggcatggaggccatccccaaccccttcatccagcagcaggacgcctagcctggccgggggcgcggggggtgcagggcaggcccgagcagctcggtttcccgcggacttggctgctgctcccaccgcagtaccgcctcctggaacggaagcattttcctttttgtataggttgaatttttgttttcttaataaaattgcaaacctcacaaaaaaaaaaaaaaaaaacaaaaaaaaaaaaaacaaaaacaaacaaaaaaaaaacaaaaaaaagggggggggggccacgatacaaaaatccccggggggggcaccaaataaaagggaacacacgtgcgggacaaaaggggccccaaagaggggccagaacaaagaagagcgggcgcgaaaaaacacggggacactgcgcaaaccgcggcaggggggaaaaactgtaggaaaaagaagaaactagtgggggggaggacaaatttggggagacaaactacccagaggatgagtaacagacccaggaggaaacaataaatgaagagtgttatgtggtgtctaaccacggaagatgtgtgctgggtgaagaagtgcccacgaatattttagaaaattag

SEQ ID NO: 134178 - DNA, 505 bp, Homo sapiens
gctgccactggtctctaggggccatgggtctcagccgtgggagccggggacctgccccacagagcgcatcccgtctgaggtccctgcgtgctcgtggcgcctgcagggtgcaggtggggaggtcggagcgagggtcttgggtgggtggggggtctcggaggcttcctggaggtccctcagtcctctctatctgctcctccccagaccctgacgaccagtacaagctcacggaggacacccggcagctgggcctcgtggtgtgccggggcacgtccgtggtgctaatctgcccgcaggacggcatggaggccatccccaaccccttcatccagcagcaggacgcctagcctggccgggggcgcggggggtgcagggcaggcccgagcagctcggtttcccgcggacttggctgctgctcccaccgcagtaccgcctcctggaacggaagcattttcctttttgtataggttgaatttttgttttcttaataaaattgcaaacctca

SEQ ID NO: 134179 - DNA, 608 bp, Homo sapiens
ggggaggtcaaagggcgcggggcggtgcctgcgaagagccacacggcgcgacaagatggcggtgagcgcgcggcggaatctggagccggggggcgtggagctcgggccgcgctccaggtctcatgcgctctgctttccccgcaggataaggagaagaagaaaaaggagagcatcttggacttgtccaagtacatcgacaagacgatccgggtaaagttccagggaggccgcgaagccagtggaatcctgaagggcttcgacccactcctcaaccttgtgctggacggcaccattgagtacatgcgagaccctgacgaccagtacaagctcacggaggacacccggcagctgggcctcgtggtgtgccggggcacgtccgtggtgctaatctgcccgcaggacggcatggaggccatccccaaccccttcatccagcagcaggacgcctagcctggccgggggcgcggggggtgcagggcaggcccgagcagctcggtttcccgcggacttggctgctgctcccaccgcagtaccgcctcctggaacggaagcattttcctttttgtataggttgaatttttgttttcttaataaaattgcaaacctca

SEQ ID NO: 134180 - DNA, 525 bp, Homo sapiens
ggggaggtcaaagggcgcggggcggtgcctgcgaagagccacacggcgcgacaagatggcggataaggagaagaagaaaaaggagagcatcttggacttgtccaagtacatcgacaagacgatccgggtaaagttccagggaggccgcgaagccagtggaatcctgaagggcttcgacccactcctcaaccttgtgctggacggcaccattgagtacatgcgagaccctgacgaccagtacaagctcacggaggacacccggcagctgggcctcgtggtgtgccggggcacgtccgtggtgctaatctgcccgcaggacggcatggaggccatccccaaccccttcatccagcagcaggacgcctagcctggccgggggcgcggggggtgcagggcaggcccgagcagctcggtttcccgcggacttggctgctgctcccaccgcagtaccgcctcctggaacggaagcattttcctttttgtataggttgaatttttgttttcttaataaaattgcaaacctca

SEQ ID NO: 134181 - DNA, 760 bp, Homo sapiens
taatagtaaatattaaatggtttccatcagcaattccagcacaagtttcccgggatggtaggcaaaatcaagctacccaagggtctcatgatgaggtatgggggtcactgaggaaacccccaaagtcattgacccctccgcgcaacctccacacaccaggggggccctgcaaaatgagggtggggctgataaaatggtcaataaggggagacaggatacagggtgagggaacagggtctacgctggtatattggcctgcaggaacggaggaggaggcgcaggacgcaaagatggcggataaggagaagaagaaaaaggagagcatcttggacttgtccaagtacatcgacaagacgatccgggtaaagttccagggaggccgcgaagccagtggaatcctgaagggcttcgacccactcctcaaccttgtgctggacggcaccattgagtacatgcgagaccctgacgaccagtacaagctcacggaggacacccggcagctgggcctcgtggtgtgccggggcacgtccgtggtgctaatctgcccgcaggacggcatggaggccatccccaaccccttcatccagcagcaggacgcctagcctggccgggggcgcggggggtgcagggcaggcccgagcagctcggtttcccgcggacttggctgctgctcccaccgcagtaccgcctcctggaacggaagcattttcctttttgtataggttgaatttttgttttcttaataaaattgcaaacctca

SEQ ID NO: 134182 - DNA, 692 bp, Homo sapiens
ggggaggtcaaagggcgcggggcggtgcctgcgaagagccacacggcgcgacaagatggcggataaggagaagaagaaaaaggagagcatcttggacttgtccaagtacatcgacaagacgatccgggtaaagttccagggaggccgcgaagccagtggaatcctgaagggcttcgacccactcctcaaccttgtgctggacggcaccattgagtacatgcgagaccctgacgaccagtacaagctcacggaggacacccggcagctgggcctcgtggtgtgccggggcacgtccgtggtgctaatctgcccgcaggacggcatggaggccatccccaaccccttcatccagcagcaggacgcctagcctggccgggggcgcggggggtgcagggcaggcccgagcagctcggtttcccgcggacttggctgctgctcccaccgcagtaccgcctcctggaacggaagcattttcctttttgtataggttgaatttttgttttcttaataaaattgcaaacctcaaaaaagaacaaaaaaatagcaacacgacgcttgcaagcgaatcaagaggggagtacaaaaaggaccgggcgggaatgctacacgggggcagacaccagacgcgtaaggccagggcgccggagcgcagaagagcctggcacaactttgctggacgcggggggagaccc

SEQ ID NO: 134183 - DNA, 822 bp, Homo sapiens
gggcagctgtgccacgcacacctcctccccgcagccccaacccatctccagagagaccaagatctgctctggcagcagccattctggcgacaacattgactgggcggacggttgctattcctcagcctcgccagaggtcccggtctgagagtgatgtgagcagtgttgaacaggacagcttcatcgagccctatgccaccacctcacagctgaggcctcggccaaatggcagagtgagatgggaagaagatcttctttgccatcctttgaaacactggactatggggacgaagaggacattgaaactcagctgtcatccagcggcaaggaatgggggatgtcagtgcccgggaggacagaggaggccacagtgatgacctgtacgctgtgccacacagaaatcaggtgccattgttacatgaggtgaacagtgaagacgatgaaaatatttctcatcaagatgggtttccaggctcccctcctgcaccacagtggacacaacaaaaagatggtaaacaccctgttctgaatttaaaggatgaaaaacctccattatgtgagaaacctccaccctccccaggtatttgccttttgaattatattatgatgaaaagcttggtttgagaatatccagattaattttatctgaaaataaagattacattttcttttttcttgaaaaaaaaaaaaaaaacaccgcgggtttagtcggggggggaaaaggggttggaagggccatggcaaggtgttccggacccacttttggaaaggggaaattgccggccccaaagggggggaaattcgaaacagtactaagagggg

SEQ ID NO: 134184 - DNA, 674 bp, Homo sapiens
tcgcctgatctgacctgaaggaggactgacttcaggacatgacaagttcctcagggcaaaagagttcaccaactggtttcctcactgtcaagaaagaatctggggtgagaaacaccaggtgcctaagaaggcaggagaggaagtaccactgacccttggctcactcaccttttgaactcttaatgatgtaatttgtggcaaacccaaaggttaccatgatgtgttactctgctgagactggtggctgagtcatgatgggaggccagtgtgtggagtgggtcactgggctagtgacaaagccagtttactgcccaaccccacatctcagtagagttgctctttccttactgaaccaacaaccaggcccacagaaaaagcaaactctctagtgctaggggttaaagtattagaaatcgatgattcttagatagggaataggcaccatccttaacaatagtcacacatttgaggatgtctacacatactcttcccaaatgctaagggtctctctgctcaaaagggtaaggaaggcaagcttcgttgacatctcagtgttgggaaagcagcctgtcttatgtcctgggcatggaggaaactgttgagatctgttgggctgcttttagcaggttagattgaaggggcagctcttccttgcctgcttctagctgagcccc

SEQ ID NO: 134185 - DNA, 567 bp, Homo sapiens
ggttgggcatgtgggaggagcttattaaataggttcaatcgccttttatgttttgaatgtataataaaaggcgaaagatttataccatctgaagagaaagcacagtatatatttttggatgtaatataaaaaagtacagggttttaatagggcagacctgggtttatgtcctggtctattacccattgtattcactgattcaacctttttcggacctactctgtgcaaagcactcttctagatattggggatattgtactgaatgtgatagtttgaggctttactcttatggggttcacattctagcaccttgggcaagatgtttaagttttctgaacctcatttttgcctccaacagttcaagtaaattcagcacctatgacatgctgggtattacactaagtttggcagcacaagaaccaactagatagaacctacgttttcaagtacttttacaagtccaatgggggcagcagacaaataatcacgcaaattcaggtgctgtgagagggatcaggacccattgttacgggcaatagcaaactcagtcctgggtgccatggagat

SEQ ID NO: 134186 - DNA, 770 bp, Homo sapiens
agtctcagttttctcattagtaaaataggaaaataatacttccctgtagggggtgcttagtgtaaagattaaagttgatttatatgaaatgcatgatgcttggcaatgtcaatgtttaaaaaatgttcgttgtaataattcatgtaagtaacagtaagctataagtatagcctgtattatttgtagatgttggctgtaataattatcattgttcaaatcaaagccaattcctagttcttagccttatggtaggacatttttctctgctactgtaatagtgttggaaccataaaccttccttttaattatatgttatgcaagtggaacaattagtaatggctttataaagattacaaatctacttataaaataaatcaaccacataggaataccttcattatccattttcttacactgggacctaattacttttaaggctcctaatataatttcagctctatgaaaaccaactaacaacttctaataatgcatttgattcacagttgttgatttgcattaccatgaatagttaataaatagaacagaaagctttctcttcttaggacttattagtctccttgattcataattattaatggtccatagaatacaatgtatagtttaattacaagatgtcataatcacagtcctaagatcttatgataaagataataaaggaaactgcaagactgattccactgaattgcataatgctaccatgaaagctccacaaaggtagggatctctgttttgttaacttctgtagtccc

SEQ ID NO: 134187 - DNA, 762 bp, Homo sapiens
gaagatcctctgttttatataaagaacacttttatgtaaagtgtttctacagaaattcccattcacagcagctgagtgtgcacccttaccctctgatttcaacagtgactcagtggttcctggattattgaagtctgctggacaaagcttgtgcttcatggtcatcctgaccattttgttcagcctcttggtcaatttgtccccagtattatgtatttaccttactttttagtagcaggagccagtgtcaaataagttagatggaatactctgagagacagacagaatccagctgatattcaacaatcttatattgatgttgatgtaattagaaaaagtagacctggcatactgaaaataggggaggaacttgggtataagattctttatatcttcagtccagtcttgaggaagatgagagacccaaataggtctctgcttataggcacttccatatcaagagatgttttgcatggaatgattctttgcggcaaattcagatatcttgtaacaaattttgttctgccttcctttgtcccatccaaaagcattttaaattcaatattgtattttagttatttggtttagatatttccagagctaggacaatatcttattaatctgtatagcccaagcttagtaaaatttctttcacttcatagacttacaaaaagaataaatgaataatcattctgaagctcaattcatcatttttctctctgaataggcttcccttcctgactttcataacaacctaccata

SEQ ID NO: 134188 - DNA, 754 bp, Homo sapiens
atttctttggttcattctacaaatacttattgagcatccgctatgagcccaggaattgtgctgagggaagggggaatgcaagagaccaaagggaactgaacctgtctctatccgcccctgtatccctggcatgctgggaggacggggcaaatggggaatagaactaccgtttatagagcatctattctgtgcccagctctgaattctcacaatagctctgtgaggtcgcctgtattacaaaagtcaaactgtcctaaagacaagggaccaacagccagctaccttgcatctatagttggatacctctcaagcttctctgggaatgaactgaactccactcagctagaaaaagccccatcctgacaccttcctttccctcatttcccactagtcccgctgattgcatctctttgcttcatctacttctctctgctgcccataagcctttgaagtctgcgttctcctgcttggattaatacaatgtgctggctgggggtggtgtctcacacttgtaatcttagcactttgggaggccgaggctggcagatcacttgaacccaggagttcaagaccagcctgggcaacatggcagaaccctgactctacaaaaaaatacaaaaactggcggggtgtggtggcatgtgcctgtagtcccggctactcgggaggctgaggtgggaggatcacctgagcccgaggaggaggtcgaggctgcactgcactccagcctgggcaacagagtgagacctggttt

SEQ ID NO: 134189 - DNA, 374 bp, Homo sapiens
agagttactcctaacctagatctcctgacctagccacagttccttgatgtacctgtaagactgcctgccttccaggagttacttatgatgcttctggtgtttctccctgcccctttccccgttgatgttgacgaaccatcttcttagcagcccgagcttaatctttatgagccatgacctgttgatgcaagtgatatttcatctaccttggccccatcacctagtaatatgtataaacccttgggaacagaattgcataaaaatctcagttactaggccggtctgattgtagaccagtgattggtttataaccagtaattgatcacaactggttagatttctttgtttcttcttcactcccactgcttcactta

SEQ ID NO: 134190 - DNA, 579 bp, Homo sapiens
aggcttgtggaaactcaagtcccaactgctgggatcagcaattcccctctggccaaggctggtttgaatgttccctctgtgggcagacatcagctaagtttggtccagttttctttctgctataacagaacagcactgagttcggtggctcataattgctatgctctccttccaccagtgcccagaaatgctctccacaccacatcaccacgccctggggggtagggaaggggtagcatatgcaattcaagactggtttttgtatctcttcagtgcctctttcagcaagataaagttaaaaccaagtaccatgactgctcacctgatttgtagttcttatgaaggtgctttttaatatagttgtcaaattggtgtccttgcagggggtgattggtgaagccttctattctgccatcttgctccgcctctccaattagccatttttaataccttgtatcttcaattgagaatttttgaagtctcagattgatattatggcagaaaaggaggaatcacacacagcttgtctttggatgaccaaaagcaaacacctgtcttttttttttttttttttgcctc

SEQ ID NO: 134191 - DNA, 300 bp, Homo sapiens
aaaacctttcccctgttgcttccggattgaatcatagttaggaaagcttttcctattcccagcttagaagaggaattcacccatgtttttttctagtactgattttctttattatttaagtttagatctcatatctatctggagtttatcctggtgaacaatgttaggaagtgatctacttagattcttttttatatggctacctacttgccccaatatttttttttgaagtccagtgaaaataaaataaaatatcactttttgtttacatgtctgttttatgtagttctgggttgatat

SEQ ID NO: 134192 - DNA, 882 bp, Homo sapiens
atttcaggaagaaatggtcaacattgtcaagtgctgcagagagttccaatcatatcagaattggacagcatccgctgcacttggcaatgtgcaggtcactggtggcataaaaggggctgagtggccaatggaaagggagggagtaaagactgtgttaacttacaagtgagagtttatgcatgtatgatatacagaggggctgacaaattacccattggtacaatgttcattatttgggtggtgagtacattggaagctcaaatcccaccgctatgcaatatatccatgtacaaacctgtgcatgcacccccagatcaataattttaaaaagactgttaaccagcttcggggtggaggaagatggggaccaggaatgagcatggaaacgaggagggtttttaacatgggaaagaccacagcatgtttctaagctaagaggaaacacgatctcgttatgagagttagaaggacaaggcctgaagagaaggtggagggaggaaaattagggtgagctgaactaggacaaatccctccccacctaacagagggcttatgcatggactttacattcaacacccattctacattcaacacgcatggactttagaacttgaatatgtctgttaatgttatgatctggaatatctccattacaagtttctttccactgggcttaaataaaacactttcgtcttttttcccccagaaaaaaaaaaaaaaaaaaatttttcggggcgggccagggagtttaaacactctgggcggggccagaagaaatgcagggtccagaaacggcgaactgggcgtcccaaaccggggcggtcggaccaggctgttgtctagccgccccacgcccgcgccgaacagcgaaaaaaaagaaaa

SEQ ID NO: 134193 - DNA, 643 bp, Homo sapiens
atttcaggaagaaatggtcaacattgtcaagtgctgcagagagttccaatcatatcagaattggacagcatccgctgcacttggcaatgtgcaggtcactggtggcataaaaggggctgagtggccaatggaaagggagggagtaaagactgtgttaacttacaagtgagagtttatgcatgtatgatatacagaggggctgacaaattacccattggtacaatgttcattatttgggtggtgagtacattggaagctcaaatcccaccgctatgcaatatatccatgtacaaacctgtgcatgcacccccagatcaataattttaaaaagactgttaaccagcttcggggtggaggaagatggggaccaggaatgagcatggaaacgaggagggtttttaacatgggaaagaccacagcatgtttctaagctaagaggaaacacgatctcgttatgagagttagaaggacaaggcctgaagagaaggtggagggaggaaaattagggtgagctgaactaggacaagcaggacagatgggaggcttcaggggcccagggaggacacaggcatgagttagggggatgctgctgctgctcctcaaactcatcccacacatagagtccaacgcccaagctctcact

SEQ ID NO: 134194 - DNA, 784 bp, Homo sapiens
gcagagcatactaattccccatggatgtgctatgtatatgtgatcacaagataatattcagccctgcaaagaagcttaaaggacagagtaaccaaagactgaacacagtacataaggtaatttcacagtagggcaatagtttgcttaattgtcctagacagaactgatattgataccctcaattcccctgtcacttaagataaagtcaacaatttttgtttctttctttcatctgatagttccaataaagtatgttgctacagtttttaaggggtacgcattaagcaaacgttgcgaataatagagagaattaatacaggagtggaggcataaagtcctcacctaataagaaacgttaagccatgaaaaaaagagtcatatcaaggacaatatattgaaatgcaattcaagtcatctcactctatagtcccagagaaggcaaaatgtcacagttacatttttttattcaccaatgaatattgtttaaatttacttataggaggttttgcttaagttgattcatttatctagaagttcctctgcttgtctaagcaggagggctcaaactgttggtttaaggactcctttttaccctgaaaaattattggatacctcaaagagcctttgtttatgtgagttatatctacccatatatgccatataattaatttaaatggagaatttaacttagaacttaatttactttaaaataacaaaaatacaaccagtatatgttagaaataattaacataagaaaactgactatatttttccaaataaaaat

SEQ ID NO: 134195 - DNA, 422 bp, Homo sapiens
cctctggccttctgaaagttcaaaatgaaggaaaggatagcgtaaggcaaaccaggcaagcactgcccgcagctattgtgtgccagaggccatgccaggtccagaagaggaagcaaagagaataacaggacgccatctctatcttcaaggaatttaaaacgtagtgggagaacttcactcacgaacaatcaacaaaaaacaagataaaatgtgcctttgtgaggataagagccaagtactaggcagcaaggagaaaggagggattcagattccgactgcgaggaccggaaatagggcgtgcttggaggaggcttaaggggcgagcacagtcttatctgactggcggcttcagggacaggtttctccccatcttgaggaaaccgggaaaatcctttaagtgagcacaatccacgaaggctggg

SEQ ID NO: 134196 - DNA, 634 bp, Homo sapiens
gtctgggacatatgatagatatatgtttaagttttaaagaaatggcaaacttttccagagtgcttgtgccttttttattttctttccagcagtgtagtagaattcaggttgctctacattctcaacaacatttgatactgtctttttaattttaaatattcaaataggcatattttggtatcttattgtgtttttaatttgtatttccctagtgacaaatgatgttaaacatcacttcatatgcttatttgccatttgtatatattctttgatgaaatgtctatgcatatgttttgcctgtattttaattggattatttagcttattattgcattttgagagctcttcctatattctggatacaagtccttttgtcagatgtgtgtttgcaaatattttgtcccaaaccatagcttgtctttttcctctcaatactctaatggaaggataatatataaatgcaattttgttttagttttttaagtcctctgttagccatgaagagggacttaaattaagtatacaaacaaggttgcagagataatctaaccttctaagagaataaaatattctaaatcttttgcatatgcatataaaccataatatgcaaaacagattaatatgatgttatatg

SEQ ID NO: 134197 - DNA, 758 bp, Homo sapiens
tgtttagtaatgtgttatttaatctgtaaatattgttggattttctagctattctcctattattgattttctagtttaattccaccgtggtctgaaagcagaccacattttgtgatttctactcttttaaatttcttgagttttgttttatggtcccgaatttggtctatgttagaaaatgttacatgtgagtttgaaaagaatgcatattctgctattgctggttgcagtatatagacttcctttatattgagttgatcttggtgttgttgagttcagctacatcctttctgattttttgcctgctagatctatttctgagaagtgggggcaattgaagtctccaactttaataatgaattattttatttttccttgcagttttgtaagtgtttgcctcatgcattttgctgctctgttattagggacatacatactaagtattgccatgttttcttggagaatcaacacttttattattatataatgcccttctttatccttaataactttctttgctctgaagtcttctgaaattaatatagctacatgtgtttcttttcatcagtgttaccataatacctctgtctttatccacttacttttaatataaatgtgtctttatattcaaagtggatttctcatagacagcatactggagggtcttgttttttgctctattatatttctgtcttttaattggtgtttttagaccattgacatttacaatagaccattgacatttacaatgattattg

SEQ ID NO: 134198 - DNA, 275 bp, Homo sapiens
gggggacagagccagatgccaggaatgagaggccaaggcagcattcctgggtagtagctggaaaggaagggcctctggggagattgagaggtgggatgtgaccctcatatgggcactttgaagagggtttgtcactgtcaggccagaagaggcagaggaaggagggggcccagcaagttgtcagagggacacattctcagtcggagcctgagattcatctttcagcacctaacttcacaattccagatggctctccttggggagttctttttctc

SEQ ID NO: 134199 - DNA, 204 bp, Homo sapiens
cggtgtgctggggtgatctagaggatcccatatgctgtctcagcctcggagtagctgggataacaggcggagtgccaccaaggccctggctaatttttgtatttttgtagagatgaggtttcgccatgttggtcaggctggtctggaactcctgacctcaggtgatctgcccactgtggcctcccaaagtgctgggattacagg

SEQ ID NO: 134200 - DNA, 262 bp, Homo sapiens
gcctcctaaagtgctgggattacatggtgtgtgccaccatgcctggctggccagaatgtaaatgataactgttttgcttcctcctgtgtccagtacataatagggctccaagtcagtatttgtgaggcaggtgcatgcctcttagttgcggtcctgagggcatggccactgccacgttctggacagtcagagtcgctgctgcccctggaagatgaccgcgatcatgaagcccaggagagctcgatgctttttgcctttccct

SEQ ID NO: 134201 - DNA, 538 bp, Homo sapiens
ggtgaacttagatggggagcccattcataattgatttttgttttttcacttgcatgcatagtagtcaaacaatatagaaaagtattcagtgaaagtctctctctcgatctatctctcatctatgcccagtcccctccttggagaggatcactgttaccagtgtctgctacatccttcctgagaggctgtaagctaggggtcggccaactgtgacccatgggccacatccagcccactacctaattttgcgtgacccttaagctaagaatggggtttatatttggtgctgaaaaaaaaatcaaaaggagaatgatgttttgtgacacatgaaattcaaattttagtgtccacaagtagagttttattgaaacatagccacactcattcatctatgcttttttgtttctgctcatttgtttacttatgagtggctgcttttgcactatgatggtagcattgagtgtaacagggactgtatggcctacaaagctaaaaatatatatctaaccctttacataaaaagtttgctgactcctgc

SEQ ID NO: 134202 - DNA, 790 bp, Homo sapiens
atttattttaatagtatataatttattattttaaataactgaattaataattgcatttaaacttaattagcatagtattttttttactgcaaataatgctttacaccaaaatgctgacaatgatcagattaggttgagaatatatatgattataggtggtgattaatattttaggaagtaactagagccggcatttgggggtgttgcggacgattcttacgaatccagacaatttgctcttttaaacgcggccttgcggttgtctaacagtgagaatagatgactaactgaatttgtcagactccctgccttctgtcataataacgacgcagaattgccaccgttatgtgtcttggaaatcttaaattctttagctctcacacacaaaaaattgaacggaagatacttggagagccagggtccattcagcacagcgcggctgggtcggcttccattcctgggtccgcagcgccctcgtgtggtaggtgcccagccttcctggctgcatctcaggccagggtacccattgatccttacttcccagtacagtagctgccttcctgggtcacaccccatcggaggtcacgatctaccaggaggttagccacccgctgtggttgtcttgtagttcttcgcaataagttactggctaggagtgcttgtaataagtcctgagtaggacatggcgattccattccttacacatgttgtgtacacgcagttatcctcaactggttggttggaccgtggcgtttatttccacaaagcagcagtttcctaaaggatggtt

SEQ ID NO: 134203 - DNA, 370 bp, Homo sapiens
tatactttttcctgaccgatatcttctcacacacagaaatattagtgatattaaatataccagttgaaaacaaacatctaaatggtacggttcagaatgttggtgttgaagtaacccagcagctgacagcatggagtaactattcttgccgtgtaagattatactctaaagatctggatgactgcccgggagtggtggcccatgcctgcaatcccggcacttcgggaggctgaggcaggtggatcacctgaggtcaggagtttgagaccagcctgacaaacatggtgaaaccctgtctctactaaaaacacaaaaattagccaggtgtggtggtgcacgcctgtaatcccagctactcaggaggctgagt

SEQ ID NO: 134204 - DNA, 465 bp, Homo sapiens
aattgcacagggaagaggtagactttggggaaatggctgtgatgtgtctgggaacattctgtcctagacacagagctctcagttgtggcaccagagccactagatcatgatggagaggacattagagacccttctcatatttcctaggtatcaacgggccttgggattcatggggtaccttatgaaagggaggcacgccaagtgatgcttaaggctgattttgctcctgcaggatatgggctagaaccagacatagcctgatttaaaggaaatgaagcaagtgacattttgcacatttgggtttggtagctacaaatccatatctactataggagaaaagggtctttatggaaattgttttattgtctgtgtggcaactgactctaaaatcagttgtatatagtgtgatgtgcatgtacacgttaaatacacctcatatcccagaggtgatcaacataaacagag

SEQ ID NO: 134205 - DNA, 601 bp, Homo sapiens
aatgagataaagtgatgagatgaaatgaagtgaaatgaaataatggaatgaaattgaaatgagatgagatgaaatgagaaaatgagatgaaatgagaagaaatgagatgaaatgatgaaatgagatgatgagatgaaaaatgatgagatgaattgaaatgaaatgaaataatgaaataatgaagtgaaatgaaatgatgaattgatgatattgaaatgaaattgaaagatgagatgaaatgagatgaaatgaaatgttgaaatgatgaagagatgtgacatgaaatgagctgaaatgagatgaaatgaaatgagattaaatgatgagatgaaaaatgatgagatgaaaaatgatgagatgaaatgatgagatgagatgagatgaattgagatgagatgagatgaaataatgaaattaggtgaaataatgaaatgagatgaaataacgaaataaaattgaaatgagatgagaggaaatgagatgaaatgttgaaaagaaaggaggaaatgatgaggtgagatgaaatgatgagatgaaattgagatgaaatgagatgaaaaatgatgcgaaaaatgatataaaaaatatgacatgagatgaa

SEQ ID NO: 134206 - DNA, 617 bp, Homo sapiens
tctgatccagtttcggtccgcagtgtcgattatcagcacatagaaacagaaagcagcgtttgacagactaagacatcaagacattattctggatgaatatcttaggctgctgcagagaaacagaactttacatgagacaacgtgtctgaaagtagactgacattactgcctacacttagattattatatgacggtcatatcaagtacaaattcagtccacgcactgaccccatggctgcactctctttgaacatatgatgaatgaaatgaatgttttgagtgggttattgtaccgtttaatatatttatgcactagaatccccatctgccttagatttgggcataactgagtaacctacaccagtttttctatccccatagaggtcttgctccagcctagcttcaagaatgactattgtaggcatccagatgttaatcaaccgagcatatatgctcacagttgttttgaagaatgctttttaatgtcaccttcctgcaattttaaaattatttgtgtcttgagctaccaaatataattacattcctgagcacattaaataccataaaacttttcttatgaatgacagaatcttgagctatcaatcaccatacccctg

SEQ ID NO: 134207 - DNA, 489 bp, Homo sapiens
taaaagggatctgagcaccccacctagtcatacacagcagcctttgtcaggagacacacacatgccctggtggtaggaatcaaatcgacaccatcccacccaccttgcaaaacccaactccacatgaaaagcctcctgagggcatagtaaccttttaccctggtagacatgtgcagccgcattacattacaataccaacctaatcatcacaatagtgattctcacaacattaccaagtggagcaaattttcctttacatggaaaactattaacagtaccaaatggtttttacaataagtgcttatttctttttgctgatttttttaaaggctatttttttttatttggtaaagagataacacgagttttatttttacaagagtgcctcctgccctatgaagaagcacacacgatgcatacaggcctaacgctggactaaataggtggtctctgcatcgatacccactagctggccccctgaggtcatgg

SEQ ID NO: 134208 - DNA, 153 bp, Homo sapiens
cccactcacctagtgtcttgtagttatttgtttataccttgcctcccttgttcttctgtgagcttcctatgaatagcatcatatttttccacttttgcatcacagcacatagcacaatgcctcacatacctaagatgctcaataggattgtta

SEQ ID NO: 134209 - DNA, 625 bp, Homo sapiens
agctgacacaaatagaaacgggagagaatgtcacaggaatggagctcgaatttaagcgtctagccagctcaaaagctcacacctcaaggtttatcagtgccaatcttccatgtaataaattcaaaaatcgccttgttaatattatgccatatgaatccacaagggtatgcctgcagcctatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccagagtccggagaaggattattgacttcatcggcaagtcataaaacaaagaacagttggcaagatggaccattcag

SEQ ID NO: 134210 - DNA, 498 bp, Homo sapiens
ttgcaccttctggctgcctgagctgcacacctgcaggaccccgggcttcccagtaccaggagccacctgggaaccatttaaaaactcagctctcaaactagccatttcctccctcaagaaatcagtgagaaatgaccgccctggggtgatggcactggggaacaggaggaggcccctagagaccaagggagaggcactgcccaatctgtggtttccatggtttctgtccccactgcagctgcaaagaggcaggagctccaatgccagggttgctgcccatctgtgttggaggccacctgggagagatgccatgccagcccttgcaggtgcagagtcccactgcatctgttcttgacagctgagagcagatccagccccgcccagtgaagccccgctctggtcttatgaaaatgagaactgggatctgaactaggatcttaaggcttggcgggctgggtgagccacatttcactcccctgccccagtctccacccatgg

SEQ ID NO: 134211 - DNA, 353 bp, Homo sapiens
ttccgccatctcttccttgtcatcaggtgtaccaagtgtcatggccacctccagataacaccatgtgttcagaacatcacggtgacctgtatttgcatattaaagggctaaggtgggagggccaggtttttcgagagctatgtaaatgacacacctggtcaaaccaatcccctgggccctatgcaaaccagacaccacctcctccaggatcccaatataagcaaccacttttccactgcacactgggttttctctttgttcaaatcctccctacctctgtctctgtatgggggaggtgttttcttcttccttccttctttcttgcctattaaacttttcactccttaaaacca

SEQ ID NO: 134212 - DNA, 457 bp, Homo sapiens
cagcggaacaagcaaatatggatcattttgtgtctgtgacaattgtgctgctgttaggggacagatcattacagaacacattacttccaaagttttgggtttcattgcagtgttctcattctatagtcaaggatgttataaaaaaggaagtttaaaacaacatattttaaaaagtagattgtcgaaaaaaatctaggaaaagtgcaataaggtagtcatttgaggctgggtgcagtagctcatgcctataatctcagtactttgtgaagctaaagtgggagtatcacttgagtgagaaatgtaagaccagcctgggcaacacagtgagaccctgccttttgttttcaaaaaaggtagttattcaaatattaaactctggcttaaatttcatttactcctaattgataaaatcatttgttatagtgtggttgcttgttccgctgccaaacctcgtgtt

SEQ ID NO: 134213 - DNA, 351 bp, Homo sapiens
taatagaacacagctggattctcatatcagtttcttcatctactctgttgcaatatattgttttggttgatgtatatgaaaaaaattcagtctcacacagatatacagttggaatacaaggaagtattttaatagctttttcaggtaattttgggatatattttgattctacaaaggcagatggcagtttcttaaaagttaattgtggtgtggatctgaaagcattatcagtgaacatttttcaaatgctattacattaaagtgcactggttgattttgtactttgaatgattttttttactaatgcatgattttgtgatatcaggcattgctcatcttgaaaatatttat

SEQ ID NO: 134214 - DNA, 307 bp, Homo sapiens
ttttgatgtcattattccagcctaactaggcctgactgaaatgtctgccacttgccctgtggtcatattctgtgagcccctggtgatttcatgatgggatttctagttgatctaaggctagaagaaatagaaatgtattacaatgccttcgatgacaaaaataatgatttttacctatgacctatatttaacaaaatgataatacgtagcattgaatgaaagatagtcggctgggcgcaatggctcacgcctgtaatcccagcactttgggaggctgaggcgggcagatcacgaggtcaggagatca

SEQ ID NO: 134215 - DNA, 469 bp, Homo sapiens
gttgaatgtttcatgtccaatggaaaagattgtgtattctgctgttgttgggaggagtggtctataaatgtgaattatgctgagttggttgataatattgctcgggtgttctatatccttactgatttactatgtacttgttctgtcaattatgagagaaaagtgttgaagtctctaactataaatgcagatttgtttgttttcatttttatcagattttgctttacatcttttaaagctctagggtacatatttagaattgttatgtcttcttagagaattgactctttttgcaagacatagtatccttatttatcactgataatatttctcatcctgaagtctactttacctattagcatagctacccttgctttcttgggttagtgtttccatgctttaacttcttccatctacttatttttaagctgtctgtatctatttgacctgtctgtacatatgtaaagtg

SEQ ID NO: 134216 - DNA, 693 bp, Homo sapiens
taagctaaatcttcagaagaagaaataagaaaacatgaatccagaaaaatactggatctgaccaagccctggtcacacaatcctggaaatgtagcattcacagtgaaaggatgtacttggaacaaaactttcccttcagaaggaaggttagtaaatgtggaaaaaatgaagaacacaaagtaagatgatagaaataaattcaaatatatctttagttacaataaatgtaaaggtactgcactttttagttccaagacaaagattgttaacactgcatttccaaaaatccaggtatatgcagtttgtaagtgctatgcctaagttataaatttaaaaatggttaaaaataacaagtgaaaaataatatatcagccaaataataatcaaaagtaagcttggatagatatagtaagaaataacactttaagaatgaaaagcattgctacagattaaaaagactattacaatttgataaaagattaaaatattctgaaagatacagtttctaatttatatctgaagtctggtttaaatttttttataaagctaaaattaactgaattataaggggaagttaacaaattttcagtaggagatttgagcataatgttctctgttaatgattgaccaagcaggtcttaaatctgtaagcatgttggaaagttgagctctacaaatactgcacttgatata

SEQ ID NO: 134217 - DNA, 123 bp, Homo sapiens
attcataatagccgagaggtggaaacaacctcaaagtctataggtaaatgaatgaaatgaaaaaactgtggcgtgttcgtgcaatggaatactatccagccttattaaaaaggaaatcctgcc

SEQ ID NO: 134218 - DNA, 475 bp, Homo sapiens
cattttaagtcatctctgggaaagacttgctccttggcatttctttgggctaggtaaactgaattggatactgtgtgaactcattcatacatcagttttcttggctcacagtacagatttgtatactatttgatctttttaaattaccccatgccaactttaagcctgtactaagatttcatatagtaaaacattattttattcgggcacagctaatttaaagttacatatgtgcaacgctgaaatgtacctttgtactaaaagtttgataattacattaatagagtaaattacactgaagagatgtttcttaaatatcaaaaatgtccaaattaaagaacttccttctaaccactaaaactaccttggcattgatctgcttgcatttaaataatacgttaattacgaatggctcatattaaatttatcaaccaattcctggtgggtcctctacttgaaatcatgttcatataat

SEQ ID NO: 134219 - DNA, 491 bp, Homo sapiens
ccctcactctgtccctttctcttccgccttttccttctcgcctcacccacctgcctagctactgcccctgcctcctcctcggctcatttctgcccccatcctagcatttctgtgcttcctggtcctacctgtgccctctcccgactcctcggtggaatctgtgagctgccccttggcctctcccctgtcctcttgtctcagaattctcgttgaaaagcctccttgctggagagaaaaggggactgggggagatgagacccccgattcctgctctattcacttgctgagtgaacttgagcaagttgctttccctttgaggcctcagtttccccatccgtcagccagagttcggcctctgttgaggcctaaggtgttttccagcgttgtgattcactttttgttgcctcgtagcttgaccttaccaaagtttcccgtggcgcaagccttcaccccatgactcaccgcttccccatccgtctgaaccagaaata

SEQ ID NO: 134220 - DNA, 309 bp, Homo sapiens
gtgtgcttcctggctggctgtccctcctcagggcaagcaatgttcccaaagggaaaggccttccttgggaaggtgtaagggagactggcctggggtgggccagcctgctgggactcaggatgggggaggtagagggaaacacaaaggctggtcttggcgaggaagggcctttgtccttagggtcccagggaggccttggaggcattttcaggcagaagtggcaccggtgggtcagctgtgagtgagtgtggatgggaggaggtgaaccccatggtgagagggactggacctgcgtgtgtgggggtcggg

SEQ ID NO: 134221 - DNA, 342 bp, Homo sapiens
aattaatttacatagatctattgcacaaccatatgcaatagcaaacactaagagatgacatttgaattcctagtccttgcttagatgggaaggggattgtaagcgttttaactatcccctttctcaatgtaattgtgagaagattccatttagaagataagagagagactaaataaatttctcaacatgaaatccctattttaatacacaatataatatagtaaagtcactgaaatgactgtaagactgtgcagacattgagctattagatccagggacagcccagatcccctggggcctgtactggccacatatcagaagcctagagctctgcttaattgg

SEQ ID NO: 134222 - DNA, 740 bp, Homo sapiens
caatcagttagaccagaaattctcagaagggagtatgccttaaccgtaaagagggctagaagagctgtggcaagatgagggcatttacagccctatcttatccatatggacaggtgcccccacatgcgtccatttataggctctccacaagggttgcattccattcccagagctatgaaaatctgcatttctggcataggaatcttggtgatgtgaaacctccctgactgcatgtctggtcataggctctctgcagggggaagcacatcacacgctgttggctcattctggcagtccaacctggcattgtctttacacaatcctgcatgcaactttgtattcacaataatcaggagcatttcatcttttattccgtagcaatagtttcagggggtctgcctacaatgattattgtaaaaattcaaataaaacaaaatttttatcttagaaactgaaagttcccctgtcatctgaaccttaaagacaactattgttaatatattattatttcaaaaattgtgggccagcagtggctcacgcctgtgatcccagcactttgggaagctgaggtgggcagttcacttgaggtcaggagttcgagaccagcctggccaacatggtgaaaccccgtctctactaaaaaaacaaaaattaactgggtgtggtagtgcatgcctgtaatcccagctactcgggaggctgaggcaggagaattgcttgaacttgggaggtggaggttg

SEQ ID NO: 134223 - DNA, 466 bp, Homo sapiens
caccatcttgactgcttaccaacagaagcgccaaaaccaaacttgaggatgtccacaagcttgctctacacttctacattcatcctcatcttttttgtgtgtgtttgtggggtaggggaggtgcagtgtttactcagtgatctttctactttctagaaagtgtctgtccttcaaaactatttaagagcctctcattagtcattttttctcttatatgctctggttgagcttgaatagaccagttgttgcttaagaaagaaactgaaaagattttagcttttcagtcctatttggcagaggacttcagctaccttcttatggtctttggctgtgttggtgccctcatgtgctctgggctaagccacatactaaattgactttttggtttgtatacccttgctctcgccttctgatgaaaacaccttaccctcaccaccaccatctttgctctcctttcccaaaactc

SEQ ID NO: 134224 - DNA, 432 bp, Homo sapiens
caccttgatttcacacttctggcctccaaaactgggagataataaatttctgttgttttaagtcacctagtttatggtattttgttataataccctaggaaactaatgcacccaccaaataaaacaatgcccatctggggtgccaccaggataaggcgaatgtggaatgagtgatgggaaaagaaggctctgatgtatcagcttggccctagcgtccatctacagaggctgaaacagttacatttagttatgacttttccttgcattcttacatgaagggcactcatggtggccaatggcacgattcagatttaggtgaaactgaaatgacatcaccacatgatgacacatcggctgatcggagtttgtgggaggaaaccaatgtcctcagtgtcctccaagcaaaaggcaagaatgtgctgagaggcacag

SEQ ID NO: 134225 - DNA, 317 bp, Homo sapiens
cagagtagagatctcataacacacaaggcttatgacagggtcctcaaaaaaagtatcattaaattagaaggactaaattagacctagacagaccaggcacggtggctcatgcctataatcccagcaccttgggaagccaaggtggatggatcacctgaggtcaggagctctagaccagcctgaccaatatggtgaaactctgtctctcctaaaaatataaaaattaactaggcatggtggcgtacgcttgtagtcccagcttctcaggaggctgaggcaggaggaaaatgggaaattggatatgaaagaaatacaca

SEQ ID NO: 134226 - DNA, 415 bp, Homo sapiens
catcagcgccacctcatgttccttgctctgcttctttgatcttattttctaataaactctaatatagttgtggcatccttatcttctaacagagtttataatttactatgatccatctattccctccagtctctacagtagaaagtaagttctttgtaggcagaaagtcatgtgggttttgttcattggtgtaacccaagctccgtgggttcatggtgcatgactggcactcagtaagtagttaaataaaaggtgaactttcaaagtcatccactttatgttttgtaattcttagttgagagttctttgttagttaccctttaatcttaggcaaaggctttaaggctctcagaggcctcaaatcctgggcctgaacattttgaacctaccccaaaagaaacaagacctctatttg

SEQ ID NO: 134227 - DNA, 177 bp, Homo sapiens
ttttaccttttctgtgaaagggacaaaatcaaagtttagtactgagatttttgtaaaaaacactcaaagtagaaaaagaatttttttttcagacttttaacatgatgttctgtaacagttattttctttaaaatttggtatggtgttaagagaatagaactaagtaaatgtgaaatt

SEQ ID NO: 134228 - DNA, 432 bp, Homo sapiens
ccccctcgccataaaataaaatgtgggatgggatcaagaatttaaatctttgaaaggcacttcagccctcattttgtccaacctgtatatggagctaggatctctttctgcagtattcacaagtaccaacagtcccatctttgtctgcaaagacctttccactgattcacaggtctgttcttttgttccttattttttctttatatcaaacttaaattctctatcctccaattctcaaaccccaatcttagttatgcatcatgaggcttttggagaaaacctgcctaatggtctatctcccttcctgtgtattcaacctccccttttcagctggcattttgcatgagcattgaatcatggtcaggtcttgcagcttgctggggaagctccttacaccccttgtcctttcttcacctctcaccttctctctcc

SEQ ID NO: 134229 - DNA, 547 bp, Homo sapiens
taactgatcacagggaacactgattagtatcctaaacccatgaggttgggtcagttcaggcaccaagaaactataattttctcttgaaattctgattatctcaagttcctataggggttgtatcacaatgaatacaggtccttttaagagatttggtacactaaaatagctagattctgaaaatgcagaaacaaatgtgcagagacaggagaagtctagagcagggaaaagtcgagacaattccaaatgctcttttggctgaagcctgccccaacaacaacaaaaaaaagtagagatgtattttccctgtacttttgcccacgttattcagtgatggataataatttttccttccaagactattcctttaaggctcagttcaaactccaacacctccatgaatgtatatctaccccagtttccagatatctctttattttctgcataactgtagcacctactgtggatagcacccatctgacataagtatggacacatgtatatctagtttacttggagttctagaattctaaggaacctagaagac

SEQ ID NO: 134230 - DNA, 682 bp, Homo sapiens
ccagtctgtcaaaagttttggtaaactttaaaagaaacaaagacagtaaaatgtcagaaaatatgaaatacacaatatttgtcacatcacatagatcactggtagataaataactatagtatgatatggccaactaaataattttaaaactgctaaataatacaacttattcccagaaataattcccaattaggtaatcacgcttcattaatcataactcccaagttcacaaaagtatggcaaagctaacgcattcatgctctgctgacagtgtaaactcgctcaagtctttggggaggcaaaaatctggcaactgtagaaacatttatatcctttgactagtaattcatttgagattagtatcctatagaaacaattcataaaagaaaaaatgcacagagatgttcaattcaatgtcaaaataggcataaactgaaaactattattttcctgtcaggcatttagaacaaatttaatacttatttttcaactatcaagtaacaatcaaatatcataaaggttatacaacatggaaaaatacaatgctataaaagtaaaataaaacttatttgatataattctgtaaaaactgcaatatatatgcacaaactagaagaaaacaaaaataatgaacacaattatttgttagtatggcaaaacaagttgatatataaaaaaattg

SEQ ID NO: 134231 - DNA, 430 bp, Homo sapiens
aaatataattaaataaaatgtcctgtcagacgggcagaatacggaactcacatagatatcaagctggaaaatcacatctgtttcttaaatctaataatagaataaatataataaggaaataaatcactcacttcaaaaaatccactccgaaatactgatttaacaggctatctgtattataaccatagcccaaaagaggctctaaaataaggccttaaaagacaatcagttataatacacttagatgttcacaatccttacatctgttcaaatacagattttataatttataatcataaatttacaatctagtttctgtttgattcttgaactcaagaccagaattttaacttaaaccattagattaagtgtatgaggcacgttttcattttttttttttttttttgagacggaggctcgctttgtcgcc

SEQ ID NO: 134232 - DNA, 137 bp, Homo sapiens
tttcctggcgcacttctgccagctcccgggtgatgctggggtctcctgagcccctcgaatgaggccaggcaagcaggcgttatgccagacagccgccaacagtgtgcgtcgctgctttccataagaaaaggcgcctg

SEQ ID NO: 134233 - DNA, 496 bp, Homo sapiens
tctgacccacaggagacaaaaataactcagatgcccgggagtactttgagaataatatcacacttgtcaaagtgggtctaatgatgtcagtcatctttttctaccttgcatttcttcattgcagcttacactgacaaatgataccattcctatgtccacagttttctttgattaaaaacccacagagaccacaatactaatatgaccactaaggctgaggcttgaacgaaggttttattctccagaatctgttcaataaaccaatttgatttttataacaaaaaatgtgatacataatttgctcccccattcagtagagattctggacaatggcatcacagaatattggagctagaaagaaacttaaagattactttcatgttattttactgatgagaaaacagatgcccaaagaggaaaaataataactttaaggtcaaaggcaccctgtgggagaggaaaagtaatcaggatggctaacaggccctgggagaag

SEQ ID NO: 134234 - DNA, 569 bp, Homo sapiens
  misc_feature (33)..(33): n is a, c, g, or t
  misc_feature (112)..(112): n is a, c, g, or t
gtctcctagaggtatccccgtcaacgctttatnttcggctgtggctacttgaggaccagttaggagaggcacaagatgaaaagtgccctcactgttccctcgatgggaaganccttccctcactccctcaggaggctggttcctcccgcaggttgctcagcccagaggccagctggctagagcagtcccactccactgacaccctccctgagtatccacatccagcacattataatagttcaggaaaaaggtgatgagagaacatgctaatggagatggagaggagtggggaaggttttaagaaatatttaggaggcaagaatagaaataacttagtgaccaatttgagaggtttgacaacagagtagaataggtcattatcttaccaagctagaacaataaaagagtgagtttggatgcctgcaaggataattgactaagttgtagacctggtgtctgcgttttgtgggtgaccaggtagagaggtacagataatggaaacctgcagtttaggagggatgtcaagattaaaggcagaaagctagacttcattgttatatgtgtgcact

SEQ ID NO: 134235 - DNA, 416 bp, Homo sapiens
tccatcatattttggcctagctgtcaacagagttgacaacctcccttacaaagtttgaacctagaatctcaaatacatttgcttgaggaaatacaattcaaaaatctgccaacgtgtttgtttagaagaaacaggtatggccagtatggtagcttatgcctataatcccagcactttgggaggctgaggtgggaggattgcttgaggccaggaattcaagaccagcctgggcaacatagtgagacccccatctttaaaaaaaaaaaaattttatcaaaagcattagccaggcatggtgttgtgtacctgtagtcccagctactcaggaggctaaggtgagcccaagagttcgaggctgcagtgagctgtgattatgccgttgcactccagcctgggtaacagaagaccctgtatca

SEQ ID NO: 134236 - DNA, 574 bp, Homo sapiens
aatacatgaggatttattataccagtatactctggggtacatttgaaaattcttataagattttttaaaagtcaaattcaatattgtatctactctaaaggctactttctcaagaccatacaccacaaatcatgaaacatcaatgtagtgaaatataatgagacattaaaatttacaaatatgtcaactatttcaacacaccaaaatgtatacatgaaatgttagattaaaatccacgatgtaaaatctatttacgctaaccaaaatctgagttttaagcttcactcagtacaacaatctctctcctaaaatcagcccatgtctaaaacttcagacattcctcaaaatttacagaatataaaaacttagccacccgattgtttaaagtgaggttagttcctaatacctcatagtatcaaaccaagtataatccaatttaggtaactctaagggtgatatagacttgaagacacatgggaggagaattcccatttactaacacctgctatttgctaatcatacagtatctcatttaatcttatattatctcaaactcatgcttccatcaaataaa

SEQ ID NO: 134237 - DNA, 553 bp, Homo sapiens
atgtgctgggattatacatgtgggccattgcgtcctccctggaccgagattcttgaatatgtagtgcccagcaccagcaggaagtcagtgagtagatttgaccattggttggatgtatatctgtgacttagggtccataaagatcttttgaagaactgggcactaatcccaacttcgcattagacaatgttgccaagcaggtgggttgttttttagcatatttgagaagggggaaagagcccactaactttctgggcaaatttgggcaaattaccaaccattgtgggtctcagtttcgactgttaacagggttgcctgagcattgccagtatatatgatgaagtattggccaggtgtggtggctcttgcctgtaatcccagtctttgggaggtcgaggcgggaggatcgcttgagtccaggagttcaagaacagccgaggcaacatagtacgacctcatctctacaaaaaataaataaaattggccaggtatggtggcacatgcttgtagtcccagatactcaggaggctgaggcatgagaattgcttgagcc

SEQ ID NO: 134238 - DNA, 272 bp, Homo sapiens
ggctgaagcatgagaatcaattgaactgaggaggtggatgttgcagtgagcccacatcatgccactgcactccatctagcctgggcgacagagccaaactctgtatcccaacaaaaaacaaacaaacaaacaaaaagatgtaatgtctcacctatgagattagcaaaaatccaaaagtttgacaatcctctctcagcaaagccttggagacactccaacattaggcagacactctaacattactgatgacggcactagctctagggaacgac

SEQ ID NO: 134239 - DNA, 540 bp, Homo sapiens
gaaaaataataatataaaaatatccggccaggcgcagtggctcacgcctgtaatcccagccctttgggaggctgaggagggtggataacctgaggttgggagtttgagaccagcctggccaacatggtgaaatcccgtctctactaaaaatacaaaaattagccgggcatggtggtgcatgcctgtaatcccagctattcactaggctgaggcaggagaatctcttgaacctgggaagcggcagaagttgcagtgagctgagatcacaccattgcactccagcctgagggacagagtgagaccctttcccaaaaaaaaaaaaaaaaaaaaaagcattacaagttggagtagcctgggctcccgtgttggctttattactgagctgtgtgcaggtggatgttttgctaaatctttctatgttccacgttatcaagaccctttctctcttttcccaaagctctcgtatcaattccatttaagccaaatctcattatttcattgcttttttttttaattatcctatttttaaaattattctcc

SEQ ID NO: 134240 - DNA, 426 bp, Homo sapiens
cctccacccacctctctacctgcccaggctccagaaagccaaaaagagctggagtcaatgaccttctccagcatctgtgtaaacctggaaagttacttacctgttttaaaaaaagaggaagacaatatccatagtacagatattttcccgggtaaggattgtcataataatggcctgtgaaggcccttagcaaagtgctggcataaggcaagcgtgtaataaataactactggcatgaaggcctctggtgatcagattagccctctgtgactttcccctcccctgggttcccataagaaatggctgaaccactcctttggcctttttcaaacacagctttgtaacagttgccaattttccttctatgagtagctcatttccccaactgcaatgcaaacaatgcttatcactcaacaaatatttgct

SEQ ID NO: 134241 - DNA, 282 bp, Homo sapiens
gcagctctgtctgcaccaggaggacaagccaggctgggtggccaaataaggcccgaacctctgccaccagctcctctgccaccagctccttctgccaccctgggcaaggtcgcaggctggtgtcgcgtctgtgtgtgactgttattctgtatgtgactgtaactgtatagctgtgttattctgtgtgactgttattctgtgtgtgactgtgtgactgtgttattctgtgtgactgtgtaactgttattctgtgtgtgtgactgttattctgtgtgttactgt

SEQ ID NO: 134242 - DNA, 429 bp, Homo sapiens
gcagctctgtctgcaccaggaggacaagccaggctgggtggccaaataaggcccgaacctctgccaccagctcctctgccaccagctccttctgccaccctgggcaaggtcgcaggctggtgtcgcgtctgtgtgtgactgttattctgtatgtgactgtaactgttattctttgtgtgtgactgtgtgtgactatgtgtaactgttattctgtgtgcgactgtgtgttactgttattctctgtgtgtgactatgtgactgtgtaactgttatctgtgagtggctgttattccctgtgtgtgactgtgtgtgtatagctgtgttattctgtgtgactgttattctgtgtgtgactgtgtgactgtgttattctgtgtgactgtgtaactgttattctgtgtgtgtgactgttattctgtgtgttactgt

SEQ ID NO: 134243 - DNA, 692 bp, Homo sapiens
gcctcttcaaacaaaataattaccatccaataatttcatatccagcaaaactaagcttcataaatgaaaaagaaataaagtttttcagacaaacaaatactgagagaatttttcactaccaagtgaacactacaagaaatgctaaaaggagttctaaatcttgaaacagaatatcaaaatgcacaaaaatagaaccttcttaaagcataaatctcacagaacctataaaaaataccacaatgaaaaaaatctaaggtattcaggtgacaactagtatgatgaagtacctcaaatctccatactaacattgaatgcaaatggcctgaatactccacttcaaaggtacagaatggcagaatggataaaactccaccaaccaagtatctgttgtcttcaagagactcacctaatgcataaggactcatataaacttgaggtaaagggtggaaaaaaatattccatgcaaatggaaacaaaaagcaagcaggaatagctgtccttatattagacaaaacagactttaaagtaacaacagtttaaaagacacagacagacattatacaatcataaaaggatcagaccaataggaaaatattataattgtaaagatacgtgcacctaacataggagcctccaaatttataaaataattattactaggcctaagaaataagataaacagcaacacaata

SEQ ID NO: 134244 - DNA, 527 bp, Homo sapiens
tagccagacagagccccaactgaaagtgaagagaaaacaccttccctgttagggcaacttcattacccttgtgcgtggtgtgtgtgtacttgcacacatacacagcccatcaggaaaatatcacagctgtgacagcagctttgtcagagggatggaatgatacatggtgtttctcccttctgtttttccgggatttgtaaagaggagacactattttcatcattgaaaacagtgcatattctaagggacagttcatccccgccttgtcctttgacctgctgtgcggtcctgggcagcttatcccacccatggatttggtttcctttattgctcaagtttggctgggggattttcttttggtttcactcccgccttcagcatgaagctgcagtgatttttcttgagtgggtgtgtggagtggggacagatgcaggagtgggagctgtgtttctagcctcatggtggttctcaatgtctgagctggttggacgacactgccctggaccttggagaagcctgtcctggac

SEQ ID NO: 134245 - DNA, 401 bp, Homo sapiens
caatagaaccttctgcgataatgggaatgttctctatctgtgcggtcccgtatggtggccactagctgcaatgtggcaaccaagcacttagaaagcggctaggtgctagggcaatggaggagctggattttacattctatttcattttaatttgtagcagctacctgtggctaggggccgctgtgccggacagcacagctctagaggcaccgggaggaagagactgtgagataggaattatttttctcattttgtctaggaggaaactaaacaacagagtggttacaacactggccagaaatcacagagctagcaggaggcagagctgggactccagctgagatccgagcaagggtctgagctcatccatcacacctgggtgacttcagactctgtagtct

SEQ ID NO: 134246 - DNA, 936 bp, Homo sapiens
tctacctaagaggtaacatgttagcataggcattagacaaggctgcattgtgaagtcagagtgactgtctggggttgtcactgtcatcttccaagctttctcctaaagaagaaaattgacataatgctctcagacttggcacatgggaccagtgccacagcaagcactggttctagcctgctactggtttttggtaaaatgcagttttcagaactactcaagggtgtaataagattaatttttatgatattagatataatatgttaactttttagctattgttaatcttaaacactgatggctttatttttattctatttaaaaaaataatttttgaggccagaagtgctgggattgcaggcatgagccaccacgcctggccctataaccgtttttgagatttaaaaactgaaggtcatgtgattgtgtaaatatttaaaaagtgatcatattaaaaaatatcatagtgatggcacattgataagattcaagaacattttgggcaaggcaggcagtcatgaggatctccttaagcagtctcttgtgaagtgatcggtaactgaattttgctttttgggtggtcttcaattatgtctgctttatctgttaggtttcactagctattacattcatgcaactccagaaatttacctccaatttatatgtgacttacaacattttcttatgtctggtaaatatttgaaaggattgaattacaaagagacggataaggccatgaagctaagacaaagttttgggtatgtgcatgtaaatgcaatttttctcaggaagaaatacaccatgatcagataactcaaaagttttataaccttgataaatagatttaccttcgtttctgttgtttttgaagaagttaaatgtctgctttaaatgtttccctgagtttcaagttttcttatttcagactcataatta

SEQ ID NO: 134247 - DNA, 268 bp, Homo sapiens
tccccttcgaccccaagttcatcacctaccccttcgaccagaacaggttcgtccagtacaaagccacttccttggagaaacagcacaaacatgacctcctgactgagccagacctgggggtcaccatcgatctcatcaatcctgacacctaccgcatcgaccccaatgttcttctagatccagctgatgagaaacttttggaagaggagctgtagttgccccctacctctcccacctcttgctcttcaataaaatgatcttaaactgc

SEQ ID NO: 134248 - DNA, 150 bp, Homo sapiens
cccattctcagggaggcgccaggaagatggggtttacttagtctccatcctcctggcctcctgtctgcagccctccctgactacccacaggtggcctggtgcttgccctgagctctctcagtccctgggctgcccacctttgctgatagg

SEQ ID NO: 134249 - DNA, 795 bp, Homo sapiens
tgattctcctgcctcagtctcccaagtagctgggagtacaggcacgtgccaccatgcccggctaagttttgcttttttagtagagacgggatttcaccatattggccagggtggtctcgaactccccgaccacaaatcatctgaccacttctgcctcccagagtgcttggatttcaggcatgagccaccgtgctcagcctgggattttgcatttcaatctttgattcattttgagttgctttctgtacatggtgagacacaggggcccagtgttatttcttctgcatccagctagccacttatcccagcaccacttactgatagggagtcctttctccatcgcttatttttgttgatttttttcaagcatcagatggtttcagttgtgcgggtttatatctgggtcttctaatctgttccactgctctgtggaaccgggtccccagcttttcagtgaaaatgccaagccattacattgtctatggatgttttcttagagtgtttcctttgttttaatgttttgtttatacctttagcaggctgcgtgcatggatttcttttctaaaatacatgcgcaccctgttttcttgtgggagttttgtggtttcagaattgagttttaggtctttaatgtattttgcattgatttttgtgttgcatgacataagggtcctatttcagtgttttgtatgtgaatattcagtttgctcaaaatcatctattaaacagtctctttttcccattgtgtctttttggtgttcttttgaaaaaatgtgttcactatatgtaaattgg

SEQ ID NO: 134250 - DNA, 675 bp, Homo sapiens
gagggtgggtgaaaacacaggccctagtgtcaggctgctgagattcaaatcctagctctgccatttcccagttgagtggccttgagtaagctgtttacctgcttgatgtctgaggctaccttcagactcaaatgtggtgtcacctcattcccaaactcattctaaccagcttcttacaagcagcgtgattttgtgctatttctgaaatttcttctcaatctttttattttggccaggttatttacctttagtgaattccatcttctgaaaacaatgcttttgtgggtcttcttgcaactgaactacaagattcaggcaattccgacttatgaaaccgtgatgacattttttaagaggtaatataacttagtgttgattgatgaaatacacaaatactgaaatgtacaaacactgctcataatatcacgggggaaaaccatcagtgatataatttttcatagcatcattcagagggcactgtttttttaatagggcctaagattataggatgctttcaaaccaccaaattacctggaaaagtaaacaacatgtaggtgttgtactatgagataatcaggtgcttctgggaacttgctgtgtccagtaacaggcatgaggcaaaaggtactcctctcttcaggaaaatgaccacactaccctggcctttaaaacttc

SEQ ID NO: 134251 - DNA, 491 bp, Homo sapiens
tgtcctagttcttgtcctagtgctgaatttatgtgtgtcttcttttcttatgagatgtgagtcaagagacaatctgtctcatgaaactgggaaacattaatctgtcttgatctcacttgagttccgattgttcttctttgttaaaatggaatgctgaactattaacaatttactttctgtcatttgaacgtttgaaaccatctccatttggctgatggtaactcctatgtctccaggattcattccgatctggtccaggaattttttcttatatttgattgatcatccctaacttcaggtgagataataaacattcatcatgggtagaagtcataaggcttggttctagcattggtcctgtcttgctgggcaccatcaaacaattattgattgtggttctactctgctacatgcctacatgagctccaagtggtatgcctgaggtggtccaaggtgggccagccaccaggtttcagttttcctgggtagga

SEQ ID NO: 134252 - DNA, 152 bp, Homo sapiens
tcctgaaggaggagtggaagttcaccaagaggagaagctggagaaaggatgcacctgctgtttcctgtggagggggagcaggtggagaccaggggccacagtggtgacccagcattagcgtaccccatgttggcttctccttccctatctca

SEQ ID NO: 134253 - DNA, 436 bp, Homo sapiens
gcctgagcctcccaagtagctgggattataggtgcgcaatgccatgtccagctaatttttgtgtttttagtagagacggggtttcaccatgttgcccaggctggtcttgaactcctgggctcaagcaatccacctgccttggcctccaaagtgccgggattacaggcataagccactgtacccggccccaactaatttttgtattttttgtagagatggggtttcaccatgtcggtcaggcttgtcttgaactcctgagccgaagcaatccacccgccttaccctcccaaaggtgctcagattacaggcttgaggcactgtgcctggccatgggtgccatctatctaaagagtgatgaacttggtgttaaaccagtaattgaaatcaccaagttcctaccatcatgagctcagtctagtggaggagacagatgaac

SEQ ID NO: 134254 - DNA, 370 bp, Homo sapiens
ctagaggaccccggcactgcttcggatgctcaggtatcctttgctattcaagtcgatggtccaatcctttgtccttactccacccctattcttcctagagctaggagttccttctcctgggatgttatctacatatcccaacaagcccctcctgagtgcattaacagaaaacattaagaccaagcaggacccatttctgcatcagccacttaaagctgttcttcctgggacatttgtcgaccttctccagcttgtttccatttcagaagcagtgctaagacccatgccaggatggaattccattttcaaatgaggtttcacaagactttttatcagacttgcagagcaattacattggctgggttctctc

SEQ ID NO: 134255 - DNA, 712 bp, Homo sapiens
gaggggggcggggcagccaccaagcactcactgagtcccagggagtcaagatggcagcctccaggaggccacacaggaccctgagaaaacagaggagggagacagcccagaaggtgcactgggcaggtgaggggagaggcacagctgcggaggtgtgctggccccgccaccctgtgaagtcggctaggaatggtttcccagaagtggataaggaccgatcactttggatttaaccttgagaagaggatgaacctgagatggaaatgaaggtttcctggggcaggagggacacattcagagggctctgagcctgtctgttcttcagaaagacagagagacaacatttgcagggccctgtgaacctacccgctagggcctgaagggcctgataggcttggtgggcctgatgggcttgatggtgggaagtagagagttgacccttcttactctcacccttgaagtttgcaatgctgggaagcacattagattcacccacagagctttagaagaatacccaggcctcagccccattccctagagattctgatttaatatgggtgaggcatgaggcccggacatcatcccagaaaattccagtgtgcggccaaggttgagaattcctgacctagcccatatgtggccaagaaacaagcacccctggtcccagcccctgctccatctgcctctgacttctcctctcctagggtccagg

SEQ ID NO: 134256 - DNA, 289 bp, Homo sapiens
ctggggtgcgcggggtgggcagagcggcggcgccattttggctggagctgcggggctgtggtgggtgactccgtttccaacgtgcgtgtcagtccgccggggcctggagggctgcgcctgcgagtctcatcccccactggcggttcgcgccggaatttgtctcaagggctttaatgcttcggatcacttatccctttgccagctgctgttcgccctcgaatgtccattttggtctgtgcttccacactctctttaaacatggtcttgctgatgagagcgcccggcgcgt

SEQ ID NO: 134257 - DNA, 257 bp, Homo sapiens
tgtggttcttgctggccttcggctcttttttctttgggtggatccctcttcagtagaaatatcaaataagtggtctgtccactgacggcggaaagctttctcgggttggtggatctttctggtacctcctcgggggaagctttcttccagctttggccattgggagctctttcagttgactcctagatccctttgacatacccccatcattaggagcaggagagagttctctgttcattactttgatcattttctta

SEQ ID NO: 134258 - DNA, 688 bp, Homo sapiens
gtagtcccagctactctcagaaggttgaggcaggaaaatcgctcgaactcggaaggtggcggttgcagtgagctgagagcacaccactgcactccagcctggacgacagaacaagactctgtctcaaaaataaagtacaggcatcaaaagcaaacatagacaaatggaattacatcaaactgaaaagcttctgcacaaaaaaacaacgcatgaagagataacacacagagtgggagaaaatatttgcaaactatacatctggttaatatccagaatatataagtaactcagacaactcaatagcaataaacaaaaacaaaaacaaaaaacaaaccaaatagtccaattttaaagtggaaaaaagacctgaatagacatttctcaaaataagagttacaaatggccaacagatatttgaaagaatgctcaacatcactagtcatcagggaaatgcaaatcaaatccataaacagatatcatctcactccagttagaaccattattatcaaaaagacaaaagacgagtgttggcgaggatgcagacaaaagggaacccttacacgctgttggtggaactgtaaattagtacagctgttgtagaaaacagtatggaggttccccccaaaattaaaaatggaactaccatatgatccaggaatccaactactaggtatacatctaaaagaaa

SEQ ID NO: 134259 - DNA, 212 bp, Homo sapiens
caaggcaaaacttactatttccccatggaaatgtacttcttcttttattctcaccctgttgatagataatagttaaaattgataaaaatagataagaaatagataaaattgtatacagataaacaaaatagataaaagagttaaattaaaaaacaaccactttgtaaatcttctcttttattttgctgttcgtctgctttgtgctgtggaag

SEQ ID NO: 134260 - DNA, 660 bp, Homo sapiens
gaagttgataagatcaaatttgcattttagacatatctttctattggtgatgtgaaggatggagaggagtccagaagagaaattgtgaaagttgactgtcaggcagaatgactggaggtggtgaagtggggatatatgtgaaatctctcagatacagcatcaatagaacttgtgggtaaatgcaaaagatgaggtaacttagtatcccttgaaatgaccaagtccaggggccttttaccagcatagttttcatgataccactgttgcttttattcactctctaagtggaaactcttcacatgagaaacataaattaacttgtgggaaggcctgggagtgggtgcagagactctgggcccccaaaactgctgagtcctatactcttctacccaagtccacaggagcacacacaaccatggcacccttaggcaagtatgtgtccttccactagcggcacgccctcacgcttggtggtagcatcccagctgtgctccaggcaccctctggccctttagctgcatctcccacacacctgccattctcagaaacctgctcctgctgccatcactccaaatcagaaggggtacctggtgagctggtgagtgtcggactgtggggatgcaccatgagggctgtagcccagcaggattccagaaagaa

SEQ ID NO: 134261 - DNA, 940 bp, Homo sapiens
gaaataaaaatcaaaagcagaaactagcttaagttgctacagtgatgaagaaaacaaaccagctcattactttaaaaaagattcagtgaaaaccacaattgactaagcttgaatttttcttccttttcctagctgactcaaaagcaaacacacaaaagcctccagctagagtcactgttttttttttataattaatcattaacaaaacatttatgaaaatccaaatggttttaaaattacttcaacctggttctcttaatagggtttgatttattcatcagaaatctgatttccagctgtactctctcacttttcagcaactatttataaaataaccaagagttctaccacaagcacagaacccccagaaaagcaaaaaggcctcagaacaactcttaatattcatacgttaacactcttgccacttactcatcagatcatattttttcacttaatattaatgtactttctaatccacaataatgtagcgtaacttaatttaaaatgaggagaggaaggttagaagcagggaggaactattaatgaccacccgtaagtaatgaccatctgaaatactatgtctcagataaaaattcagacattcagcatggggaaggagcactgcatataggagctaagaaaaagtacacactttaggctgggtgtggtggctcatgcctgtaatcccagcactttgggaggctgaggcgggcagatcatttgaggtcaggagttcgagaccagcctggccaacatggtgaaaccctgtctctactaaacatacaaaaaaattagctgggcgtggtggtgcacgcctgtaatcccagctactggggaggctgaggcaggagaattgcttgaacccaggagacagaggttgcaatgagctgagattgcaccactgcacttcagcctgggtgacagagtgagactccatctc

SEQ ID NO: 134262 - DNA, 908 bp, Homo sapiens
aatgagttagctaagaggtttgcatattttacctgtataggaccagacagcaaatactttaggttttctgggtcataaggtgtctgtcctgactactcagctctgactctgtttcagggaaatggctgcagataatatgtagatgagtatcagctgtgttctgattaactatttatttatttatttatttatttattttgagacagagtctcactctgtcactccagcttgggcgacagagcaaaactctgtctcaaaaaaaaagtcagttagcattgaaacatgcatatgggaaaaacttgcatcaatgaagaaatatactcttaatcagaacaggacaaataacctaaagaggagggaatgaagagcagtgagaggcctgacagtgggaaaacaatgcctctcgggttggaaggcagaaagccaaaaatgcgaaagatacaaatgggtacgaagattggagtaagaaaaaagctccttggaaacaggagagacatgattatctcaaagagaaagcgagaggcatgtttggaatctgaagctgaaaacactcaaaagacagatacacagattgaccagaggcttcagagataggcatgagttgaatgacatgtgcagacagcacagcaggatgagcaatgcacggtgaatgtgaggctgaaatactcagaatcatgatgaaagaaaaacacaaaccaggtacactaaggcaaagctgggtgagacagtccaggagacaagtcatacagctttgtcatggcacaacaagacgcaaataggtgagacctaagggaggagaaaaaaatctcaggtgatggctacatgggcatttttatttacttatttttatttatttatttattttattttttagacagcctgggcaacagagccaagaccctgtctca

SEQ ID NO: 134263 - DNA, 607 bp, Homo sapiens
taaccaccctcctctttccttatgcccttgtctgctccagccatgcccatctctattcagttcctccaacccgagaggcattgtttcccactgtcaggcctctcactgctcttcattccctcctctttaggttatttgtcctgtcctgattaagagtatatttctccattgatgcaagtttttcccatatgcatgtttcaatgctaactgactttttttttgagacagagtttcgctgtgtcgcccaggctggagtgcagtggtgcgacctaggctcactgcaacctctggttcctgggttcaagcgattctcctgcctcggcctcagcctcctgagtagcgtgaaccacctcacctggctgattgttgtatttttagcagagacagagtttcaccatgttgtccaggctgatcttgaactccaacctcagtgatccacccacctcagcctgccaaagtgctgggattacaggtgtgagccactgcgcccggccacatgggcattttttaaatgcctattaggggcgagtgaagctggttctggagaagggatctctgggaaatagtgaattatataccttagacaaagaggctggagaacagtgaa

SEQ ID NO: 134264 - DNA, 349 bp, Homo sapiens
gagacgggagaatcacttgaacctgtgaggcggaggttccagtgagctgagatcggaccactgcactccagcttgggcgacagagcaaaactctgtctcaaaaaaaaagtcagttagcattgaaacatgcatatgggaaaaacttgcatcaatgaagaaatatactcttaatcagaacaggacaaataacctaaagaggagggaatgaagagcagtgagaggcctgacagtgggaaaacaatgcctctcgggttggaaggcagaaagccaaaaatgcgaaagatacaaatgggtacgaagattggagtaagaaaaaagctccttggaaacaggagagacatgattatct

SEQ ID NO: 134265 - DNA, 177 bp, Homo sapiens
accgatccggattaaggggccggaggcgggtcctgggcaccagcggttccgacccccccgccctccgcgccgcacccgagtggcccccagccgagcgggcccccacctcctggcccggcctgggccctcctgcgcctcccttggcctttgtccggcgccaggaggccggtcccgcgc

SEQ ID NO: 134266 - DNA, 316 bp, Homo sapiens
acacaataaaaagagaaaatgagcataaaaatctaagaaagatacccatgcttaagaagtggatcaaggccggacacggtggctcacacctgtaatcccaggactttgggaggccaagtcgggtggatcacgaggtcaggagttcaagaccagcctggccaagatggtaaaaccccgtctctactaaaactataaaaattagccaggtgcggtggcaggcacctgtaatcccagctgctcaggaggctgaggcaggagaattgcttgaacccgggcggcagaggctgcagtgagccaagatcgtgccactgcactc

SEQ ID NO: 134267 - DNA, 473 bp, Homo sapiens
gtgactcaatacacataaagtgcttagaagagtgtccggcacaaagtcaatatttggaaatgttagcaatcatttggaaggtgcttgacgcacagcgttgatcgataaatgggacctattcttcttggtagcactgctggtctagagcaggattctggtttctgagctctccctgctctcaacctccactccaccccatcctgacttaaaattaaggactggaaatatctctagccatttatggtcacaggtaatggaggttcaaagtgtgtctcatagagtgatgagaaaagtaggagtctacactctgagccagatcccaagacgctattgagcagagtccaaaaggggtgaggcccaagaggaaagcagctgaggggcagagctgtgggaactctgctacagaagtgattctcttaagagaggcagggggtggtggggagagttcagtgagcagaactgtgagcaggcgg

SEQ ID NO: 134268 - DNA, 447 bp, Homo sapiens
gtagtaggcgaggggggcagatcacgaggtcaggaggcacgaccagcctggccaaagagaccagcttggccaacatggtgaaacccatctgtactaaaaatacaaaaatcagccaggtgtagtagtgcacgcctgtagtcccagctactttggaggctgaggtgggcagattgcttaagcctgggaggtggaggtaacaatgaaccatgatcatgctactgaaaccagcctgggcaacatggcaaaaccccatctctacaaaaaatacaaaaaattagctgggcatggtggcgtgtagtgcaggttatttggggggccaaggtgggaggatcagttgagcccaggaggtcgaggctgcagtgagctgagattgcaccactgcctgagtgacaaagtgagaccctgtcacaaataaacaactttctactgttagataaccaaataatt

SEQ ID NO: 134269 - DNA, 689 bp, Homo sapiens
gatttgcaactaactcaccactgcccttctgatcaccaaattcatatacctttcctacttcctcatacctcttgacaaaattggtacattttaccttctttatgattttctccatgcatctctttcttttctctgatgtatatcaagtatatcattggcaaaagcattggactgatataaatcagaagacctagattcatgacttaggctctgcttctttctaacggtgattttaggcaagttttaagtttaaatactctggacttctgtttcctattttttaaatttgtggcaatacttaggttcttacaggagttaaataaattaatatatttgaaaggactctgtaaaacctttgattatgttaagggacacatagtctaaagagtcctgacttagatcacaaaatgataaggcccttgagcatgtaaaaaaaaaaatgtattcaagcagattgaagttaaaattaagaaatgtcaaccaaaacacttaggtaacagttctaagaataacattggacccttacttatgaatcttagcccttattatcccataattattcatgaacaaatttacccctgttattctatgagcttctagaatacagaatcctatcaaatttatctttatatcttcctacaatgccttgcacaaaataggtgctaaataaataccttcaaggaatgaaa

SEQ ID NO: 134270 - DNA, 687 bp, Homo sapiens
gcatatatctaagcagaaggtagataatcctgaattatttcattgaaaattcccatttttaattcacctttttctaagcattgtaatttaataggcatttcacttttaaaacagcagagtgaacagaataaaaaagcattagtagtagaattaccaactcttagctaacttagaattattatttgtaattataatgtatttttgggttattagaaactgcttttttggttaagatggaattatttttaagaatttctcttttgttaaccaattccatctagaatcctaattctggatgaaattgtattagtgatatgataggtgttacatgttactgcttattttccaatattaaaaaaatcggtttttagtttcagtggtagacttaatagttatagtgaattgacttggttactttagagactgattcaagattgaggttactgtggggattcatttgtgtgattaaaataatcttggttttcttaaatttttttgtaatgcactggacaacatgctgaaattatggcttattatattagtgaattttgtattcctgaaacagcataccaagagacactagaacctttgacagaacttttctgaaacccaaatgaatgccaaaattaggcatgcttttaagatgcaaagggctgggttttatcttttactgtctttcttgcttat

SEQ ID NO: 134271 - DNA, 307 bp, Homo sapiens
tgatattcaaaaaagaaaaagattgatgctcagtgaatcaaagcaaagtactttctaggtaaaagtgacaccatctcatccaatgtctctgaaagatctcagttgcacagtctttggataaaaagggttataactaaataatactacaaaatgcaatttacacaatgtgctgactacacatttgtatacccagcatttattaatttgggaagcaaccaactactgtaacttctctttactttttcataagaaaatgacaatgaggaaggaagtgcagcagaaatcttgaacattaccactattatgc

SEQ ID NO: 134272 - DNA, 229 bp, Homo sapiens
gtattgttttgattattactatttctggtaacacaggcccatcttcctttcacacagcaggtaaggttgctcaggctgggactgttacgtcagaataacaaaagctaagcactcctcctgaaaccaggttctctcatgtcttgagtgtgctgtgcctttataatgaaagaaagctcgaggaggagtagggtcagctgccatttattgcccaacactgtgctgctagtgt

SEQ ID NO: 134273 - DNA, 277 bp, Homo sapiens
atgacagtcatttgcacaaaactaaatatatcatcaagtctgaaatcctgaacttcattcatggcttaatttattttgtgatcagatctaaaatattagcaaatatttcacactagaaaactgtgttttatataactactgtttagcatatgagattttattccgtaaaaaacatccacagccattaaatatagaattctaaaagacacaaattatcctacagacatgtaacctataaatacagaatacacattttgtatggccttctttttttgag

SEQ ID NO: 134274 - DNA, 279 bp, Homo sapiens
ggatcctattatatgctgtctcattgtagttttgatttgtctttctctgatgactagtgatgatgagcattttttcatgtttgtggctggttggatgtcttcttttgagaactgtctgttcatatattatgcccactgtttattggggttgttttttgcttgttaaattgttttttctgagacggagtcccgccactgcacccagcctcaatatttatttcaatacagaaacggacttaattgggtattttgttgaaggcaaatagtagcaaagtggga

SEQ ID NO: 134275 - DNA, 783 bp, Homo sapiens
acaccagtcactttgttggccttgagattgtgtttctggtctgcctcagcatctgactttccaccccgggatgcgtttggtctgttttgccagttagagaactggagacacctgagcctgagctccttcctaatggttacatttccctggtagcatttgtcactagggcttctaaatttggccatcaggatttcctcaggcttggaaggttaacacatactgcccaagagggaggcaatataatgtaacatgggtgcctcagcttcctcatctgcagaatgggctgaggataatacctcgtcacgatcacccggaacagggcctggcatactttacctagcgactttgtagggacttagtgaatgttccccaacagatctgtcacagaaactgtaaatattgcccttcaccccttccgcacctcttgcagcagtgttatccaggaaggttggaaaccttaggagatgaaggggcccttttctcagggcactccaagagaaccctctcagtgtcttttaaaattgtcaaggtcccagctcatagcagttcctcataaaataccattcctgtgccgggcgcggtggctcacgcttgtaatcccagcactttgggaggccgaggcaggcggatcacgaggtcaggagatcgagatcatcctggctaacacagtgaaatcccgtctctactaaaaacacaaaaaagtagccgggcgtggtggcgggcgcctgtagtcccagctacctgggaggccgaggcaggagaatggcgtgaacccgggaggcg

SEQ ID NO: 134276 - DNA, 688 bp, Homo sapiens
aaatgctcatttttgaatgaagaagccaatgaaaacactaaaaatgagtttgaaagtgatctctaatgtgtgactcaaggcatcggtaaaattagctaggaacacactatgcaatttagaaaacctggttgacttttataaaattacttttcattgtgattttaaaaatacataacataaaatgtaccattttaaccatttttaaaggtacagttcagtggcattaaatacattcacattgttgtgcaaccattaccatcattcatctctagaaccttttttcatcttgaaaaattgaaattctgtactcattaagcaataacttctcatttctgtcttcacattcagaccctggaaatctactttttgtctctatgaatttgtactctatacctcgtatgagtggaagaatgcagtatttgtccctttgtgaccaacttatttcacttaacatatcttcaagattaatatatgttgtagcatgtatcagaatttcctttctttttaaggccaaataatattctatggcatgtgcataccatattttgttcattcatctaactgtgggcacttgagttgcttccttccatcttcagttattgtgaataatgctactataaacataagcgtgcaaatatttctttgagggttttctttcagttcttttgggtatgtaaccaagagtgga

SEQ ID NO: 134277 - DNA, 351 bp, Homo sapiens
cctctggcctgaaagtgctggagtcaggacttgaacccaggtctgtataactgatcatgtgcttgctacctcagcaagaggaatgtttacaagacaaggacttatctcacagttgtcttattcctctcttggtgttttgaatagccattatccagtatcttttgaatatatttcaattgttggtgcagctgtaatttacttaataacttttaaacatagtgaaatgaagcacatagatatgtttctttttttttttttgagacggagcctccttctgtcacccaggctggagtgcagtggcatgatttcagcttactgcaacctccgcctcccaagtttaagcgattttcc

SEQ ID NO: 134278 - DNA, 206 bp, Homo sapiens
caggcctccccagtggggattgctgtcttcccctccacacctttactactcctttattttattactgctgggcacgtctgtcttgttaccgagttggcattgattttagacggctggccctctgctttgtaagttcccagagggcaaggtccctgtataactgtccccactctagttagcatttgggaaacgctggttggattgtg

SEQ ID NO: 134279 - DNA, 275 bp, Homo sapiens
gctgatcacagtcatgagcttactctggtcagagatctctatgagctctgagtactggattcagggcattcacatgccgtgtattttttctagttaagagaggagggtttctccatgttggtcaggctggtctcgaccaactcctgacctcagatgatctgcctgcctcaggctcccaaagtactgggattacaggtgtgagccattgtgcccttaaaccttccaatctatgaacatggaatgtctttccctttatttatttttatttttatttc

SEQ ID NO: 134280 - DNA, 426 bp, Homo sapiens
gtgagatgaaattatgtgaaaaagaaggcactcctttaccatttatttttcaattcttctgatcaggtcaaggagaacattttaattcgatgctagtaggtcattaacacctccacaggtctcagtctcagagccttctgcaggcaacagcatccagttaagatttcatagccttgtttagatcccattacgcttaccttccattcatggctggtggtgctgttttgtcttttgtagcaatgacataagatttcctttttaaagaaatacattaacatttaaaaagtgaatcaatttaaataaaatatattaagtaaataatagcacaggtggtacctggatacaatgaaaagtaatcatgaaagtatcttggtatacggaaatggcagagattgggaagatggtaggcaaataaagtaaatttga

SEQ ID NO: 134281 - DNA, 456 bp, Homo sapiens
aaccaggtaagactttttaatccagaaattattcctattccctgcaatgtatagggtgctttctatctgcaaaactctaaactcaaatttctgcaggttcagattccaactgtctcatgcgcagagactctcccatcacaaaattcttcccgctccagccatcatctgtttcctcctcagcctttcccttgaaatccagagccctttcctgtccgttagaggcaatcagtcatgtttcagtgaagcttgaggcactgggccccccagtgaacaaaaccagacatcctgaccccctactcctgcggtctctgcagggcttgctttagcatgcttggcttgtggggagggggtgtggcagccattcccacacaaggtcacgcagggatgccacagtgcgtttcaagagtaggaatccacagccttctctccgtaactctgggccttgctgtaaatagc

SEQ ID NO: 134282 - DNA, 280 bp, Homo sapiens
cagaattagaattttgtcatttcgttgttgcttctttccactctagagatttcaaaaaggaagagattgctaatgatgatactgaggtatctcctctcttggggtaaaggagacttgctgtctctaaagggacctctcaagatagagattgcatttcttagtagtttaccatagtaaagagtctgaaacttatagaccctgtagcctagtatttctacagttacctaatttttgtctcaggttcatatttacagagttcatgagcttgatataaaaatca

SEQ ID NO: 134283 - DNA, 736 bp, Homo sapiens
gaattacagatacctttttcagagactgcatgctagtctctcatgattcccttatctgttatattgaagtcgtgtgtgatcgcacgggaaacttgcttttgttatttgccatcaccaaaggacccttctgaatgaagagcgagggcagctggctgttgggtgtgtggcgtgttgtcatcacttgaacacaggattattaaaggtgcgcaggattgttaaatgtgcctgctgtcggctgatgtcagatgatcccctgggaaggtttatttatttatttatttatttatttttaccctgcaggctccagttctgcttcagcagatctgggatggaggctgagactccccgtgatgcccaggcagctgttcatgagccccctttggagtaccattgagccaaggtcctctagcatggccgagtgctctctgctcttgcagtgaggcagtctctgcttttgttctgctcagggctgacctgttttggggggcttcctccactcttggggggcttcctccacttcctggctcttttccctcatccacgctgctcaagaccccatttcttccctgctgtctcatgcatacatccacgctcctcccaaacctctgttcctgtcactccagcaggctcctccatctccccaggccaccctcctaccaccaccactcccaccaccacatcagagtccttttttttccagttactacttgattgcccccctccccacttcacccct

SEQ ID NO: 134284 - DNA, 531 bp, Homo sapiens
ttaatatgatataattactataaattatataactatatattgttttatatataattatatatctttttaatatatatacacccatatatacacatgttcaagaaaaggatgagactgatcatgatgaaaaagaattatagggaaatgatggatctggaaacaggtcagtgatgactccagattctgtcttgaatgactgtggtggtgataagggctgcgatgttactacacaagatagggattatagaagaattttgttgggaagagcagatgctgcctgttgtattttaaatgctagcatgggagattctggtggttcctatttagcatatagttatgaatgtatagtttaggttacaagtcagtgagtttcaaatacagatgattgttgaagttgtggaaatcagattgttgggggaaagaaaaattaggaaaaagatgttcacagacaaagccttgtggaatgctcacatttaaaggataagaggaagaagaacaagaaacatagatttgagaaagagtaagaaaaat

SEQ ID NO: 134285 - DNA, 185 bp, Homo sapiens
acctgtaatcctaacactctgggaggccagggcaggcagatcccctgagttcaagagtttgagaccagcctaggcaaccttgtctctacagaaaaataaataaataaataaataaacaaacaaacaaaccaaaaattagctgggtgcagtgacacatgcctgtaaccccagctacttgagaggct

SEQ ID NO: 134286 - DNA, 608 bp, Homo sapiens
tcgtgaagatgccgtgggccgcggagctgcgcggattctgggctgtggggcgggcacggcctttccggaggcgccgctcctgggcgtcctttcaggcgggcgtggaggcgccagcctcgggcgcgtttagcctcgggcgcgtttagcctcgacctcgggccagcccgcttgccgcgccgtggccctaaggagcggctgccctgctggaccgcatccaccagcagcctggctctgccgctatcgaaggaggcttttaaagcgctggggttacaggtgtgagccaccattcctggccgtgtattttttaatggttatatttattgactgttttaaattttttaagtgacttttgcttttggtatggtgtagcgaaatctcccctcaaattatacatatattcattcacctgtggtttttttttgtagacattcttagggtttccattattttaaaatttaacccactgaaagtagttgtatgaaatagctacgtttattttctttcaaatgtattcaatttgtcagttaaaagacacactgctggttgggatttttctttttccttgggacagggggttcccctttggtggccccgggctggcgtccacg

SEQ ID NO: 134287 - DNA, 392 bp, Homo sapiens
gtacgtcgtccgattagctcctgacggtacatttccagaggaaaccaaaagttgtttaggaaaggaaagtatttgtaatttataccatttaacagctataaatagtatacatgggccgggcgcggtggctcatgcctgtaatcccagcactttgggaggccaaggcgggcggatcacaaggtcaggagtttgagaccagccttaccaacatggcgaaaccccgtctctactaaaaatacaaaaattagccggacgtggtggcgcgtgccttaatcccagctactcaggaggctaaggcaggagattcgcttgaacccgggaggcagaggttgcagtgagctgagatcacaccattgcactccagcctgggcgacagagcgagactccgcctc

SEQ ID NO: 134288 - DNA, 256 bp, Homo sapiens
ctctcctctagactaagtgatatcttgaataggccccatgtcaggataatggtggcagagctaggacttccctgagccctagacaaattttctttgtattataccaggccaatttcttcatacaagtaggacagcccagctgcaaggaattgccctagggtattcactagtgaattaggaaggagcttgtgttattctgtgcatccagccactgttaaaaaatatgtgttgggttgggggcaggaatttcagcatt

SEQ ID NO: 134289 - DNA, 219 bp, Homo sapiens
gcccatcctgggagctggagtgcatggatgtcggagggtcatgttttccaaactgtggaagaaaaaacaaaaagctatgttcttccaggaggtatttagaacggagcttgagtttgggattcagatgcctgggcctgtgtagttcacttgtggggcaccccagcaggggcctcctaatggaaaatgcatcctgagagaaggagttaattataagcttag

SEQ ID NO: 134290 - DNA, 836 bp, Homo sapiens
ggcaggataatcgcttgaacccgggaggcacaggctgcggtgagctgagatcacaccactgcactgcagcctcggtgacagagcgagactctgtctcaaaaaaaaatagtactaagatagcaatcttatatacattatctcatttgagccttacagaaatcctggaaagtagccagggcaagtatctacattttactcatacttaagttgaggcttgaagaggttatgtgacttcccaaggttacacagctgttagaaacagaactatgatccagatcttttaattactttgctagtgggttataggttccaagcaattattggttctcatacctatgtgcaccttgatcatactttctcagtgtaattatcgattaacaaagaggcaaaatgaagtgcacttggaattacatggggttttgtacttagccagcccttttcttggtacatgaagaactatacacttgcatccttttttaactttcatatttcctttcaatctctaggttggacaagatgctgccaattcatcaaacccaaagaaagctgcagagatcactgttatccaccagacatacttctgaaaagttctgctctatctcaaagactgaatgatactacacagtcctctccctattaatatgggcacattcttgccaatttcacacttgtatcttcagcagggacattacaatcaaacaccaattcctggttaatgaagggagagtgtgggcttagcagagttaccctcatgcccctatctgagccacaaccttctgtaattcacttcatacatccatctaaatggatacctttccatcccctcaaacgagaac

SEQ ID NO: 134291 - DNA, 547 bp, Homo sapiens
gtaacaaatgtgccactcaatgcaagatgttagtaatgggggcagtgggtgggagagttgtatacatgtgagaggtatgagataaccctattttttgttcatttttctgtaaacctaaacttgctttaaaaagaagtctaaataaaaaagaaaaaaaaaaaaaaaaaaaaaaatttttggggggcttgggcccccgaaaagactctttccagaaaaaccatctgcgtgtggcggcgccgggggccccagtgagaggttagaggggaacacgagggcccatgagagcgtgttttcccgtagagagagaaccgcggggtcccattcacactatgagggcgtggggcgaattctctttccccccaatattacaaaaggcgctccgcggggggtaacaaaccgacgaaagggtttcttgtgaaaaacaaatctcgagaagagtggagagttttcggcgagaggctatcatattaggggggcatttcttactacaacaggggagtgatctcacaagagcgagagcctctcgaattatttcaaaatttacgcc

SEQ ID NO: 134292 - DNA, 862 bp, Homo sapiens
ctcttcagaggtcctgggccaaagagcttccaacctaaatagagcttgggcaagcctagaatctagaaaaattaagcagcttaactggtcagcctgacatccactgttgtggctgcctggcagatggtatttaagccccacaattgttccctaaggccaacacaggaaatctgattcctggagcaaataaatgaacgggtggtagtagggggcatgaggggagaggctttgactctgttctaatttatttagagcaaatcaaaacactcctcaaatggcatctttctgcttttatcactagttccgtgttttttttcttgttttgtgtctgtgtattttcatttctctgtcatccgtcctttcatcttgaagcaaatctcttctaactccctcataccccagaaattgattcattctattcaaatgcttaataattcaggagattattatttgtttgagccctatcttctttttttttttgagagggggtcttactatgttgaccaggttggagtgcaatggatattcacaggcacgatcatcgcacactacagtctagaaatcctgggctcaagcgatcttcctgcttcagcctccccagtagctgggattacagggggccagagcacagccctattttcttttccttttggcaagatcatctcagcagaggccagaagagaccctcaactgttcaatgaatatttacggttgctttcttccttttatgagcctcttgcatactttgaaagctttaaatttatacctataatacaacggacatcccctatcccagaagaccattcctccctgtacttcagctctttacttcctcccaaataaaacctaacttttctaacta

SEQ ID NO: 134293 - DNA, 1020 bp, Homo sapiens
ctcttcagaggtcctgggccaaagagcttccaacctaaatagagcttgggcaagcctagaatctagaaaaattaagcagcttaactggtcagcctgacatccactgttgtggctgcctggcagatggtatttaagccccacaattgttccctaaggccaacacaggaaatctgattcctggagcaaataaatgaacgggtggtagtagggggcatgaggggagaggctttgactctgttctaatttatttagagcaaatcaaaacactcctcaaatggcatctttctgcttttatcactagttccgtgttttttttcttgttttgtgtctgtgtattttcatttctctgtcatccgtcctttcatcttgaagcaaatctcttctaactccctcataccccagaaattgattcattctattcaaatgcttaataattcaggagattattatttgtttgagccctatcttctttttttttttgagagggggtcttactatgttgaccaggttggagtgcaatggatattcacaggcacgatcatcgcacactacagtctagaaatcctgggctcaagcgatcttcctgcttcagcctccccagtagctgggattacagggggccagagcacagccctattttcttttccttttggcaagatcatctcagcagaggccagaagagaccctcaactgttcaatgaatatttacggttgctttcttccttttatgagcctcttgcatactttgaaagctttaaatttatacctataatacaacggacatcccctatcccagaagaccattcctccctgtacttcagctctttacttcctcccaaataaaacctaacttttctaactaactatttaagacttggaatagtccgcttgactagaagaaggggaagaatgtttgtaaattcacctctaatcggactttgattctactataattcagcagaaaattcatagcgctgtgatttttagatcgacctcacataaaacagtccctgcactcgc

SEQ ID NO: 134294 - DNA, 1085 bp, Homo sapiens
aatttctgtcttcaactttggacatttcttaactattaactgggattacttcctttttgctcctctacaacccattctctacacagaaactgtagtgatttctttcaatgtgacattagattctactacaaaaatcaccaatggctgcttactgtaactagaataaaattcaaacttaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaagaaaacaaaaaaaaaaaaaaaaaaaaaaataaaaaagaaaaaaaacaaaaaaaaccacaagaacaggaaaaaaacgcggaaaacacgagagcccaccggggaccaggagcaccaccttaccccgcggcgagggcgagacccacacggccacacaccaccacacacaacgagactctaaacccccgacggcaacatatacacaacgcaacaacagagaaccacaggcgcgtacacacccaaccccacccaataactcgcgccaccagacacacactcaccccaaacaagcagaaaaacaaaccccacgaaaacagaataaaaaccgagacacaccgaaccaaaacaccagcccacacgaactacaaccaacacacacacaacacaaacaataaagcaaaagagacacataggccgcaaagcaaaggaagcagagacgaaacgaagagagccacgcgaaagacgacgcgtcaaaacaggagaccgaaaaacagaagacagcgagaaagggagaaagaaagcagaaaaagagacggcgacacaaaaaacgaagaaagaaagaccagacacaagacggaacagcaaagcagcagggagcaccagctgaaagagggaaggcgcagcaaaacgagaacaatccggagaggcagaccaagacgaagaccagagagcgaaagacaagccgagcagagcggcaagcaaacacagacgaagactgggagcgaaacatacgagagagcagagaagacccaggaacggggagccggcccacgacaccacacagatcgagaaactgcaaacag

SEQ ID NO: 134295 - DNA, 278 bp, Homo sapiens
  misc_feature (26)..(26): n is a, c, g, or t
  misc_feature (36)..(36): n is a, c, g, or t
  misc_feature (59)..(59): n is a, c, g, or t
  misc_feature (63)..(63): n is a, c, g, or t
  misc_feature (95)..(95): n is a, c, g, or t
tgctgcttcgccacctgctgcttcgncacgaaaganttcccgtgccgtgggagcaagtntggnacctctggtcggaacggagagtcgcagctgtntgttagggctaggatggctccgggatgcgcgtaagggcccgcctggcaggacgactgagcaagtccttggaaaaccagagatattagagcggtgaatcgcgctggtcacgttggacacctgcgcgttaggagattctggagccagagggagagaacccagaaactccccgggcggcgacccag

SEQ ID NO: 134296 - DNA, 472 bp, Homo sapiens
cagtccgttcgactgagctctctcctgtgctcccaggcctcctggttgtgttcgcacctgtggtcctggggctgaaggcaattaccttggctgcactcctactggccctggctacctactcggaggagccctgggcaagaagatgtcaagaccacaggcccagcaggagccatgaacaccttagcatggagcaagggtcaagagtgaggggtcagccccagagtgaggaccctctgagttggagaggagccagggctcctcaaccatttccctacctccagtcccagcctctaggtgcccccaggcctcatgacaaactcctagatccctacatctggttttggtccacctagtgaaattcccttctttgcaccgggcttccctctaaaatgtctccctttctctttttggcctgttcaagacctccttgcttttcagtccctggctcagtcgaacggactggggtaccgag

SEQ ID NO: 134297 - DNA, 788 bp, Homo sapiens
ggataaatccttttttggtcatggtatataattattttaatatatttgctggatttggtttgttagtattttgttgaggattttgtatctatattcataaggaaaagacgttagtctgtagttttcttatgatgtttttgtctgattttggtatcggggtaataatactgacctcctaaaattagttgggaagtattctgtctgtttctagttctaggagacaatgtagataactggtattatttctactttaaatgtttggtagaattcaccagtgaagccatctgggcctgggctttcttgcagaaattgatatgatgattctaaaattcatatggaaatgcaagggacccagaatagccaaaacaatcctgaaaaagaataaagttggaggactcacaattcccaatttcaaaacttaccataaagctacagtaatcaaaatagtctgttactggcataaggatagatacatagatcaatgggatagaactgagaattgacaaataaaccccacacatccatggtcaatttttggcaagagaaccaagaccactcaatgggaaaagaatagcctcttcaacaaatggtgctgggataacctgataaccaccttcaaaagagtgaagttggacccctacttcactccatatttaaaagttaagtcaaaatagatcaaagacttaaatgtaagaactaaaactataaaactctttgaagacaatttagaagtaaatctttgtgacctgggttaggcttcttagatataataccaaaagcacaagtaa

SEQ ID NO: 134298 - DNA, 468 bp, Homo sapiens
ctgcccactatactccattacactgcccacgtggtgttcctggagggacaaaacacccacaggtaaccctggctgactgttaccaattcccctccctgttatccatagcctagttcctttttgaggctcctgaagaggaccctgagcctaaaagaaggccatagatctgggaagaaattaatcccacattacttgtcagcagtggcacagactccctgccattacctaggttacctgactggagtttaagccactaccgatcactcccctatttaccttaattaatcagattggcatggctccctcaggaggggtgctcagacctccctgtgcccctgggataagtgaggaagttggggagcgcttcttggcgaaaagacctaagaattgcagggaggcagccctggaggccagggcgggtaggaacactaacagaggggccgcctgcaccaggtgggacagaagagg

SEQ ID NO: 134299 - DNA, 524 bp, Homo sapiens
ggtgatggagcaaaggtcagcggtggccaggggctgggtgtggctatgaaggggtggctgccttgtgatgattcaatatgctatgtttttcctttgtggttttctgtatctatgttttatcttattttttttgagctctgtcacccaggctggaatcagtggtacgatcttggctcactgcaacctccacctcctgggttcaagcaattctcctgcctcagctgcccaagtagctgcgactacaggcatgcgccaccatgtccggctaatttttgtacttttttttgagacagagtttcgttcttgttgcccaggctggagtgcaatgccgcaatctcggctcactacaacccccacctcctgggttcaagagattctcctgcctcagcctcccgagtagctgggattacaggcgcccactgccacaccccgctaatttttgtatttttagtaaagatggagttgcaccatgttggccaggctggtctcaaactcctgacctcaggtgatccacccgcctcagc

SEQ ID NO: 134300 - DNA, 1202 bp, Homo sapiens
ggactttggcagattgtgctattacattgggctctaactttctggcacccgcaaggcagacctatgatgtccacatggctgactcttgacccctggccattgtgagcagaggaatcaagggtttagggaggcagtattgggcagtgtggaagagttagatgagatgaagcagttagcacagtgcttaacccatactaagtgcccccaaccctgccagccaaattaggtgcatagttttcagcttgggtctggattcaacagcattcccgctgcccactaaaagggtgggcttggacagttcctgaacctccctaaatctgtttcttcatctttaccacacacagtctgtctcagtggtggtgtggattaagtgaggtgctagcacttattaggggaagatcctccagacctgcaaagcagggctgcagccccaattctgacccagccctgctgtgtgtttgccgcaaagaggtttggtgtgtgcgagacatttctttatgaaccatttacactgctggaaatgtacccactaatgtgatggcaagaacttcaacaaattgcttatgaatcaggctctcaatggaagaagttaatcctctgaagagggggaagactggactttcagaagtatgttggggatagagaatgaagtttgagtcagcagagctctgccttcctgtttgtcaaagaactagagtctgggagtcttgcaagatggagctgggcttctgaagaacccagtgggtaggtactgggcatccattagacggcagtgctaagtcggtcatgtgcagcagaaagacctccccactgtgaacaacaaaccactttcctcctccagtggcccattcatttggattgatacactttttcagtgtcagaaatgcactttctccctctacttgtctgaattacgatgctctgctcaactctgtggacagtgtttcttgaatttccttttccaccgccttttcccactcaagaaagtggagagaaaaacagggatgcaggctgtgggtcttgtggaagccctttacaaccattaaataaagaacaccagctgcattatgtgtgtttagaacgagaagttgtttgtacagtatttttctattgaccgcttccgtcttgcctgaaacctgggcattctttctgtagtttctctgaattttctgtctcacctcctcacccctacccttgccttt

SEQ ID NO: 134301 - DNA, 397 bp, Homo sapiens
ggtgggcttccgggcaatgctctgcgcactgccccacatcagggctaagaggacaccgtgtccccaaggatgcagaaacttttggcatctgtgactcccccagtcccagattctactccacatggctctcccttggctggttctgacttacatactttctctataataaaactcattgtaaagacagtactttcctgaatcctgtgagtcattctagtgaatttttgaaactgaaggtggttttggaaacctccggactcacaactggtgtcagaagtgggggcaggactgggcacagtgattcatgcctataatcccagcactttgggaagccaaggcaagtggatcgctggagcccaggggttcaaaaccctcctgggcaacatggtgaaaccct

SEQ ID NO: 134302 - DNA, 422 bp, Homo sapiens
tactgttgcagctgtcagagcaacctaactaggggctctgttcccagcagcagaacttatggaatgtgaggcgtgggcggatgtggcagtcatacttcctgccctagaggatggcagtctatcacaagagaatgaaccaatattacagtgcaaggtctcaaagagtgtcctggagtcattaatttccttccattcattcccgagttccagctgtcacttctctcagtccagctgcttgattttcctctggttttaagataccctagtttttttaaactaataccccttttagctgttgagttggatttctgccatctaaaggagactagtaagatttctaagtttcggatgaataaatacatttgatatgaaagataccaaaggattaagattttttttgagacggggtttcactcttgttg

SEQ ID NO: 134303 - DNA, 205 bp, Homo sapiens
tcctgggcctcaggtgggcatccggggtttcgatctcagctcctgctgacaagccggggccttgagttgttcggaagttccactttcctcctttgcagattgcaggttaaaatactgacctctgtgggccgggcatggtggctcacgtctgtaatcccagcactttaggaggccgaggcgggtagatcacgaggtcaagagatgg

SEQ ID NO: 134304 - DNA, 658 bp, Homo sapiens
gccaattaatctctcttccctttggaaaaactggactgatacccggcttacagggttctgggccttacaggtgagaaaagaatgtcacttcctggcaggcccaggaccctaggatatcttgaggatctcaacaagagaagaattcatccaaatctgtaggtattgttattggaaaggggtactaatacagactccatttaatacagacacatttaacgcagtgtgtcgagggaactttatagcactaaatgcccacaagagaaagaaggaaggatctaaaattgacaccctaacatcacaattagaagaactagagaaacaagagcaaacaaattcaaaagctagcagaaggcaagaaataactaagatcagagcagaactgaaggagatagagacacaaaaaacccttcaaaaaatcactgaatccaggagctgtttttttaaaaagatcaacaaagttgacagactgctagtaagactaataagaaaagagaagaatcaaaaagacgcaataaaaaatgataaaggggatatctccactgatcccacagaaatacaaactaccatcagaaaatactataaacacctctatgcaaataaactagaaaatctagaagaaatagataaattcctggacacatacaccctcccaagacta

SEQ ID NO: 134305 - DNA, 256 bp, Homo sapiens
gggagtttcagtcattcaggtatatagaaagatgttgtccagggatcagtactcctgcctccataaatagcagcatttatctagtagagcaacaaatgcttaatactgtgattcagagagatcccaaacatcattagtagaatacacagtggaggtctattttataagagaaagcttagtttgattttttttcttcaatttcgggtgtttaaagggaatagttggaggatgctgtattagtggacttctagcgact

SEQ ID NO: 134306 - DNA, 280 bp, Homo sapiens
ggagaccttagacatagaggaactctcagacttgaactctacagggtggtgttgccggtaagatgggcccggtcagacctgagcactcctcagtcggctgacctctccagggtccccagcgtggccacgcctgcttggagcacagcctcgggtgtcaaggggtgataactcctgggggccccacatcacagctcttgcactggtgaaccatgcctgaccagcagagaggtccagcagagcgtcccctgtaggatacgcaccagcccactcgtaccctcct

SEQ ID NO: 134307 - DNA, 181 bp, Homo sapiens
caagatatggcggagggggaatttggagagattcaaagagtgagagagcctgaaggggaccacatggaaagcatgaaaaggactgtaggcctgaaggctggcccctggcagataaccagccgggaaacgggggccttgtccctacagctgcacgaactgaattcagccaacggcctgagtg

SEQ ID NO: 134308 - DNA, 481 bp, Homo sapiens
tttaactagtactgttataggtttagttttttcttgagttagttttggtagtttgtgtgctgctaggaatttgtccattttatctaggttatctaatttgttagcatataattgttaatagtatttccttacaatcctttttatttctgtaagattggcagtaatgtccccactttattcctgattttagtaacctgaatctttttgtcttgctcagtctttttaagggtttgtgaacattattatttcaaacaaccaaattttggttttgtggattctattttctactgtatatttcatttatctctactccagtctttactatttccttccttctgctagctttgggtttgatttcctcttctttttctagttcctgaaggtggaaggttaggttgctgattctaggtattttttaatgtaggcatgtgcagctataaaattgcctttgagcactgcttttgctgcattccaaacgttt

SEQ ID NO: 134309 - DNA, 1188 bp, Homo sapiens
gtgaagatcattgacaagatctcaactgttttcctccagtctccagaaactattccgcgaagtaagaataatgaaggttttgaatcatcccaacatagttaaattatttgaagtgattgagactgagaaaacgctctaccttgtcatggagtacgctagtggcggagaggtatttgattacctagtggctcatggcaggatgaaagaaaaagaggctcgagccaaattccgccagatagtgtctgctgtgcagtactgtcaccagaagtttattgtccatagagacttaaaggcagaaaacctgctcttggatgctgatatgaacatcaagattgcagactttggcttcagcaatgaattcacctttgggaacaagctggacaccttctgtggcagtcccccttatgctgccccagaactcttccagggcaaaaaatatgatggacccgaggtggatgtgtggagcctaggagttatcctctatacactggtcagcggatccctgccttttgatggacagaacctcaaggagctgcggcgaacgggaactgaagagggaaaataccgaaataccatacaacatgtccacggactgcgaaaacctagcaaaagaaatacctcatactaaaacccagcaagagaggcacaacagagcaactcatgccacgatcgaggatgactgtgggacagaaagatggatgaactaaagcctaacgtgaggcacatccagactacgaggacccggcggacagagctgatgaaggccaagactaaacacggcaaaaacacagaaatccagaagagccaaaacacaccacgggaacgccaccaacacagacagggcaaacagagacccgacaatgatagtagagacaacagaaagcagatagaaccaccaggaacactagagtatcgggaaacacatagacgagagccacaacacaaacatacaagagcaaacgagcaggagcactgcacaaccaaatagaggagcggcactagcacacgagcagcgacaaatacccgcacagagacttaaagagagacggaaaagccagaaagatgcgactgcaagtgcaagccgcagcacaacaaggcggacacagacgaaagacgcacacacgcctcgtgcaagctatcgtgcgtaagagcgagcaggcgcacctacaacaggaagacgcacgcgaa

SEQ ID NO: 134310 - DNA, 420 bp, Homo sapiens
cccttggatctaattaatgaggtcaatatctttgatctgttacagagatataaggtgaagaagtcagacttgtaattatttagcacgtcaaattcaccttaatatacagattcttagaccctcttcccctcccccaaagattccaactcaatagatctggtgaaaaccaggaatctgtaaacgcccagtaattcagaagcaaacgtaagagatcaaattctgagaaacaatgtgtttctctgagaaagagaggaacgggattcattctgtaatgacaggacaaattcatgtaccattcaaaacgtctttcacaactaggactcatatttattatttacgtttacagacttattatacttgtagccctacgcccaaggctctatcatcatttacaatccagtcacttcctcaaacaaatgt

SEQ ID NO: 134311 - DNA, 384 bp, Homo sapiens
ctgctgaggggttacccagcctgattgcttctgttggcagcaagctcacgacttccacctctggactctgcccgttagaaatggtttcttataggccaggcgcagtggctcatgcccttaatcccagcactttgggaggctgagaccagcggatcacttgagcccaggagttcaagaccagcctgggcaacatggtaaaactctgtctttacaaaaaaacaaaaaacacaaattaggcaggcatggtggcccacacctgtagtcccagctactcaggaggctgaggtgggaagattgattgagcctgggaggtcaaggctgcggtgagccgtgatcgcatctgtgtgctccagcctgggcaacagagtgagatcctgcatcaag

SEQ ID NO: 134312 - DNA, 222 bp, Homo sapiens
aaaaaaagatatgactcactagaagctcagatgatcattagcatttttttagcaatgaagtattttaaataaaactgcatttttttagacataatgctattgaacacttaatagcaaccatgtaaacataacttttatatgcactggacacccaaaaagtccacgtgacttattttactgtggtagtctataagcaaacccacaatttcttcaaggtatgcc

SEQ ID NO: 134313 - DNA, 253 bp, Homo sapiens
gaaaaggctggggagcagatcctgagccaagaagtggcatgacgtattttcaagagaacccctggggtttctatgtggagaacagactaaagggagcaaggtccgaagtggggacaactgttaggaggctatcataaacatccagccgagacataataaaagtttgggccagaataacagtagaggtatggtcagattcagtatatatcaaaattagggtataggtaggaacataaagagatgagagcctgag

SEQ ID NO: 134314 - DNA, 709 bp, Homo sapiens
gaaggaaagggtgacagttaccagttagattcaatacttctcagcttttctatgatcagcattatttggcacacacagaaaccacaactttaactttccacatttaccactgttttatgtgatttgggtctagaaggaaaatggtcaggggccaattttctaggaaccagggaggttatgttattcctggattacaccaaatactggtcattaaaaaaaatcgttttattgcagtataatttatatgccaaaacttcacccactgtaagagaacagctcaaggatttcgggtaactttatattgtgcagccttcaccacagtccagtgttagaacatttccacggtcccagatagctccctccaagcctagtacttttgattgtttgtgaattctgttatgtatatgttcaaacacctttccaatgaataacaatgccttttagaactcttcgtattttttcattgttctagattgagtaaataggtcgcaggccacctgtttcattaagttagtcttgataaataagttcgtgaggtttgtgccatttgcctaaaatgaaatacttcaaccagtgagtattattgtaataatgaatatgtgccaggtactgctttgccatctcttaaaataatgctttagaagtatactcacggtttaaaagagtactctgtttatgttaatgcaatagtcatatatttgaacaccca

SEQ ID NO: 134315 - DNA, 1247 bp, Homo sapiens
tttctattttcaggacttattttctgaatattctttttttcttagatggagaaaaaccttacaatttcaaaacctgaggatattagtggcagttccttaaaaatgttttcttctcccttcacagtcccactttgctccattttgggttgtgggttttgattctacctttcaccctagaggcattcctcaaatggctggtgatccttgcctgtctgcacatattgaagagggggacaataagctgactggaagcaaccggctcataggagtaggatttgttgactctggcattcctgaaactgctgcttccctggagacccccaatatcagctgccaaattttgcacagaatcttctcatctcctggctggaagcataagcctggctaccagcattcagacagccaagtaggggaaagtgctaagcattaaatattctgaatacaggctgggcacagtggctcacacctggaatcccagcactttaggaggccgaggcgggtggatcacctgtggccaggagttcgagactagcctggccaacatggcgaaaccccgtcgctactaaaaatatgaaaaaattagccgggcgtggaggcacgcgcctgtagtcccagctactcaggaggttgaggcaggagaattgcttgaatccaggaggtggtgcatgcctgtagtcctagctacttgggaggctgaggcatgagaatcaagtgattcttgcacctgggaggcagaagttgcagtgagctgagatcacaccactgaaccaccgcagcctgtcttaaaaaataaaaataaagaagtaacatttttgggaactggtgtgcctggaaacctttttattccacctacccttacactaattgaggctggagataacattcccttggaattttaaagatattgatctactttcttctcatatctgatgttatttgaggcattcagattctcagtcctttgtatgaaacttttaaaattttttctagttcaggtattccttgtagtgaaattcacaatggcataccctagtgcgggtctgtttttatatattgtgctgggcactggaaagccatggctttcagtttcattggtgatttcctctgctgtttcttctgttctctttatggcatgcttattattcagatctgaggccttttgttctggtcttttctttcctactttctgcagtgagtcaagattgtgccacagcactccagcgtggcaacagagcgagactccgtct

SEQ ID NO: 134316 - DNA, 162 bp, Homo sapiens
ccctcaccccccactcttaggtatgtatgatgctaatcttgtccctaagtaagtttcttcctgctccttttgtatcttcctttctgtctttcctcctaccttttgtctcttggtgttttgggactttttttttttttttttttttttttttttttttttttt

SEQ ID NO: 134317 - DNA, 308 bp, Homo sapiens
ccaggctggtctcgaactcccggcctcaagcaatctgcccgccttggccccctaaagtgctgggattacaggtgtgagccacctcgcctggtcctgagtgcatattttagagaataaaatcacccaactgcccagcagatacatgaggatgagtgaggttaaagaggacacaagctgtttcttagatattaatgtcaaataaaaggttagttatcggctgggcgcagtggctcacgcctataatcccacctcactcaaatctctatcatgataaacagcatcgctggctgtcagacaagctcgtgact

SEQ ID NO: 134318 - DNA, 439 bp, Homo sapiens
ccttggctttatcttctctctgctccctcctaggctataaactcgggaatgaatgaatggacagatgaaccctgccagtataattgtaaaccatctaatcagaaactcaaagggcagcagataggaggccacagctcagggtgttccaaaggcccagcccagggcgtgactgaggggtgtggtagtcaagggggtgaccttaaaacctggcgtctgtctttgtcattttagtcattccatccgcagcgcctgttgagcacagccgtgtcttaccaggcgggtgctgagcgcacacactgagagaccgtggtcttggcacacgcgtagtttatagtatgagtggggtatgccgcaagcccatgtctgttccctgctagcctgggtggacagtgatggctgtcactgcagacatgggatgagaagcttcagtggtgaggtg

SEQ ID NO: 134319 - DNA, 834 bp, Homo sapiens
tcactgaagtaaggaggagaaatagtttggagggcagagtgtggtaatggtaggaaatgacagttatcatttgggacattttgaggtaatggattagaagtactgaggccttaacccaaacacagtacaaagagacaaaaagaaaaaaatgtagaagtgctgtcaagaatcatggaggatgtattgagatgacatggtataaatttgtgtataggaaagccagaacaagataaagtgagaatgatggaaaaaacaatatcaaaagtatgtcgggccaggcgcagtggcttacacctgtaatcccagtactttgggaggctgaggagggagaactgcttgaggccaggagttcgagaccagcctgggcaatccagcgtgaacccccatctctaaaaaaaaaaaaaatttaaagagataatgacagagttttctgaaactgaaagagagaccaaatttttcattcaaatggagagtgtactctgactatcaagcaggaaaaataaaatatataaaatctgtagtaagttctatcacaatgaagctgcagaacatgcagggtaaaagggaaatggtaaaagctgccagaaaaaaagggagtgtcttcaatggaacaataattaggctggcagcctgctttcctgtagcaaccgtgcaagctgaaggtggcacagcaatagcttcaaaatgctgtgagaatcgccgcccactcctcactgtgtgtgggctgggtgtggcacgctggcaactctccccaaacgactctggatgctggtgtccctagaatctcttgggtctaaagattgatcttcttacctcctataattcctgaggtgg

SEQ ID NO: 134320 - DNA, 451 bp, Homo sapiens
cccaatgatagaatgaaggcaagcctgatactttgtatatttgacctattaatagaaaaataccgtgtgatgatgagcccttaataaacattaaataagaacaagagttctagcttgatctgtgggctgattgattttgtagagtttcttaattgacttcattttttaataaaatagaatatgcctgagagagtggaagaaagaaaaataagctaattggaatagaggtattgcatcattgatttgaatttattttttgctatgctttctacattgattaattgttctatttgaaatttttagttgaatggttcacaggcaaactaagatgtataatatttatatgtagctgccactgtggctcacctgatatatcattgtcattctatttaaggatccttagacttaaaattctttacaatacttgcatattccccacatgctcacacat

SEQ ID NO: 134321 - DNA, 318 bp, Homo sapiens
atttaaccctccaagcttatttgccaacgtgtgaactgaggataagaatatctgctccttagagtgttgatcaagtacgtagcatggcgcctggcactgagccctcagtaaaaggtgattccatgttgattcttctcctctgaagctaaaggctgtgtcgctactgcagtttctgtctgcttcaccctgcatcgtccctgccggactaaactcccttaagtggcgattttgcctctattgagtaaaaacttagcttttccccattgcttatcttttccatctcgacttttctgagcaacttttaatatacaacttaaa

SEQ ID NO: 134322 - DNA, 458 bp, Homo sapiens
cagacaactgaatttaaaagtaagcaaaagacttaaaggagcatttaatcaaagggaatgacaataccggattaatttgagatatagaaaatagcttaccaaaaagatgagccatggccatgtgtcaacaatatccttttttgagagctcaattaaacataataaaaccagttataaaagaattagaaaaacatgtaatccccatgctttggaaggccaagttaggaggatcagttgaggttaggagtttgagaccagtctgggcaacatagtgagacctcatctctacaaaaaattaaacaaaaattagctggctgtgatggcaggtgcctgtggtcctagctacttgggaggctgagatgggaggatcacctgaatcctggagtttgaggttacagtgagccgtgaccacaccactgcactcaagcctgggtaacagagtgagaccctgtctctta

SEQ ID NO: 134323 - DNA, 343 bp, Homo sapiens
gctaatatgctggcaattcggcttattaagcgcgttctgcgtagtaagtgagtggggatctcaggccagcggggggagcccagggcacagctccagcagggctggcccctcagagcttccaggctgcagcaggcaggggttggaagaggtgagaaggagcagggcagtgagtgtcccaggaagcccattcccggaacagcgtccttgggttggttctgggaactggggacaccaggaaggcccaggggagtggggctgctgggaatggcctgggggaggccacgaggtgggtcaggggtggagctgggtgttctgggcgggcctttgaagcccactggccttc

SEQ ID NO: 134324 - DNA, 434 bp, Homo sapiens
acgcatccagacaggaggtacaagtcagatctctgtatgttcaggttaaaacgatagaaataaatagacatacccacaactttgaaacctggacagagttaaaggggaccaaagacaggaaggtttcttggttttgtataaatatgtcgattcacacatgcgtttctgaaaatctttatggttctccccccagcttggacactggccactgtaaataatgctagaaggttctggtgccttcatggcaagattacaggggataggaatcacatttatcaaatatgtgaaggactgtcactggaagaaggacattagtgatctgagaaaatccccagggcaggactaaggtcaatgtgttgaagataaaggggtataggtttcatttaggaggtgctctcgtgtcataatctcacccaaaatggcccagagccccc

SEQ ID NO: 134325 - DNA, 313 bp, Homo sapiens
aagtgtattatcatacttatatactggactgacatagaaaaatttccatggcatagtataaaaataaaaagcaagttcctgaacaatatatgtaagaatggcaccattttttgtataacatgtgcacgcacacacgtttatgtagcaggaataaaacattttttgtctgttttttaatcgactgacattaaggtttctgcctgtgtttagaaaaattccttacataagacgggtacatagacagataatcaaagaccagtagtatctcccctgaatttggaaatagcagcaagttaagaagcaaaagaaaata

SEQ ID NO: 134326 - DNA, 319 bp, Homo sapiens
gggatattttagttaagctgtcccacccagctacagtggcagaagttgggaagagggcccactcataaatctttattgaactttaattaattaattaattatttgccattgttcataggaatttgaaagggaaagacatattgaataaccatgcctatctgactttatagaaatggtccaggttcttggggttaatgtgacttttattatttgataggcacgcatttgtttaacaatgacaataaccggaaaaccacagaagtataaataccagtaatgaaaagttcaatgcaaagaggaaaaaaaagaagaagaaaaa

SEQ ID NO: 134327 - DNA, 397 bp, Homo sapiens
acatacagtattctgcttaactcaattcacagttaatagccttcacggtactgaatggtcccaaatagttattcaaatttttgaagagtatcttggaccatttaagttaattctactgaatacagctgtggacaacccagttgggggtgtgggggacaatcttcattcacatctcaccataatgtggtatgtccatcatatttgaacattttattaaaactcaatacctaacggtcaatacaaaccagactgccagtgcatacagactagcctgaaaacagtttttggaaaaaaaaaaaaaaatgcagtctaaaaatattaactatacaaacatcacatctattgaaaatacacatttcacattaaacacaaacaaaactttaaaggtacctactag

SEQ ID NO: 134328 - DNA, 558 bp, Homo sapiens
gaggactaacagcaataataaacaggaatttttatctttaaatctcttcataactttaattagttaatctgcacaaagctataataggagacaggtatggtgggagttatctccatttcaaagctttatagttggtccaaggtgacaggattaagttttcaaactggcattagaatgcggagaccattgtctgctcaactgtgtttactagtttgcatggctatgatgcctggccaagcacacagacactaattggaaaaagagatatagatacagtcccttaattgactaactttaaaattgagcaaagtgagatagggctgtctttgaaattagatcaaaatatctcaaacaaaatgttatcagccacttaaaatggttgttaccatcttgttcttcaactgttgaagtttaccactgctgacttcactctgtcagcaatctttgagctgttcattcatgcactcatatcatacctttcatgatctttgagcacctactgtgtgtaagacattgggcaaggacccatccgtattattacagccattacccttttgt

SEQ ID NO: 134329 - DNA, 293 bp, Homo sapiens
ggctgaggcggaggcaggattgcttgatatgagggagattgaggctgcagtgagctgtgttcacaccactgcactccagtctgggcaacagtgcaagaccctgtcacttaaaaaaaaaaaagaagcacttcccatcagaactcccagaaagcagtgagtccaccctccctgcacatgcacaagttgggtggggacaggcaggaagggagctcatctaggtgtcagcgtaatattgaggggcagtggcagtggcagcatgtgctttttccaccaatgccccagtgtctcaaaag

SEQ ID NO: 134330 - DNA, 636 bp, Homo sapiens
ctagcccttcactttataggtaaagaaatcgaggctcaacataataagggaaaaagaaataaaagcccaaaggaaaaatggaccactcctacagagacctccaaagacaatggtgtttctgaggttgtacttccaccttggccctgaacttcttggcagccaaaccaaaaaagggagagatgggagctagtaatttcttttaatcataaaggaaggatcttggcttttcccagcactggctacttaaatattcttacatgaatttctagactctgccctgaatatctggcctcaacaactttacataaataagtgcataagtggcaggtattggcctcaacaaaaacttttcatagtaaatataataaaagattttataaagggaattctgtgagggtccaaatgtataataattagacttattgatatatattaagtacctaagtgcactattgtagagtctcaatgaagaatataaatataaacaaaaaagataaggagctgaaaaaaccaggagattttccattctacctgtcatactattttttgcctttgcaaaattctgtcttaacttctttcagtgcttacaagtaagttaaactgaattcattttttccaagaactggaattagttgg

SEQ ID NO: 134331 - DNA, 416 bp, Homo sapiens
ccatctggcacgaggactggtgggaacccagccccctacaggacccaggtctcaccccctggacagatgcttctcccaaaaccgtccctgtcctcaaggagctgataacccaggaatcgtggttaatggtgacattggctaacactggatgttgctttcctttaaacctgcagttagctttcttccagcagaatgctgagatattactcctgtgttcacatgtggaaatgcagcatggctgcaccatttcaccatttctaccactctaatcattgtagcttcctcttgctctctttttaagctaagccttagcctggcttcttgtacctatagggagttcaattcatttaccaattcactcaacaaatatttgagtgcttctctggtggaagactaccattccaggcttttgggat

SEQ ID NO: 134332 - DNA, 539 bp, Homo sapiens
cctgttatggtgccagaaattccaccatttataattccttgggggtgagacatcatatcttcccactaggctcccttttccaataataataataacaataatagcaacatgtgcatgtccaggggtgtacagttaacccaggactttcccatcccccaccctcataacagctcggtaaggcaggtactgttttagctattttggacgggaaaccaggactcagaggggtggtgggacttgcccagggtcacagagagcagtaggcgactagactcaggtccaggtctgactgcagagtcctggtctcaatcttggtccccctaggcaatggcagcttgaggtggtggtgcctttgggttcctggaggagggagccatcctcggccgcaggcctgcaaggggccccctcctgggttggggcagggaccagttgtatcccaggttcctcgccttttcctctacagccagacatctctccagtctcaaacctggcggaagtttgacaccacagggatctgattcctgctgagggcctcagat

SEQ ID NO: 134333 - DNA, 869 bp, Homo sapiens
agataaactatgtaaaccaaatattttaaagtttttatatttggtttgaatcaggttagtgggggagagagcgagggggaagaaaataagggcatatacacagtgttttgaacatattcactgagttttagaaggtgatacgctgtctatcttaattaaacaggcatcataaccatttttgcacgtggcccagtgtgaacaacctaggagagccatttgttcaattagtggagatacagactcgggtctgttctatgcaggttgaggcatggtcactactgtttgcctatttctaatcactgaaaagaacttaaagcactgactatggctgtgagactacaaagaacgaagttaaaattatgccttatatcttgagcacaatttccccattctataattttccttggtgttatatcttgcatttttctaaaaggggaaaagagagtgaaagagcaaaaacctaattattgaaactctgtcctcaaactcttttctgaaacttgctctaaggatgaggggtatttttctggcctcatgaaaggatgccctttcttccttggccaacatgaatgagaattttcctctttcttgtaaagaagagagacttcttatgaatgaggctttttagggagggggaagggggttgtctaaaatcttgtgtttatacatcaaaaaatccagtttaacttaaataatttattactttgagtttcacttcactgcattaattgtattaattttatacacgactagacaataaggccaaaattcaatgcctttattctttaaatctgtttctagcatgttgactggcactaagtgaatgaataaacagttaaacaaatcaatgaattcaatgattcttaaaa

SEQ ID NO: 134334 - DNA, 402 bp, Homo sapiens
tcccaccaaagcttccacccttcagtctacgtagatcattgttctgtatccccttgatctatatccttggttgaggaatggaagttctgtggccagcagatagggattccagagctgttcagcttcattattgaaagggaggcacattcatggcttacctcaagatagtgggggaagcaagagcacaagaaattgaagagggaaattagggtgcctaatgtttaaactgtcacaacagttagataatgttgacttccgctgttttctctctggaccacagaattgtttgttaaatggaagcagtgcagtcaaacgttttcaaaagaattgagttcactctaaaaagtactgtttttccccactttctcctgctattcctcagtcactggcactaaaaaaaga

SEQ ID NO: 134335 - DNA, 170 bp, Homo sapiens
gttaacatccccaacttcttcaaaaacagtttctatatttgtgtgctttcacctgttgtttgagctgcaagttttttcttaagttagagtttcttcctaaattaatttttcatttttggtgaattgaatgtttttaggaactgtaaagagaaaatctgaggacaaacagg

SEQ ID NO: 134336 - DNA, 831 bp, Homo sapiens
gagctgtccggtaatagaaagaagctgcagaaccctgttgtcttcatcttttgtttaactcatgcaacatttgaaagcacgtttgcctacaagaaataaaacttaagttgtgaaatggcttattaatgaactcagatgacaagaaaccaaaacagcgggcctggctgaaggattcatccctagccctgaaagccagcggggtctttctgtaacatcaaaggcacaaacaattgaaccgacatggggacttattctgtccagcagccctggtggcctcagaccatccgaagcaagggtaacctaccagaaagctgctagatgttccccactacagtgaaggattaaacaaagaatgaagaagaagtaggactcaagaagtaaatgatccaactcaagaaagaggtaaagggaattccttttaaaggcttcaagacttttctttcccactcctccctgcccatgcgagggaggctccattttaaaatgtacacacacacaaaaaaaaacggatttgaaataagggcatagcctgaggtaacttacccccaccttggcttccagagcagcttggatttcccgatctttgagcaggtcagtgatttggggccccagtaaaagagccgggctattcttctgaaggctcatgaaaagtcacttcttagtggcatagcgagaccacggggtgttcaaaattattccgtagaggcctgtgtgggccccgttcccccattgactttgtttgacggcttcgccattttgggcccgtgccaatccccccgtttttggggcttaacgggccctaaagttatatttttaaaggggttgaaccca

SEQ ID NO: 134337 - DNA, 322 bp, Homo sapiens
ctcacaccttatacaaaattaactcaaaatggatcacagacttaagtgtaaaactataaagcttttagaaaaaatataaggaggaaaatttttggatctagggttaggccaaagagttcttagacttgacaccagaaacatgatccattgaagcaaaaatttgattaattggacctcatcaaaatcaaaaaattttgctctgcaaaggatctgttaagaggatgaaaaaacaagctatggaccaagagaaaagatttgcaaatcacatatcttataaaggctagtgtctagagtatataaagggctctcaaaactcaacagt

SEQ ID NO: 134338 - DNA, 744 bp, Homo sapiens
caacaagcctctatccagagctcagaaactgaaaaaaatatattacatttttcttatacaggcataccttggatatattggaagggagaggctaaaaatctctcatgaaagcaccagtatctgagtgctgaccacggtaggcttctgcgcttacagaggagctgcatcacagatgagagaaatacaaccaagacttcaactacaattgagcagaaagcctcccataaacatgaagacaattcgtaaccagagtttaagttttataaaggtgtctaaaaatatcttattttgaatcatgcaaaagtgatccagtctggaagcattgtaaaaataatgcttccttcccaggctgggtagtttgtaaaaccctagagactagaatttcctcaagcctattttatcctctttattctggagaagaaaacaaatcaagaaatcgaaacacttgaccttggaaaggatctcatcctttgttacagactggctgactctgaatatatcaggaatgtacttcctagaccccaggactcaaatataaccagagtgacagatagggcaggtctgagagaagtagcaaacgtacttcatcttagggtcagaaagaaacatgctggtataattctaacttagaaaataaccaggtaaggggtcttgtaaacttcatacaatgctgctgcctctgagttattaaaaaaattactaacaggcttctgatcaactaaaggaataaaattaggtgttcaa

SEQ ID NO: 134339 - DNA, 401 bp, Homo sapiens
gactgttgcttcctctgcctggcttgtcctcttctctctgttaactcctgctctttgtcaagatctagctcagattattatttcctctctgaagactcttcttggtaaagttgctcgctctgcactgcttcctcagatctttgtgcccttgttacgtgctttttaatttgttttatggctctatctccctaactagactgaaagcacttgaggatggtgaccttttcatagtctttttgttatttgggcacttaacacatagcagctgccccatgattgctggtcccttttctttctctcctcgccaaccacccaccctgttgtcagactgaaataagcccaaaagtccatggaagttggacagctgtattgacaactgagctatgtccaggatcaagcta

SEQ ID NO: 134340 - DNA, 363 bp, Homo sapiens
gccagaatgaccttctaaaaattacatattttatcatgtgtcactcatgcttaaaatatcacaataatttcccattgcatttcaatataaacacaaatcttcaaatatggtgaacaaagctaagcatgatctggcccttgctcatctcagccatatcatttcatgtaattaattttcatattattagactcctagaagttatcaagatcttttcctacactatagccatcacactcacatgcctctacttctatctgggatgctctcgagaccccattctttacctggctaaatgtctgttttaatttatatttcaaagcttagcttaagtgacacttgcttacagaagtctcctttgaccca

SEQ ID NO: 134341 - DNA, 137 bp, Homo sapiens
cagctcttctatatttgtgtgatgggcacagaacaccttcatatgtatgctttcttatcctcatgatcagccaacagaggcatgaatctaccaaaagaggcaaattcctccttaaaaaatgcagaattttaggctgg

SEQ ID NO: 134342 - DNA, 318 bp, Homo sapiens
tacaaaactcagtatatctaaattttgcctttgcataattaatagtgcataaatctatataaattacttacttaacaaggtcattttttctgctactataagcaacctaggaacactagtgattaggtggaacgttttaaaagcattttaacatcatcagcaggacccacccagacaaaagacatagtatttcatactaacgtacaagttatcaacttatttggaacaaagctttaacataactcatgttcatatagactagatatttaagtatgcaaaaacaaaatagaagaaaacagaagttagcattttatagca

SEQ ID NO: 134343 - DNA, 788 bp, Homo sapiens
tgccaggacttgcaggatatggtggcaggtacagcattttactagacatgaaatatgtattgtccttgtcaaaaggctattccctaatccatttacataagcctctgtccttcaaagacttttacaaattgttcatgttcagcgatcattccagttcttcccaaaagccatatatctataattcacagcagcttatgtacaaatattttgtttgcatctgattcactgatgttcaactgcatgacgcaaggcaagcagtacccgggatgtaaaaggtagcagaaagaacctggatactgggatcaggcagattgaactataatgttttatttttaattttggatttctcatctgtaaaatgggagcatttatatgatttggtagaataaaatgtataaaagatctatcaaaaaaaaaaaaaaaaaaaaaaaaaaaaattttggggggggcctggggcccgaaaaatttcaaagaccacttcggtgtgggaggcgggcggcccaagagaggacaaggtggacacgagtgcgcacaggggtggacccccgaaaagaaaccgcgggccgaggaacaaggtgcgtcggtgtttttcccaacaaattaaaaaagcggcgggggaacccaagagctgttttctggaaaccaatcccaagagggggattctgggagcacataaggggatctcacaagagggtctccaaggcaggcgaaataaaatgacgagcggcggtgtgggaagagagagagcgacaaagaaaagagacacaacgaagtacagcatgaaacac

SEQ ID NO: 134344 - DNA, 552 bp, Homo sapiens
atttccattcttcacaagaattatgtgcattttaagcatggttgaaatttgctgccacaaccataacattaaaatttggagatcattgtagattcatgcggttgtaagaaataatatagagatcttgcataccttccacccagtctcccaaatgataacgtgtgtgtaactacagtatactggacattcctcccccttttttttcggagaagttacagattgcctcataatcctgtggggatactatgtggctatgatgagtgatgactacactgaaataggagaactagacggtttcatgataacctgatttttttaaatccagagctgtctgaactggaggattcagcagaacaacagtatccacatttaattatgcatgaagtccccttttctctaccttaagcaattaatttcctcccaaaattcaatgtggaggaggttagaaggcacatctggtccctctgccctcccctgcctttactttaaaccactggttttacctgttttgtaatgtggaggtttcactggcaattttatttcaagaagaaa

SEQ ID NO: 134345 - DNA, 719 bp, Homo sapiens
gccaaaactcagaaggagtaagaggcaactgcctcaaaggtactcaggctgcgggtaaacatttgacggaataaatgctctttattcacagcctgtgttgaaatctccctgaggatgactcaccatgccttttcccaacatcaggcccaggaagccacggactttcccatgtcatcactgacttgcaagcctggggcaaaaccacagtccacccagcacagaacttggttctgcgaccagaaccaaagatgaacttgtaccctaggaagatgtggtcttctaagcctgacaaaggacgtcaattttccccattcctctctcttaattcataatagaagggtttggttaattacacctgggataatgaataactaaaaatgtgttcttcgctacgtaaacagaacacattctctattcatttacagttaacatttcaacttcctcttagtctcacctcccaggacaagatcaatggacctacattcatctaaccacattgtcgattttccaggcttcttattttctccatcttttttctagttgaagattcctcattgttttagactttcttcatcacagctctcacatggcagtccagatttgggttatttttaatctttttggagttatttcaagttgtttgtctagtttaaatccaggcagacttcaagatttttccctttgttcctgtacaacactggtgaaaggagggtgctcca

SEQ ID NO: 134346 - DNA, 660 bp, Homo sapiens
tattcacagggtctggggattgggatatggatgtgtcttttcaggagccaccatttaacccactaaattcattatatgctgtttaatgctgtatcttccttttggattgaagagatatgcttctgtttgaagatgggcaagtgggctagggaatttttggctagtaggtagaaaggaactttaaaaatatttctggttggtgctgtttagtaagtgcttgttaaactttcagaggtcaaatatcttgaacacaaattggagaaggagtaaatcagtataaagtgaaaaatatgatattttctccaaaaggcagtcactgactgctttggcagaaagaattgaggtgattactcaagagttccaccaaattgttgtgctagcttttacatttgcaaactataaaaaacgggactaaattaagtagcagctcactttttttattaacagtattacaagttgactttttcatttcttgtgtaattgagataaaagggggggtgtgtgtatgagagagagacaaagattttgttaatggttttagtatgattcatttcttatgtcatatgggcattctaatttgagtcatattaattaaggtgatctatgtatgtaaactctttgagggagggacttggcatgccttgtatacagctagatccc

SEQ ID NO: 134347 - DNA, 240 bp, Homo sapiens
taaacagtgttgaactatatgctgtctcataaacccagttgggcaaatattataggcctatttctgtcacctctggctggtggagtgtttgtatttgtccacacatcctttatgcccagggcacgccctggataggagaagcttgtgccctcccagatggaaaatgcccataactcatcagcccaacattggactgctaattgtaggcctggattcatagtgttcttgaaagcttcaggg

SEQ ID NO: 134348 - DNA, 398 bp, Homo sapiens
ctcaggctcctccacggtaaaaacttggtgccatactcttaagcatatacggtcatacagacaagaccgaggctagtctttctgggctatactaacccttttctcatgtcagcagcttttgtcctgaatgtagctccttggtaacatttccttggaaagatctgaaaaagagccttcacttggaagccaagagctcttgatcccagcaggttactcacttgtcagtgtccatgtagctgactcaccttaggcctagatgttagaatccattttcttaccaacctcacacagttatagtgcaacatgagtcatttgttgcacttctatgaatgagttattgagcatttctatacatgcatttatatatcaatcaagataggctaggttacgctgcggta

SEQ ID NO: 134349 - DNA, 150 bp, Homo sapiens
agggcagggtccagagaagctactgcaaccacgcagcctctccacaggactgtctttctacattaaatgttactgaggaataccaatttaaaatcagagtcttctcttcgtatctcattaatttgcttgcagttgcttgtagcacatctc

SEQ ID NO: 134350 - DNA, 685 bp, Homo sapiens
agttcataaaatttgggttgtttttaataatagttatagcaatagtaaaaaatttctttttctacttactatattatgtaaggtgaaatacttgggattaaactgaaaaccctaatagattctagaatcaaacaaatgggggttcaagtcttggttctgatgcttactaaatctttgaccttgggtacattatgtaatctctctttgtttcctcatctgtaaaacagggataataataactatgtcatagggtttatgtgaggtttaaataataccctgtttataaagcccttgcatagtgcttagtagtgtttaataaatggtagtagttactttgacaaaaaagtatgagtcctaatttattgtgaaactaccaccaaaatcaattaacaatccacccaaattttgtaaaaggtgtttggaatgtctttctgtccccaaagcttgttgatcttgtacttttcaattaatttattattgtcctcttgagatttaacctgcaggccagtggtttctaaatgataaactgtggattggtgctggttagtgagaaagttttcactgggccttggtgaaatggaagagtaagcaggacaatgtaatgatatcataaagttaaccttaactcagagctcagcgcctgctctttttagcatgtgcgcacgcgtgtatgtgtgtgtgtgta

SEQ ID NO: 134351 - DNA, 104 bp, Homo sapiens
tgtatgcctggtgtgtatgtgtatgtgtgtgagctggtgtgtgtatacgtgtgtgtgtgtggttaatgtgttgttcatgtatgaggtgatggtggtagtagtgt

SEQ ID NO: 134352 - DNA, 598 bp, Homo sapiens
  misc_feature (598)..(598): n is a, c, g, or t
gtgtatgagccaagaacttagtggacatatctgtactggagataaaatttgggagttgtcagcaaataaatggtgtataaagcaatgagactgaagagatcacacacagaatgagtgtaaatacaaaatgagaaattcaaacactgacccttaggctgctccaaagtttagttagagacaatggagaccaaaaaggagctgccagaaacataggagaaaaaaaaaaaaaaaacgatgcgggtgggcgccgccggggcccccggagaaagaccttccaaaaccacactggcgggggggcgcggggggccccaaggggcaagggagaacggggccaaagaggggtgccccagagagagaacaccggggaccacggacaaagagggaggagggaattctctccacaccaaataaaaaaaggcgccgcgcggggggacacacacgggagaggagtttggaggaaaaaagaatccacgagaagaggagatgtctggaggagaggcacaaaagagggggggactcatttcaacaggagggagcccacaaggaggagactcccgcgaaatctctacaaattatgcccccagagcggggggtgaan

SEQ ID NO: 134353 - DNA, 429 bp, Homo sapiens
gattcagcaggtctggggtgggactgagagcttgcatctctaacaagctcccagcgaggctgatcctgttgctccagggaccacaccttgagaaccactggttgggcattgatgaggtcaaccaggagaagcagtgtcccctagaactggcaggagagaaaggacaaggctaagaaacagtgaacaggagtcaagtaaatgcagctgccaacaggcgggggtccttgagttcacattcttggttccaggtgacgtttcctgggagtcaacaacccttctcctatgaaaaagaaaagggccagacacagtggcacacggctgtaaccccagcactttgggaggctgaaagcgggaggattgcttgagcccaggagttttagaccaacctgggcaacaaagcaagatcttatctgtacaaacaaaccaaca

SEQ ID NO: 134354 - DNA, 361 bp, Homo sapiens
ctaatttgtcccaacttctattcttgccctagcccctaccacaccttcctcatctagtgctctgagtacagtgatctttctaaaatataaatccattcgtgtcaatcttttcatttaaaatgcaaaataaactctaactttggatacaagggtctactctacctggttcttgattgtccaacctcttctcaatgtccctatcccattcactgactactacccagctatgcatttttttctgttactacacatgccatggcccatacaacctgtttgcctattgtcttttttcttcctcacccagctaacccacccctactcagctcattcctcatatgccagatcaaatgccacttcctca

SEQ ID NO: 134355 - DNA, 750 bp, Homo sapiens
ggaattttttagcaatattattgtaggattaataatattaaatatatttaaaaatactaaacatcataatatctgctcttcagagaaagctcagtgaacctcctgattggtagattaatattttgctgttttcattgaggcagtctgttatatcttataaaggcatcgcagtgggttaaaaatatttttttaaatatgttcctgctggaaatcagctgcaggcaaagtttactatttctctacatgagaaaatacaaggtttttaaaaaaataatttgtggctattactgtcagagattatacagctaatctttgatggtataccactttaattctaaaattatgtcctttagcttctttttagatgaagtggattctgataatttctaattgttgtatacttatttttatgtgaaggggaaaagcatactaactgcgtttaaggctatgagagcagtgggtgacagaaggggaagagaggagagagaatttcaataaaggaaatgctgccaaaattcagaagaggaaaataaataatgtttagcagcctagccaactcttctgctaggaagatacattattattattccaattggctgatatctaatagtgttgctagggatttgatgtcagaactgttcctacagaattatttgcctagccttttggctaacaaaaaaaagaaatagccagaagacttggctgcaggtagctttgaatatttgtaaatcttttcataatttattttaa

SEQ ID NO: 134356 - DNA, 324 bp, Homo sapiens
gttgagcagggctgggagaaggctgtgggcagggagcagtgaggatgggaagcatgcctgtccttcctgttgccattggcccttgccaccttatggactctacgtcgaaagtgcgcaggtttgggcaagaagggatctcctcagttagtgttaagagctggagctaggattgtgttaactcgttcaagacacagcatggtactgagggaattagtatttattgaatgcttgctatatatgccaggccctgttttagagattttctttaaaacgcccatgggaagaggagggaaagtaaaggatgaagtaaagccagaaatagaa

SEQ ID NO: 134357 - DNA, 206 bp, Homo sapiens
tgcctaggagttgcactgatagcctagactgactttcaaatttacttagagacccagagcactttagcccatggtgggtcgcaaagtttgcaggaactcaaattccactgggatccataatttccctcttgttagggctggtttaaatgccccctctatagggaccagccctacagggcctgtgggtttttctcctcgtgtgtgga

SEQ ID NO: 134358 - DNA, 812 bp, Homo sapiens
cagagatttgctgtgcttgtccaagaaagcaccctatgtgttcagagtggccgagacgggacctctcccacagcctggcaccaggtcctggcaggaagcagcccagtctgaagaactcagacaaagagaggctcatcaagaccaggcaagagaagcagcagtgggtgtcagagcaaccagactggcaggagctccctccaacccctgaggctgaggggcagggctgggcaatggtagcacctgagcccattaggacctggaccctggagggagccggcaggccctgggcaaggcaggctttaagaagtgcagcgaggaagagtctgtgtggggtggcctgggtggtgggcacggagccgggtggttgcctttcacacaggcagccctggccctcagccatgggtggggctggcacctcagtgattggatggaggaagtgctaccagcttctgagaagcatctgagtgtcaacaagctgacactaaaagggggtctgagtggggagtctctgctctcctacacaatgtgctccagaaatgtgctattcggagctttgcctgtgaccccctgcttcggaagcattcctgcccatgtgccccactgatctctgcttttcctggcagcctgtctggagaaccgacccctcccagggaaggtcatctgtgttatgggcgtgggagcatctgctatgaactgtgtcctcgtaagagacccccatgaagagggggtggcctcatctgcggccccattggccgctgtgcccacagcccacagtgagagcaaggttggcaccacacagattgccatgaggg

SEQ ID NO: 134359 - DNA, 798 bp, Homo sapiens
actttttatagagtaactcttaatctgggtttttctggtatttcttgatgattagactgagcttatacatttttggcggggataccacagaaatggcattgttcttttcagtgcaccgtatcatggtgtcagttgtcccattacaaggatgttaattttgatcacttgtattaggtgatatctgctatattactctactgtaaagtttctaattttttacgttaagttagtaagcattttgtggggaaatactttcagatgataactattttgtttctcaacaaactttcacacactcattttagcatccagtgatatttcttggtggaattaattgttactctggtgttgccaagtggggattcttccaattgtattattatttctgtgtttattctgtggcattctactataaggaaaatattctactaaagccttggaatcagccatttctccaaagagccttagtttcttttagtggagaatggtttttagaaaccatgatctgagcctcctgggttgtcattgcttttaggcccctttgacagaaagagctaggaaacatgtattagaaatcacaagttttcctgatatctccagttccagtccaaccgctacagggttcttccttgccttttcctattccttacttttatcttcttccacagtcaaaaccctggcactcagcattatcagtgtatttgttcattcacaaaactgtgaatgtttaaagtgttaggtatgtatgccttttgtaattaaaaataattttaagtttaaaaaaaaaaactctgggta

SEQ ID NO: 134360 - DNA, 877 bp, Homo sapiens
actttttatagagtaactcttaatctgggtttttctggtatttcttgatgattagactgagcttatacatttttggcggggataccacagaaatggcattgttcttttcagtgcaccgtatcatggtgtcagttgtcccattacaaggatgttaattttgatcacttgtattaggtgatatctgctatattactctactgtaaagtttctaattttttacgttaagttagtaagcattttgtggggaaatactttcagatgataactattttgtttctcaacaaactttcacacactcattttagcatccagtgatatttcttggtggaattaattgttactctggtgttgccaagtggggattcttccaattgtattattatttctgtgtttattctgtggcattctactataaggaaaatattctactaaagccttggaatcagccatttctccaaagagccttagtttcttttagtggagaatggtttttagaaaccatgatctgagcctcctgggttgtcattgcttttaggcccctttgacagaaagagctaggaaacatgtattagaaatcacaagttttcctgatatctccagttccagtccaaccgctacagggttcttccttgccttttcctattccttacttttatcttcttccacagtcaaaaccctggcactcagcattatcagtgtatttgttcattcacaaaactgtgaatgtttaaagtgttaggtatgtatgccttcatttcattatttacccagtagtcattcaggagcaggttgttcagtttccatgtagctgtttggttttgagtgagtttcttaatctgagttctcaatttgactgcactgtgtctgagagactgtt

SEQ ID NO: 134361 - DNA, 418 bp, Homo sapiens
attctgtgtcccacttcttaggaagccaggggagtatgtgtatgattttacaacataagtgagaaggatgagaagaggaagacatgattcacagaaacagaacataccaacttagagcagttaggattgaagcaagaggctaggaagaaaccaaaagaatatttgaatcagtacatctattaatatgttcaggtatttggaaattacaggtgttttacagatctgatataggtacataaaaaaactaagcaattaaaaaagcttagcagttattcagagaaaacaaaagattatttaagaaaagataggacggctgaggtaggagaatcgtttgaacccaggaggtggaggttgcagtgagctgagattgttccactgaactccagcctgggcaacagagcaagactcttgtctcaat

SEQ ID NO: 134362 - DNA, 593 bp, Homo sapiens
ctcgatctcctgacctcatgatctgcccgcctcggcctcccaaagtgctgggattacaggcatgagccactgcgcccagcctggtgagttttataacttccctttctctgcccacctccaacctagctattggatttctctgttgaacaatgttagcacttcactaaagactgctgcctggatgtgagggcgatctggctgcaacatgttaccccactgatcgccagggttgattcagctgacctggctggctaggtgggtgtccccttcctccctcactactccatgtgcaacctcctgaagctgtgcactccgttaaagaggacaaccatccccgatagacaaggaccagtcttcggtcaagggcatacaagtagctgtgctcccctgctagaccctcccaacaagctctcaagactgctgtctgccaatctgtatccagagttggaaaaaagaaagaaaaaaaagaacttgtcccagagtgttccttactgagttataaattagttgtaatttggaaagggaacattctgtggtagatagtgattgaaaattcaaagatcaaaatattaaaggatgtatattctgagaaa

SEQ ID NO: 134363 - DNA, 399 bp, Homo sapiens
gtaacagtgcagtgaggtagatgctttaatgacagaatctgtatagtggggaccccagggatggagtggttatccttaactgaagaagtcattgaaggtatcactggaatgactatatctgaacctgaattttatatagttcctaaagtgaagaaggggaagaaggacattccaggagtaatttttaagatgtatgcctcgtaactgatagatgaaatataaactccgtaattacatgccattgcactgaaagctgttataatgtgtattttttttataactataatttccattttttggcctatagctctgctttttgttcttagagttaaacattgttctccagtagggtgatttaaattatgtatttgtatgtgtgtgcatgtgtgtgtggggggg

SEQ ID NO: 134364 - DNA, 207 bp, Homo sapiens
ttgcaatggattttggtccattgatcataatgacatgtgacatctatttcaacacttagtatgtggcaaacatggtgctttgtatgtattatcacttttactgcctacatcaacaacattatgatgtaggtggttctgttccctcagttttggagaacaggaaatggaggcacagaaagatgacataactagtctgaggatgtaggg

SEQ ID NO: 134365 - DNA, 563 bp, Homo sapiens
catttcttgaccgtacagcctccatcttcaagccagcgacggcacaatagatcctttctgtgcttcaaatctctgacctccgtttctgatcttgacacccggatttaaaggttcaggtaattaggtcaagctcagcaggacagcctctccttttgtgttcaactgtgccatataaagtaacgtcacgtaatcgcatcatattcacgggctccccacacgcgcaagggaggagattacatgagggttagcgtcactggggttctcttacgattctgccttatatattttacaggtggaattgagagatttctgaccaattctgggtttctagcttggacagccggtagggggcggggggtggtaacatatttaactaatagagagagagtgcaaggaagaggaggaatttggtgagtgtaaggagactgtgtccaggcagagctggctagaaggccatggaagtgtggctcagcccagctggatgagataacacactggtggtgaaagcaacaagggtggaaaagaaggtccagccagggagtggaagatgagaagacaggaga

SEQ ID NO: 134366 - DNA, 493 bp, Homo sapiens
ccccattttacagatgaggaactgagactcagagaaggggagtaaagtgcccaaggacacacagcaagtatatggcagaactggaaaccaagttcctgcagctggctccagagctggagccccaaatcacacactgggagttcagcctgtgtgcaccccttcctcgggcttgcaggatgaacagctgccttctggatggtctgcatgggaagcatattcagattgtgatttataaaacacaatgaagataatagaaaccagccctgacacttacacagggctttgtgtttccagatacctttttttatcccagtcattgctgtgtcttcctggctccctcgtgaaggggtgaacaggtatcgcctctctagtttcccaggaaatccagggccacactgtaagccaggcacagctggccagaggaatcagctggcctctgattccagatcacggcacactctctctccttacttttttaacatgttattttttc

SEQ ID NO: 134367 - DNA, 366 bp, Homo sapiens
ctttgcctcaagtgccacctgtatgtttccccttatttaatttagcatcacaacagctttctaaaaattgtcttttgggctgggccactaaaaaagatcttttggtctctaattgtgtttagtgctccataaaataaaccgccaaacagataacaaggtcaggtagcctttaagaccaatataagttagcaggaagtcatacattaattgttcaaggccgggtgcagttgcttatgcctgtaaggccaaggtgggcgcatcacctgaggtcaggagttcaagaccagcctggccaacatggtaaaaccccgtatctacaaaatacaaaaattagctgggcatgatggcgggtgcctgtaattccag

SEQ ID NO: 134368 - DNA, 494 bp, Homo sapiens
actgctttgagagcctctaaaactatgatccagtcttaataataacgtaataggtatagttccacacactgaaatagagatgtcataaactgagtagaaatgtgctttaaacacacacacacacacaagcacacacacacaacaccaaatccagctcaacattgtgaattagaaatccaaagcccaaggaagaccaaaagttcaaggttgcacattgggttaggacagaaattggcctctgtctcaggcatcgcaactcacactacagtcctctcccaccttgctgggatgctttcactaagtctactctccagagcaatgtttctgtattagtaaggatctccagagacatagaaccagtaggaaatatatagatttataagaggggatttattatagaaattggctcacatgagtatggaagacaagaagttccaggatatgtcatctgcaagctgtaaaaccaagacagccggagctgcattcagttagag

SEQ ID NO: 134369 - DNA, 264 bp, Homo sapiens
ggcaaaagagtgctttcatggaagcaaacaaagtaatattgcattctttccagaagattaatttggctacaatatatggaagataaataacaatgggatcaattaaactagttcagaagtatttgcaatatcgaagtcaagatacatcatgaatcctgcctcttcggtcctcgtggcagtaggattgagaagaggtggggaacaggaccatgatatatatactgtgcaagtagacaactgatgtgagaccatgtgaaaaatacc

SEQ ID NO: 134370 - DNA, 551 bp, Homo sapiens
aaaaaaaattgggagagtggggcttaaatccacgtgatgtcagacacccgggaggcagcgaagcacagaggaaagaccatggattgagagtaactggcaccagccctcactatgccacctgccagctgtgcacctttcatcaattactccacacctctgagcctcagtttcccctgcggtaagatgctgatagcaacggtactagtgcttcccagagctgtgtgatgattaggttagtatataacttaagtgcatccccggataaacagggaagtcttggaacaccacagttttattctatttcaggtcttaagctactacgacttatattgtggtaaatctttgaagtcttccaaagcagatctgttgaaactcaaaacagcagtttaagattcccagggctaccttctgccctactcaaaaaattcacaaaatgccaacaacgatgttaaaatcctggtgggagctgtcgcagagctcagccatcaacctttgccacttcctgttcatcagcagtacagccccagcacatggacgtcacagagaaatcc

SEQ ID NO: 134371 - DNA, 391 bp, Homo sapiens
tctagcaggatcttggaactgtttcggatgctcagtgggagggagggccacgagtgattagcaatgacatttcagccacagtgggatcccgaagcgggctgtaaatgacatgtatgttattctgttcagcccaagtgaagaacggacatcaagtgagctcaggtcccaggtgacaggaagtgccactcaactttttgatatctgtgtcatgacactgcttactatgattacggtcattagctagtcacttatcttcctttatgagcaattgtagcagctaccatttggggacttctgagccaggtgtggttctgagggctgtataagcatcagcccgttttacagatgaggaaactgggacccagggggttaagcaacctcgaccaaggtc

SEQ ID NO: 134372 - DNA, 216 bp, Homo sapiens
tctgggatcagaatcctgaatatggctaaaagatgtacgtcttagtacagacatttatagatgatgatgtttaataccgtagcgatcagattccaatgaattaaactgagagaagaaaagaaggaagaaggtagttgaacaattttagaatggttgtttggtcaagaattactaaaatgagaaaatatttaaaagttgtttgaatttttattttat

SEQ ID NO: 134373 - DNA, 358 bp, Homo sapiens
agcacttctcactctgtgggaggcacaagaatgcccccctccaaagagatacacatcctaatccccagagcctattaatatggtatgttatatggcaaaggggggattaaggttgcaaatggaattgtttgctgatttgctgactataaaattgggagagtatcttggattatccaggtggacccaatgtaatcacaagggtcctgaatcttggaagaggaaagcagaagagggattcagagtggtgtgacgtgagggcttagcttgctgttgctggcttcgaggatggaggaaaggggctaggagcccaggaatgcagcagcctccagaagctggaagaggcaaggtaaaggattct

SEQ ID NO: 134374 - DNA, 569 bp, Homo sapiens
ttaagagacagggtctttaaaaaagtcctgcagtctgcagtcgcccaggctggactgcagaggcacaatcatagctcacggcagccttgaactcctgggctcaagcgatcctcccacttcagtgtcccaagtagctgagactacaggcacacgccagcatgcccggctggttttttaatttgtatttcctttgagacagcatatctctctgtcgctcaggctggggtgcaatggctcaatcagctcactttagccttgaactcccgggctcaagtgatactgccacctcaacttcccaagtatgctactacaggaacacaaactccttttttaaattttttgtggatatggggtctatgttgcctaggctggtcttgaactcccaggctcaagcagtcctcctacctcagcctccccaaatgctgggattacaggtaggagaattgcttgaacccaggaggtggaggttgcggtgagccaagatcatgccactgcagtccagcctgagcaacagagcaagactctgtctcaagacaataaaaacacacaaaaaattaactcgccatgat

SEQ ID NO: 134375 - DNA, 182 bp, Homo sapiens
accctgtttatgccttatcctactgttcacaacgccctgtgtattgtggatatgtttaatgttactcttccagactttgggatcaagttccaagtcatctcaaaaaagtgaggctttccatgcccttgcacccacctccccagacaccttttctccagcttcactgtcccctggaattccaa

SEQ ID NO: 134376 - DNA, 351 bp, Homo sapiens
acttcagcgtttcaatagcaaccactctaatattttcagccacaaattggaagcgggccccagtgaaagaacacaagaagaattcatggaaagaatcttaaaaaatactgtgttgtgctcagacaaaggaagagtaggcaagcttcctcaagggatatctgcatgtggcaggtggattctggtcttcgtaattaatgagagttgtactgtatagcagatgctattgaaacttctaaaactaggcctagttttagaagtttcaatagcacctaaataaaaccaaccccaggcagcaatgcctagttttagaagtttcaatagcagaatcatgtactaccgggccgagctcga

SEQ ID NO: 134377 - DNA, 215 bp, Homo sapiens
tgaagaacacagggttgagtgaaagcagaaaagggaataataaggcaagagagagagacaagagaaaaaccaggcaagggtaggtcagatagaggtccaaggaaaagaagaaacccacgtaaggaagacataaatagaaaaataaagaagtagacatagtagacatagtaggcatagaaggacaacccaactggttctgaggtaagtgaatgaaa

SEQ ID NO: 134378 - DNA, 283 bp, Homo sapiens
ggtcctctaagaacacggaaaccaaggaaacacacctcttgccccaaacaaggagatgttaggtagtgcaggttcccatggaggaaatgagggaagcagaagcttgtttggagatcaggctgcactgaacacacaggcagcaggctgtgactcttcacgctctgactctaccattttaacctggctcctcctggggcttcagaactaagtgagccttattccttccggacatatcttatctctttgccttttaagtatttcttcatgttcaacttgtctctat

SEQ ID NO: 134379 - DNA, 257 bp, Homo sapiens
ggcactagcgccccaagtcctgtgtgctcagagcctcccaaggcttccagtccagcaccctccccgacctcggccacagctgtcacttgtgcccatggagcgctagggcccggcactgtgcctgctgatcactgggctccgtgtgttttgctgcgggaagaaagggaaggagggagaggagggtagggaaacaggtaaccaccacaaggtatgaacaaggctgtgaaaaatgtaaatgccaggtgttgtgaaacaga

SEQ ID NO: 134380 - DNA, 720 bp, Homo sapiens
agaagaggatttttggttgatgtcagtttctaaagaatggattataaagaatcacaacttacaaatgaaacatagactcaaaaaaaaactttaaaaagtcactaatacacaagtcacaaccatttgaacaggtaaagctagtgattaaatggttatcatattctcaaactagagcaaagttttatttttgaaagtcatgcttagtcagaagcctcaggaatcaagttatttagtaattaaatttattacccagaaaaggaaaagtcacacagctggtgagaaactaatgatgtcagcatgtaaaattatagtgcgtaaaatgtttggataggatgcagtatgagaaattgaaggctttgctctcaaacagagtaagttgacgtattgatgacatgtcacatcatgcttaagaggttttgtgtaatacatgaaaaacaacagtttctctccagattgatgagtcaacagatttcagcgagaaatgtcataatgttgcattgtaagatttgtaaataatggtgaaatttaagaaaacgctttttctgctgcaaaaagtttcaaacaacaggtaagtgccaggttaaatttaatatcttgtttccatatcttgaaacaaaacaaaaattgaatgttggagtaactaagttggtatttctgtggatgctgcctattcagtggttgactctatcagaagtttcacctctttcaaaaaaaaaaaaa

SEQ ID NO: 134381 - DNA, 535 bp, Homo sapiens
ctgctctttacatataacagctccatggactttgctccttggtatttacaatgtttaattgggttgctttgaaataacatttatctgacaaaggctgatatctaacctagtcagaaatttcctaaagtttcaggatacagattatgtgatacagatagctttcttactgcatgagtttagtaatttcataaaatcacataggtaaggatgagaaaaatgactctttattcccatagtactgtaagtcacatgtagtttcttgaaatgatattctgaaaaaagtattcaccaaatgccatcattttgaactcactttatactgactcttgatctgatgattggcctcagtggcctttcaggtaggaaaagaagtatggaagagcggagtgagctgtttgttaagttaaaagaaattcatagattactgacaaatgtggagtcattctaggttttaataaatttgactccgtttgcagcttagggtgaaaaggggttaattttcttttagtaggtgaaaaggtgttaattttctttt

SEQ ID NO: 134382 - DNA, 446 bp, Homo sapiens
acgctcgctctgtgggggagagggggccccgggagagggagggatggaggagcggggagctccagccagagaagaggaaagagaaaggagagagctaggaactgggaaggaaaagagctaggaggagaccatgagacagaaagagaagagggtgaagagagaggatagtggctgggaggagagaggaggagggaggagcacagagggagaggagaggaaacagccagagaatctgctagaagggagagaggagagagaagagccggacagggagagcagaagtgagaaaaaggagggtggccacagagaggacagcgagaaaaagagaacaggtatcgtgtgttccccatgtcggaattctctctctctctctttaagacagttaatgctgttacagatgctaactgatgccaggacggccatgtcacaaacgagtcctacagctt

SEQ ID NO: 134383 - DNA, 611 bp, Homo sapiens
acgctcgctctgtgggggagagggggccccgggagagggagggatggaggagcggggagctccagccagagaagaggaaagagaaaggagagagctaggaactgggaaggaaaagagctaggaggagaccatgagacagaaagagaagagggtgaagagagaggatagtggctgggaggagagaggaggagggaggagcacagagggagaggagaggaaacagccagagaatctgctagaagggagagaggagagagaagagccggacagggagagcagaagtgagaaaaaggagggtggccacagagaggacagcgagaaaaagagaacaggaagaggggaaaagagaagaaatgggagagggaagaagggtgggagagaaaacggaacagagagggggcacagacagcggactggaccgagagggagatggagcggtgcggagggggagagagaaagagggagggaaggagggtaggagagggctggagataggggaaaagagaaaaggagggtaggagagggctggagagagaagggaagttaagaagggaaggagagagacagacattagggaagaaggaaaggagaaaggaaaaaatacaaaaaag

SEQ ID NO: 134384 - DNA, 837 bp, Homo sapiens
agagctgggaaatgtttgtgatgaaaattattaggaataaggaaataatgatgctgtgtgagaaagcaagtagacttaaattctgagatagaaacatctgcaatcaacatagagaaggctactttacaaaaatgttatttcagtgcccgtatggacaaatctctttaaaaggctttgtctactgtgtacataaaggaacttataagcttcataaagtgcttatttttctctaggaagcccatgtgatagctctctcctctgttttcccactccttccccagcttttcctgctgcccactgctccaaacactgacatccagtggccagagaccagtccaaatggagcactaaaactacatatagatagtgatcatattgtttaaaatgttattgcaacatggtgtgtaaagtgcacaggtctgaaatatacagctcaataaatgtttacatatatatgcgcccatataaccatcattcagatcaagatgaggctcccagtcagtcctcatacataaccaccactctgacctctgtcactgttgttgacattcctatacatggaattatccagtctataggtttttgtgtctggtttaatttgatcagcattatgtctgtgaaatgcatctatgttgttgcatgtagcaataacagtagtttgttctttttcgttgctctgtagtattccatcagataaatacatcacaatttatccattctcccactgatagacattttggttgtttgtaatttttagcttttgtgtttaaagcagccataagcattcttgtgcatatattttaatggacacgtacactcatttctcttgtgtgtcca

SEQ ID NO: 134385 - DNA, 690 bp, Homo sapiens
gtgaactgctaaccatattcccaacacgtttgagcagttagcacagtgcctgatacagaactgttttactagcagtttgagaggtagaatagcacggttaagacttaaaccaccgagcgcggtggctcacgcctataatcccagcactttgggaggtgtgtggatcacgaggtcaggagttaaagaccagcctggccaagatggtgaaaccctgtctctactaaaaatacaaaaattagccgggcacagtggcaggcccctgtaatcccaactactcgggaggctgaggcaggagaatcacttgaactcgggggacggaggttgcagtgagtcgagatcacgccactgcactccaacctgagtggcaaagtgagactccatctcaaaaaaaaaaaaaaagacttggactcggagttttattcccagctctgcattcaccagctgtttgcctttgagctagttacttggcccctctgtacttccatttttgcatctgtaaagtgtgaataatagtatccacctcacagggttattgtgaggattaagtgacctgctgtttagtaaattctatgcagatgtgtgctattatcattgctattcttcctgagtcattcctccagatgggccattctcagattaggtttaaagagttaaatgactcccccccaacccccccacccccacccaata

SEQ ID NO: 134386 - DNA, 235 bp, Homo sapiens
  misc_feature (208)..(208): n is a, c, g, or t
attagctagcgctcgctctactctctctaacgggaaagcagcggaatacaagagactgaactgtatctgcctctatttccaaaagactcacgttcaactttcgctcacacaaagccgggaaaattttattagtcctttttttaaaaaaagttaatataaaattatagcaaaaaaaaaaaggaacctgaactttagtaacacagctggnacaatccgcagcggcggcggcacggcg

SEQ ID NO: 134387 - DNA, 192 bp, Homo sapiens
caggcatatgagatttttcaaagggaagatatcctgctccctttgtccctgaatgacacatggtgaggaaggagctgagaagaagtgttcccactccctacactcataccagtgtgacaagtccacaaggggatgtagcatccccagaccattctgagggttaacagtccttcttacagacttcatttcttt

SEQ ID NO: 134388 - DNA, 375 bp, Homo sapiens
caggagagaacccctggaaatcaggttaaccagaaacaggatagataattacaggctaatcaccgacaggcgtggttcacagccccctccaaaccacctttcgagggatgatattgccagttatggttttacccaggaactgaccttggcccagagccttcaattcactcggctagggactttgcataccagagaagtcattcccagccaatagatatactttccacattccctttaaacaaggcttgtgttggtgttaagataagctcgctaagggtaactaaaggacagggttggaaactatgaaacaaggataggaaaagtaggctacataaataggagcccctggaacaactttatgagcagccccaggga

SEQ ID NO: 134389 - DNA, 182 bp, Homo sapiens
cataaaaatgttttattcataaatgagaacattatgtactgaaaaggaacaaagatgatggaacaaaaaagacttcttgagaattaaaaggtgattgagaaaataaacaactctaggacaagattcaaaaagataggcaaggaagctttccagaaaatcaactaaaaggatgacagaaaaag

SEQ ID NO: 134390 - DNA, 713 bp, Homo sapiens
gctgtgggtcagaaaagaagcgacaccgacaacatttggggacttgaccctgtttgcattgcggcatgtttgaaacattttttaatggaaatttgggaatagagggccgggcgtggtggctcaggcctgtaatcccagtactttgagaggccgaggtgggcggatcacaaggtcaggagatcaagaccatcctggctaacacggtggaaccccatctctactaaaaatacaaaaaattagccaggcgtggtggtgcatgcctgaaatcccacctcccaagtagctgggactacaggtgcacgccaccacgcccagctaatttttgtatttttaatagagacggggtttcaccatgttggccaggatgggctcgatctcttgacctcgtgatccgcccgcctgggcctcccaaagtggtgggattacaggtgtgagccaccatgcccagcctctgcatttatttttatttatttatttttatttttattttgagacagtcttgccctgtcacccaggctggagtgcaatagtgtgatctcagctcactgcaacctccacctcctgggttcaaacgatcctcctgcctcagcctaccgagtagctgggagtataggtgcacgccaccacgcccagttaacttttgtattttttagtagagacggggtttcaccatgttggccaggctggtctcgaactcctgacctcaagtgatc

SEQ ID NO: 134391 - DNA, 716 bp, Homo sapiens
ttgaactctggcctcaagtgttcctcccatctcagcctcccaaagtgttgggattacaggtgtaagccactttgtccagccctcattgtggttttgatttgcattgccctaatagctaatgatattgaacaccttttcatgtgcttatttaccatccataaatcttctctgatggactacctcatcaagtgttttgccctctttttaactgggttattttcttatcattgagagttctttatattttccctttaccagtcctgtatgagataggtgatttgcaaatattttctctgtctgtgccttgccttttcatttgcttgtgtttttcaaggaagttcttagttttgatgaagttcaatttattaattttttcttttatggattatgcttttgatgcaatatctaagaaacttttgccaatccaagctcataaatatcttctatgctttcttgtagaagtttttattaggttttaggtttttcatgtagttttatgatccattttgaatgaatttttaaatctgatgtgagaggagtctttcctttttttttttctttttgtttttttgagacagagttttgctcttgttgcccaggctggagcgcaatggcgcaatctcagctcactgcagcctccgcctcctgggttcaagtgattctcctgcctcagcctcccaattagctgggattacaggcatgagccaccacgcctg

SEQ ID NO: 134392 - DNA, 451 bp, Homo sapiens
taagtaaagtgaagagctgtcttttagtttttaatagaagaacttgtacttcatttattcttcaatggaatcccgcccctcactttagccaaatgatttctccaaatcctcatttttttttgttgtacaaatagagtcgctcaattatctcccaaggctctacaaaatcgaaataactttttcctaagctaattattgtggaaagttccaaaaagtacatgtgtacattttctaataaaaatatacagtgattatcatagatcgattggtctggtttaagtcaaattccattaatcaaaaccttcaatcaacggatttatcgtggatgcatacatttggtttctaatttatttattgtctacattctgcttttagaagaaaagggaaaaggaccaataagcaggtggttagtattaatttagtaaatagaaactacatcttcaatagtata

SEQ ID NO: 134393 - DNA, 740 bp, Homo sapiens
gggtttgggtagtatatttttcagtataatttagagaaatttcatgaaaatggcatcattgggggatttttctgtattttcaattaaataaaaatatctttaaggtttagggacagtgttgaacacagaaaagttatcttctgttcgcaaaactcgtatcattccatttatcaacatcctgctttttgataaaaagacttcaacaatttccttaagattctaacaatgtacgcaaaaatttttcaaacatggtattcaatagtcttactttcgtcagtcccattattatattactttgagatatgccctttttgttatagaaagggtaaaatagtttgcctgtgttcccctgtcaaagtataaattaatatctgattttcttggtttttaaacaattgcctatttagacttaattttttctgatttaaaaaaatcagtgcaataagttcaaggtcttttatcaacataactacagttaatgtattttatacttgaaaatagctacgagtagattttaagtattctcaccacaaaagataaatatatgaggtaacacatatgttaatttgcttgatttagccattctacaatgtaaacattttatttatttttatttttctttattaattttttttgagacagagtcttgctctgtcgcccaggctggagtgcagtaacacaatctcggctcactacaacctccgcctcctgggttcaagcgattctcctgcctcatcctc

SEQ ID NO: 134394 - DNA, 6377 bp, Homo sapiens
ccttttctttatagttgtcatggatgatgatgatgactcgtgtctccttgatcttattggagacccacaagcattgaactattttctacatggacctagtaataaatctagcaatgatgacttgactaatgcaggatattctgcagccaattcaaattcaattttcgccaactctagtaatgctgatcctaagtcatccctcaaaggtgtaagcaaccagcttggagaagggcccagtgatggactgccactttcaagtagcctccagtttcttgaagatgaactcgagtcttctcctcttcctgatctcactgaggaccaacctttcgacattcttcagaaatccttgcaagaggccaatatcactgaacagacattggcagaagaggcatatttggatgccagtataggttcaagccaacagtttgcacaagctcagcttcatccttcttcatcagcatcctttactcaggcttctaatgtttctaattactcaggtcagacgctgcagcctataggggtgacgcatgtgcctgttggagcatcgtttgcaagcaatacagtgggtgtacaacatggctttatgcaacatgtggggatcagtgttcccagccagcatttgtctaatagcagtcagattagtggttctggtcaaatacagttaattgggtcatttggtaatcatccttccatgatgactattaataacctagatggatctcaaatcatattaaagggcagcgggcagcaagccccatcaaatgtgagtggagggctcctggttcatagacagactcctaatggcaactccttgtttgggaactctagttccagtccagtagcacagcctgttaccgttccatttaacagcacaaattttcaaacatctttacctgtgcataacatcatcatacaaaggggtcttgcaccaaattcaaataaagtcccaattaatatacagccaaagcctatccagatgggtcagcaaaatacatacaatgtgaacaatttgggaattcagcagcaccacgtacaacaagggatctcttttgcttctgcaagctcaccccagggctcagtagttggtccacacatgtctgtgaacattgtaaaccaacagaacacaagaaagccagtcacctcacaggcagtgagcagcactgggggcagtattgttattcattcccccatgggccaacctcacgcaccccaaagtcagttccttatacctacaagcctttctgtcagttccaactcggtacaccacgtccagactataaatgggcaacttcttcaaactcaaccctctcagctcatttctggccaagtggcctcagagcatgtcatgttgaacagaaactcttccaacatgctcaggaccaaccaaccatatactggaccgatgcttaacaaccagaatactgctgtccacttagtgtctgggcagacatttgctgcctctggaagtccagtgatagccaatcatgcctctcctcagcttgtgggtggacagatgcccttgcagcaggcatccccaactgtattacacctgtcacctgggcagagcagcgtttcccaaggaagacctggcttcgccaccatgccatcggtgacaagcatgtcaggacctagtcggttccctgctgtcagctcagccagcactgcccatcctagtcttgggtctgcagttcagtctggttcatcaggatcaaactttacaggagatcagctgacccagccaaacaggactccagtaccagtcagtgtgtctcatcgtcttccagtttcttcttccaagtctaccagcaccttcagtaacacacctggaacaggaacccagcaacaattcttctgccaggctcagaaaaaatgtctgaatcagacttcccccatttctgctcccaagaccacagacggcctgaggcaagcacagatccctgggctcttgagcaccacactgccagggcaggattctggaagcaaagttatatccgcatccttaggaaccgcacaaccacagcaggaaaaagtagttggatcatctcctggccatccagctgtgcaggtggagagtcattcgggaggacaaaaaaggcctgctgcgaaacagctaacgaaaggagctttcattctccagcagttgcagagggaccaagcccacactgtgacaccagacaaaagtcacttccgatcactaagtgatgcggtacagagactgctctcctaccacgtgtgccagggctccatgcccactgaagaagacttgagaaaagtggacaatgaatttgagacagttgccactcagctcctaaaaaggacccaagctatgcttaacaaatacagatgcctgctcctagaagatgccatgcgaatcaatccctctgctgagatggtgatgatcgataggatgttcaaccaggaggaaagagcttccctgtcccgagacaagcgtttggcacttgtagaccctgagggttttcaggctgatttctgttgttccttcaaacttgataaagctgctcatgagacacagtttggccggagtgaccagcatggcagtaaagcaagcagctctctgcaaccgccagccaaggcccaaggcagagaccgagccaaaaccggtgtgacggaacccatgaatcatgaccagtttcatctagtgcctaatcacatcgtggtctctgcagaaggaaacatttctaaaaaaacagaatgccttggcagagcactgaaatttgacaaagtgggcttagtgcagtaccagagcacgtctgaagagaaggccagccggagagagcctctgaaggccagtcagtgctctcccggccctgaggggcaccggaaaacctcatccagatcggatcatggtactgagagcaaactgtcaagcatcctagcagattcgcacttggagatgacgtgtaacaattccttccaggacaaaagtctgaggaattctccaaagaatgaagttttacacacagacatcatgaaagggtcaggcgaaccccagccagatctccagctgacaaagagcttggaaaccacatttaagaacatcttggaactcaaaaaggcgggacggcagccccagagtgaccccacggttagcggctctgttgagttagatttccccaacttttctcctatggcttcacaggaaaactgcctggaaaagttcatcccggaccacagtgaaggtgttgtagaaactgactccattttagaagcagctgtaaatagtatcctagagtgttaatagcagcagtcctccccctaccccgccccgagaccccaccccgagaccccaccccggaccagttacattcgttcctggcaaaagcaaatggaaatggtctcctgtctccagcctgcttgatctttcatcacaggttattctttctaatctcaatcctgttctttgtttaagagcaatacttgtcgtgattacagggagatcctttagtaaaattaatccttggcagaaagcagtctgataggccccactcatttcaagtgttatgaaagtgcttataggcattttgtttatttgttttgttttttaaaaacactgtaactcaatgagaccacagtatacttggcccttggtaaaattttgacaatcataagtcatttgaaaagaacagacttactaaaatcaaacgagacggatagaagctactttttaaagaatatcccactgcatctgcaaatttagttttgggtttttttattattattattttgagtttttttgtgtgtgttttgttgttattgttgaggggaagaccacatggttcttccccctcagccatctttgagcagtaaattgctggctgtgctgccagggacccgcagccctggtggaaaagccagtagcacatacgcagggcattgcagggcttccctattgatggttcaagtgcttttctgatgcttccggagcaaaacctcatgcttttaggcatatctatgttgaatttcacctagggaatgttctgttcttagttacagcagcaaaatttgaaataatttcaccaggctaaataaaggaaaatggaaaccagttaagaggcacagtgtacagaggaggccgggatagagccatgagggttataatattaatatgtatatatgtaaaagcatatatatgttaactattgagaaaaaacaagttttgcattttataattggatatagtcaacatataatgtatgtttttgtttgttgctggattttgtttcatttaacctctctttgcaccctctcccacaacaaataccaagcatcaaaagcactttcatttgaaaattattatgttgtaatttttcagtttaaactttaaggagactctggccttgtttatgcttcttgtctgagaacagtagtgacccctggcagcaattcattaccaaaacacagacaaaccaaaggtaaccagctagcccaccactgaaaggaaagatctgagacatgggattcccatttgagagccaaaggatatgccctgtcatggtttctgtttggcctgtgttcatattagtgagcatggcttactgctttatttatttttatttcttgtcagggagtattctccgttttcctttctcgtatacctgccccaggttatcccatttctgttgttacctttattcttaatgtcattgtaaccatcacttatctcctctcattgggaaagctacatgatagtatttttatgcactcttctcccacacatacacacacgtgcatgtatctgagctgctcggatccagaggtcatttttgttacagtgtgtgcacactcactctccttcttagtgtgcatactctctcatttattctgtttatctccctggctctggaggtgcagccactggtcttcactttaatgtgttgccagaatctgcttctggctgtcgccaacatggggatgacccccattgtcatcatgttgggcatttcttttccagattggcctgtgatggaaaggaaggcttctaattagaaaacacagcaacagaagacctataccccggtgcccctgtgtcccactacacacagaaaaccctgtgagatggccagtcttcataatagcaacgtaccttcaccccagccacatgccccagccaatacaaattggaaaatctggcccattttagggttaccattttttccttatttgtgccaatgtccaagttgcagatttcccctttttcctgtattgtaacatattagataagttggtgtcgccagttggtactttctgtttgggtagtcctagggtaacaccctgccctaaactccatgatttcataggcttttcttcccttggggctcatgctcccctaattcctagcaagatgatccttcctaatcaaattcttctcattgcagaactttatccctggaagccttcatgtgggctgctagtgagttacattaattactgcaaatcagtggaattctcaagagacaagataagcttcatgtacatttgtcacctctctttcttccctatcctgccctgctgtcccaatcctagcttttctatataccatcctaaagggtttttaagccctaacacttgtctagcaaatggagagcctaatttaccaaaatgaaacttgtaaatttttgtgtcattgtatgtaagtttactttttatggaggaaggattctagataatgacaaatgaagattatgacatgtatttcactcctgtgattaggttctacgcacatgggtcataactcgcatgtcgagccccctctagtgaagggtaggagagctcagcctcggatggccaacattcagttgttcaggttcattcgtcaaagttaagttttagaactatttgtactcagtaacaaaaatcattttcttttttttttttttttctgttgtggaaaagcgtgaatttgttattaagcatttgattttctgtgtccttaagtacttcctgaagatgaagcaaaattttaatctggcaattatgaaaaagaaatattttagctctgaaggatttagtagattctgttagattagggaggccttacagactgactttacttaaagaggacgcgtcactcgctgtcagtgtggtgtgggctttatttgcttaaataccttcatttgtatagtacgtctcacttgaaattgctttgtatacattttgtaaaaatatttataaaatgttttgtaaaaaaaaaaaaactataacaaattgcagtttattttgttatgttggataaatactgttaaaagaaaccagtcagtaactatattgttaatccatggttaggaaatgtttagttggagattacaaattgaaacaaccattgcaatacagccaaagatttgggaaaatgtgaaact

SEQ ID NO: 134395 - DNA, 6203 bp, Homo sapiens
ccttttctttatagttgtcatggatgatgatgatgactcgtgtctccttgatcttattggagacccacaagcattgaactattttctacatggacctagtaataaatctagcaatgatgacttgactaatgcaggatattctgcagccaattcaaattcaattttcgccaactctagtaatgctgatcctaagtcatccctcaaaggtgtaagcaaccagcttggagaagggcccagtgatggactgccactttcaagtagcctccagtttcttgaagatgaactcgagtcttctcctcttcctgatctcactgaggaccaacctttcgacattcttcagaaatccttgcaagaggccaatatcactgaacagacattggcagaagaggcatatttggatgccagtataggttcaagccaacagtttgcacaagctcagcttcatccttcttcatcagcatcctttactcaggcttctaatgtttctaattactcaggtcagacgctgcagcctataggggtgacgcatgtgcctgttggagcatcgtttgcaagcaatacagtgggtgtacaacatggctttatgcaacatgtggggatcagtgttcccagccagcatttgtctaatagcagtcagattagtggttctggtcaaatacagttaattgggtcatttggtaatcatccttccatgatgactattaataacctagatggatctcaaatcatattaaagggcagcgggcagcaagccccatcaaatgtgagtggagggctcctggttcatagacagactcctaatggcaactccttgtttgggaactctagttccagtccagtagcacagcctgttaccgttccatttaacagcacaaattttcaaacatctttacctgtgcataacatcatcatacaaaggggtcttgcaccaaattcaaataaagtcccaattaatatacagccaaagcctatccagatgggtcagcaaaatacatacaatgtgaacaatttgggaattcagcagcaccacgtacaacaagggatctcttttgcttctgcaagctcaccccagggctcagtagttggtccacacatgtctgtgaacattgtaaaccaacagaacacaagaaagccagtcacctcacaggcagtgagcagcactgggggcagtattgttattcattcccccatgggccaacctcacgcaccccaaagtcagttccttatacctacaagcctttctgtcagttccaactcggtacaccacgtccagactataaatgggcaacttcttcaaactcaaccctctcagctcatttctggccaagtggcctcagagcatgtcatgttgaacagaaactcttccaacatgctcaggaccaaccaaccatatactggaccgatgcttaacaaccagaatactgctgtccacttagtgtctgggcagacatttgctgcctctggaagtccagtgatagccaatcatgcctctcctcagcttgtgggtggacagatgcccttgcagcaggcatccccaactgtattacacctgtcacctgggcagagcagcgtttcccaaggaagacctggcttcgccaccatgccatcggtgacaagcatgtcaggacctagtcggttccctgctgtcagctcagccagcactgcccatcctagtcttgggtctgcagttcagtctggttcatcaggatcaaactttacaggagatcagctgacccagccaaacaggactccagtaccagtcagtgtgtctcatcgtcttccagtttcttcttccaagtctaccagcaccttcagtaacacacctggaacaggaacccagcaacaattcttctgccaggctcagaaaaaatgtctgaatcagacttcccccatttctgctcccaagaccacagacggcctgaggcaagcacagatccctgggctcttgagcaccacactgccagggcaggattctggaagcaaagttatatccgcatccttaggaaccgcacaaccacagcaggaaaaagtagttggatcatctcctggccatccagctgtgcaggtggagagtcattcgggaggacaaaaaaggcctgctgcgaaacagctaacgaaaggagctttcattctccagcagttgcagagggaccaagcccacactgtgacaccagacaaaagtcacttccgatcactaagtgatgcggtacagagactgctctcctaccacgtgtgccagggctccatgcccactgaagaagacttgagaaaagtggacaatgaatttgagacagttgccactcagctcctaaaaaggacccaagctatgcttaacaaatacagatgcctgctcctagaagatgccatgcgaatcaatccctctgctgagatggtgatgatcgataggatgttcaaccaggaggaaagagcttccctgtcccgagacaagcgtttggcacttgtagaccctgagggttttcaggctgatttctgttgttccttcaaacttgataaagctgctcatgagacacagtttggccggagtgaccagcatggcagtaaagcaagcagctctctgcaaccgccagccaaggcccaaggcagagaccgagccaaaaccggtgtgacggaacccatgaatcatgaccagtttcatctagtgcctaatcacatcgtggtctctgcagaaggaaacatttctaaaaaaacagaatgccttggcagagcactgaaatttgacaaagtgggcttagtgcagtaccagagcacgtctgaagagaaggccagccggagagagcctctgaaggccagtcagtgctctcccggccctgaggggcaccggaaaacctcatccagatcggatcatggtactgagagcaaactgtcaagcatcctagcagattcgcacttggagatgacgtgtaacaattccttccaggacaaaagtctgaggaattctccaaagaatgaagttttacacacagacatcatgaaagggtcaggcgaaccccagccagatctccagctgacaaagagcttggaaaccacatttaagaacatcttggaactcaaaaaggcgggacggcagccccagagtgaccccacggttagcggctctgttgagttagatttccccaacttttctcctatggcttcacaggaaaactgcctggaaaagttcatcccggaccacagtgaaggtgttgtagaaactgactccattttagaagcagctgtaaatagtatcctagagtgttaatagcagcagtcctccccctaccccgccccgagaccccaccccgagaccccaccccggaccagttacattcgttcctggcaaaagcaaatggaaatggtctcctgtctccagcctgcttgatctttcatcacaggttattctttctaatctcaatcctgttctttgtttaagagcaatacttgtcgtgattacagggagatcctttagtaaaattaatccttggcagaaagcagtctgataggccccactcatttcaagtgttatgaaagtgcttataggcattttgtttatttgttttgttttttaaaaacactgtaactcaatgagaccacagtatacttggcccttggtaaaattttgacaatcataagtcatttgaaaagaacagacttactaaaatcaaacgagacggatagaagctactttttaaagaatatcccactgcatctgcaaatttagttttgggtttttttattattattattttgagtttttttgtgtgtgttttgttgttattgttgaggggaagaccacatggttcttccccctcagccatctttgagcagtaaattgctggctgtgctgccagggacccgcagccctggtggaaaagccagtagcacatacgcagggcattgcagggcttccctattgatggttcaagtgcttttctgatgcttccggagcaaaacctcatgcttttaggcatatctatgttgaatttcacctagggaatgttctgttcttagttacagcagcaaaatttgaaataatttcaccaggctaaataaaggaaaatggaaaccagttaagaggcacagtgtacagaggaggccgggatagagccatgagggttataatattaatatgtatatatgtaaaagcatatatatgttaactattgagaaaaaacaagttttgcattttataattggatatagtcaacatataatgtatgtttttgtttgttgctggattttgtttcatttaacctctctttgcaccctctcccacaacaaataccaagcatcaaaagcactttcatttgaaaattattatgttgtaatttttcagtttaaactttaaggagactctggccttgtttatgcttcttgtctgagaacagtagtgacccctggcagcaattcattaccaaaacacagacaaaccaaaggtaaccagctagcccaccactgaaaggaaagatctgagacatgggattcccatttgagagccaaaggatatgccctgtcatggtttctgtttggcctgtgttcatattagtgagcatggcttactgctttatttatttttatttcttgtcagggagtattctccgttttcctttctcgtatacctgccccaggttatcccatttctgttgttacctttattcttaatgtcattgtaaccatcacttatctcctctcattgggaaagctacatgatagtatttttatgcactcttctcccacacatacacacacgtgcatgtatctgagctgctcggatccagaggtcatttttgttacagtgtgtgcacactcactctccttcttagtgtgcatactctctcatttattctgtttatctccctggctctggaggtgcagccactggtcttcactttaatgtgttgccagaatctgcttctggctgtcgccaacatggggatgacccccattgtcatcatgttgggcatttcttttccagattggcctgtgatggaaaggaaggcttctaattagaaaacacagcaacagaagacctataccccggtgcccctgtgtcccactacacacagaaaaccctgtgagatggccagtcttcataatagcaacgtaccttcaccccagccacatgccccagccaatacaaattggaaaatctggcccattttagggttaccattttttccttatttgtgccaatgtccaagttgcagatttcccctttttcctgtattgtaacatattagataagttggtgtcgccagttggtactttctgtttgggtagtcctagggtaacaccctgccctaaactccatgatttcataggcttttcttcccttggggctcatgctcccctaattcctagcaagatgatccttcctaatcaaattcttctcattgcagaactttatccctggaagccttcatgtgggctgctagtgagttacattaattactgcaaatcagtggaattctcaagagacaagataagcttcatgtacatttgtcacctctctttcttccctatcctgccctgctgtcccaatcctagcttttctatataccatcctaaagggtttttaagccctaacacttgtctagcaaatggagagcctaatttaccaaaatgaaacttgtaaatttttgtgtcattgtatgtaagtttactttttatggaggaaggattctagataatgacaaatgaagattatgacatgtatttcactcctgtgattaggttctacgcacatgggtcataactcgcatgtcgagccccctctagtgaagggtaggagagctcagcctcggatggccaacattcagttgttcaggttcattcgtcaaagttaagttttagaactatttgtactcagtaacaaaaatcattttcttttttttttttttttctgttgtggaaaagcgtgaatttgttattaagcatttgattttctgtgtccttaagtacttcctgaagatgaagcaaaattttaatctggcaattatgaaaaagaaatattttagctctgaaggatttagtagattctgttagattagggaggccttacagactgactttacttaaagaggacgcgtcactcgctgtcagtgtggtgtgggctttatttgcttaaataccttcatttgtatagtacgtctcacttgaaattgctttgtatacattttgtaaaaatatttataaaatgttttgta

SEQ ID NO: 134396 - DNA, 5421 bp, Homo sapiens
acagtggaacgtgacaccatgacacttcctgcatacacggttcatcacccactcacccccccaacacacaacctcactcactcagaacttaacggcctcctccatctttacctgtgcataacatcatcatacaaaggggtcttgcaccaaattcaaataaagtcccaattaatatacagccaaagcctatccagatgggtcagcaaaatacatacaatgtgaacaatttgggaattcagcagcaccacgtacaacaagggatctcttttgcttctgcaagctcaccccagggctcagtagttggtccacacatgtctgtgaacattgtaaaccaacagaacacaagaaagccagtcacctcacaggcagtgagcagcactgggggcagtattgttattcattcccccatgggccaacctcacgcaccccaaagtcagttccttatacctacaagcctttctgtcagttccaactcggtacaccacgtccagactataaatgggcaacttcttcaaactcaaccctctcagctcatttctggccaagtggcctcagagcatgtcatgttgaacagaaactcttccaacatgctcaggaccaaccaaccatatactggaccgatgcttaacaaccagaatactgctgtccacttagtgtctgggcagacatttgctgcctctggaagtccagtgatagccaatcatgcctctcctcagcttgtgggtggacagatgcccttgcagcaggcatccccaactgtattacacctgtcacctgggcagagcagcgtttcccaaggaagacctggcttcgccaccatgccatcggtgacaagcatgtcaggacctagtcggttccctgctgtcagctcagccagcactgcccatcctagtcttgggtctgcagttcagtctggttcatcaggatcaaactttacaggagatcagctgacccagccaaacaggactccagtaccagtcagtgtgtctcatcgtcttccagtttcttcttccaagtctaccagcaccttcagtaacacacctggaacaggaacccagcaacaattcttctgccaggctcagaaaaaatgtctgaatcagacttcccccatttctgctcccaagaccacagacggcctgaggcaagcacagatccctgggctcttgagcaccacactgccagggcaggattctggaagcaaagttatatccgcatccttaggaaccgcacaaccacagcaggaaaaagtagttggatcatctcctggccatccagctgtgcaggtggagagtcattcgggaggacaaaaaaggcctgctgcgaaacagctaacgaaaggagctttcattctccagcagttgcagagggaccaagcccacactgtgacaccagacaaaagtcacttccgatcactaagtgatgcggtacagagactgctctcctaccacgtgtgccagggctccatgcccactgaagaagacttgagaaaagtggacaatgaatttgagacagttgccactcagctcctaaaaaggacccaagctatgcttaacaaatacagatgcctgctcctagaagatgccatgcgaatcaatccctctgctgagatggtgatgatcgataggatgttcaaccaggaggaaagagcttccctgtcccgagacaagcgtttggcacttgtagaccctgagggttttcaggctgatttctgttgttccttcaaacttgataaagctgctcatgagacacagtttggccggagtgaccagcatggcagtaaagcaagcagctctctgcaaccgccagccaaggcccaaggcagagaccgagccaaaaccggtgtgacggaacccatgaatcatgaccagtttcatctagtgcctaatcacatcgtggtctctgcagaaggaaacatttctaaaaaaacagaatgccttggcagagcactgaaatttgacaaagtgggcttagtgcagtaccagagcacgtctgaagagaaggccagccggagagagcctctgaaggccagtcagtgctctcccggccctgaggggcaccggaaaacctcatccagatcggatcatggtactgagagcaaactgtcaagcatcctagcagattcgcacttggagatgacgtgtaacaattccttccaggacaaaagtctgaggaattctccaaagaatgaagttttacacacagacatcatgaaagggtcaggcgaaccccagccagatctccagctgacaaagagcttggaaaccacatttaagaacatcttggaactcaaaaaggcgggacggcagccccagagtgaccccacggttagcggctctgttgagttagatttccccaacttttctcctatggcttcacaggaaaactgcctggaaaagttcatcccggaccacagtgaaggtgttgtagaaactgactccattttagaagcagctgtaaatagtatcctagagtgttaatagcagcagtcctccccctaccccgccccgagaccccaccccgagaccccaccccggaccagttacattcgttcctggcaaaagcaaatggaaatggtctcctgtctccagcctgcttgatctttcatcacaggttattctttctaatctcaatcctgttctttgtttaagagcaatacttgtcgtgattacagggagatcctttagtaaaattaatccttggcagaaagcagtctgataggccccactcatttcaagtgttatgaaagtgcttataggcattttgtttatttgttttgttttttaaaaacactgtaactcaatgagaccacagtatacttggcccttggtaaaattttgacaatcataagtcatttgaaaagaacagacttactaaaatcaaacgagacggatagaagctactttttaaagaatatcccactgcatctgcaaatttagttttgggtttttttattattattattttgagtttttttgtgtgtgttttgttgttattgttgaggggaagaccacatggttcttccccctcagccatctttgagcagtaaattgctggctgtgctgccagggacccgcagccctggtggaaaagccagtagcacatacgcagggcattgcagggcttccctattgatggttcaagtgcttttctgatgcttccggagcaaaacctcatgcttttaggcatatctatgttgaatttcacctagggaatgttctgttcttagttacagcagcaaaatttgaaataatttcaccaggctaaataaaggaaaatggaaaccagttaagaggcacagtgtacagaggaggccgggatagagccatgagggttataatattaatatgtatatatgtaaaagcatatatatgttaactattgagaaaaaacaagttttgcattttataattggatatagtcaacatataatgtatgtttttgtttgttgctggattttgtttcatttaacctctctttgcaccctctcccacaacaaataccaagcatcaaaagcactttcatttgaaaattattatgttgtaatttttcagtttaaactttaaggagactctggccttgtttatgcttcttgtctgagaacagtagtgacccctggcagcaattcattaccaaaacacagacaaaccaaaggtaaccagctagcccaccactgaaaggaaagatctgagacatgggattcccatttgagagccaaaggatatgccctgtcatggtttctgtttggcctgtgttcatattagtgagcatggcttactgctttatttatttttatttcttgtcagggagtattctccgttttcctttctcgtatacctgccccaggttatcccatttctgttgttacctttattcttaatgtcattgtaaccatcacttatctcctctcattgggaaagctacatgatagtatttttatgcactcttctcccacacatacacacacgtgcatgtatctgagctgctcggatccagaggtcatttttgttacagtgtgtgcacactcactctccttcttagtgtgcatactctctcatttattctgtttatctccctggctctggaggtgcagccactggtcttcactttaatgtgttgccagaatctgcttctggctgtcgccaacatggggatgacccccattgtcatcatgttgggcatttcttttccagattggcctgtgatggaaaggaaggcttctaattagaaaacacagcaacagaagacctataccccggtgcccctgtgtcccactacacacagaaaaccctgtgagatggccagtcttcataatagcaacgtaccttcaccccagccacatgccccagccaatacaaattggaaaatctggcccattttagggttaccattttttccttatttgtgccaatgtccaagttgcagatttcccctttttcctgtattgtaacatattagataagttggtgtcgccagttggtactttctgtttgggtagtcctagggtaacaccctgccctaaactccatgatttcataggcttttcttcccttggggctcatgctcccctaattcctagcaagatgatccttcctaatcaaattcttctcattgcagaactttatccctggaagccttcatgtgggctgctagtgagttacattaattactgcaaatcagtggaattctcaagagacaagataagcttcatgtacatttgtcacctctctttcttccctatcctgccctgctgtcccaatcctagcttttctatataccatcctaaagggtttttaagccctaacacttgtctagcaaatggagagcctaatttaccaaaatgaaacttgtaaatttttgtgtcattgtatgtaagtttactttttatggaggaaggattctagataatgacaaatgaagattatgacatgtatttcactcctgtgattaggttctacgcacatgggtcataactcgcatgtcgagccccctctagtgaagggtaggagagctcagcctcggatggccaacattcagttgttcaggttcattcgtcaaagttaagttttagaactatttgtactcagtaacaaaaatcattttcttttttttttttttttctgttgtggaaaagcgtgaatttgttattaagcatttgattttctgtgtccttaagtacttcctgaagatgaagcaaaattttaatctggcaattatgaaaaagaaatattttagctctgaaggatttagtagattctgttagattagggaggccttacagactgactttacttaaagaggacgcgtcactcgctgtcagtgtggtgtgggctttatttgcttaaataccttcatttgtatagtacgtctcacttgaaattgctttgtatacattttgtaaaaatatttataaaatgttttgta

SEQ ID NO: 134397 - DNA, 478 bp, Homo sapiens
caatccctctgctgagatggtgatgatcgataggatgttcaaccaggaggaaagagcttccctgtcccgagacaagcgtttggcacttgtagaccctggtaagaaacatcgcagtgaaagtagtggatagctcctgccatggttcagggaccatggggcctttggcagtctgtctgaactttgggtaagaaacttgaaggtagaacgtgaattctggggagagctgggcacggtggctcacacctgtaatcccatctacttccttctcctctttggcctgcacagccaatgtttgttggatggaatcatctttttagatttcaaggctatattccctagaactcacattttagaatttggtgaacaaattcatgttcacactatacatacatactcttcgttgttttgtagatgtcatcaaagctctatttcacttcgattatttccagcattaacactttttccactcttgtgtaac

SEQ ID NO: 134398 - DNA, 1901 bp, Homo sapiens
ccttttctttatagttgtcatggatgatgatgatgactcgtgtctccttgatcttattggagacccacaagcattgaactattttctacatggacctagtaataaatctagcaatgatgacttgactaatgcaggatattctgcagccaattcaaattcaattttcgccaactctagtaatgctgatcctaagtcatccctcaaaggtgtaagcaaccagcttggagaagggcccagtgatggactgccactttcaagtagcctccagtttcttgaagatgaactcgagtcttctcctcttcctgatctcactgaggaccaacctttcgacattcttcagaaatccttgcaagaggccaatatcactgaacagacattggcagaagaggcatatttggatgccagtataggttcaagccaacagtttgcacaagctcagcttcatccttcttcatcagcatcctttactcaggcttctaatgtttctaattactcaggtcagacgctgcagcctataggggtgacgcatgtgcctgttggagcatcgtttgcaagcaatacagtgggtgtacaacatggctttatgcaacatgtggggatcagtgttcccagccagcatttgtctaatagcagtcagattagtggttctggtcaaatacagttaattgggtcatttggtaatcatccttccatgatgactattaataacctagatggatctcaaatcatattaaagggcagcgggcagcaagccccatcaaatgtgagtggagggctcctggttcatagacagactcctaatggcaactccttgtttgggaactctagttccagtccagtagcacagcctgttaccgttccatttaacagcacaaattttcaaacatctttacctgtgcataacatcatcatacaaaggggtcttgcaccaaattcaaataaagtcccaattaatatacagccaaagcctatccagatgggtcagcaaaatacatacaatgtgaacaatttgggaattcagcagcaccacgtacaacaagggatctcttttgcttctgcaagctcaccccagggctcagtagttggtccacacatgtctgtgaacattgtaaaccaacagaacacaagaaagccagtcacctcacaggcagtgagcagcactgggggcagtattgttattcattcccccatgggccaacctcacgcaccccaaagtcagttccttatacctacaagcctttctgtcagttccaactcggtacaccacgtccagactataaatgggcaacttcttcaaactcaaccctctcagctcatttctggccaagtggcctcagagcatgtcatgttgaacagaaactcttccaacatgctcaggaccaaccaaccatatactggaccgatgcttaacaaccagaatactgctgtccacttagtgtctgggcagacatttgctgcctctggaagtccagtgatagccaatcatgcctctcctcagcttgtgggtggacagatgcccttgcagcaggcatccccaactgtattacacctgtcacctgggcagagcagcgtttcccaaggaagacctggcttcgccaccatgccatcggtgacaagcatgtcaggacctagtcggttccctgctgtcagctcagccagcactgcccatcctagtcttgggtctgcagttcagtctggttcatcaggatcaaactttacaggagatcagctgacccagccaaacaggactccagtaccagtcagtgtgtctcatcgtcttccagtttcttcttccaagtctaccagcaccttcagtaacacacctggaacaggaacccagcaacaattcttctgccaggtaatgccctttcccaaataaatatttggctgattatagaatg

SEQ ID NO: 134399 - DNA, 883 bp, Homo sapiens
gctgctcagctcgcatgcttgccctgccttgggaacaaggtttctggatagtggggataagatgttcagcgtaatggtgtgatgtttgctataggaaggcagcaaggcaatttcttagtattagttctgctcagctctagaaaatgttttccttgattgccaagaactttcccagctcaattcaaaactcgaatttgatgaaaggaggctctgcaattcagcctcctttaatcagaattcaatcttgggctggggtggggagagtggagaatgaatgagaatgaatatgtctgtacagcggcctccttctgcccctgatacccagattcaccatgttctcctttccgcctgtcttcgttgtcttcctaacgccaggttcagtttgtgggctctggattctattatgcggataggcagtttctgtttgttctacagattcacaactgtatgatagcaactggatgttataactggaaactggagtagaataccaacataccccacacccatgttagggaggcagtgggaatcactagtttagaaaattcttgggactcagttctcttttccttttggcctcagtaggcgtcaagaggagatgggaaatctgattgacctgtcatttctgcacactgttataggcacgttgctgacaagcctcagtttctttaaacttgtttgtgttcagatcttttccaccagaccagcatcagcagggtctggtttgtggtgttacgtactcctcttctgttgggctggagctttgaacagtttgccctttataagcctgcagcattaatagggaaagactgaggggcacccaagggggtgtttatagaatgggctttataaaactcccagctgccccgtaaaacaagagttc

SEQ ID NO: 134400 - DNA, 483 bp, Homo sapiens
aattcaagttgagatttgggtggggacacagccaaaccatatcaagggggatgaggcactgagactagttagaagatggcagcaatagtttaggtgggagattatgacctgaattaaggtatagaaatgagcataggttaccagattccaaggatatttagaaggacttggtgaccaagtgcaagtaggtgtgagcaggtggaagggcttaaagccatctctcagccttctagattaagcaaatgggggcgaggtaagtgcagaaaaaggaattcaggagagaaattaaatttgaagaagacagtgaatttggttcagcatactggcttagcatttgtggcgagtggaatatcagtagagatgttcactgggcagttagagtcatgacaggccggggcctttatggagtgctatttgtattacagatgtaagggagctcacccgcacacagcatgaagctagagaaaagaactgggctaagag

SEQ ID NO: 134401 - DNA, 529 bp, Homo sapiens
gactgatggttctgattttggttcagaaaaataattgcatgactgtcctaaagtggaaagagaaaaacctcaaaaattgttaacacatcaattacatcaaccttttctaattacaactctgcatttcattattctgcaggcaaaatgagtaccttaagtctagagccccaggtaaacaaagcctttccctgtcctcatttcaaaactttgtttttataaacattccccgtcccctaaactgaactacagcagcacaatgatcctgttgtgagcactgccttgacctctataggacaacagattgttgttcacttagcccctcagagttaaatcagttttaatacagaagtttctgtcttatcaaaggaagtaaagaagtaaaaacaaaaaatgaacgtatacaagcacagatttttgagcttcgattgtagagaaatggtagttatgtggcttgccaagaaagtgcatcacctacttctgcttctggggacagaggtgaaggggtctgttctggaactttctaaggagg

SEQ ID NO: 134402 - DNA, 546 bp, Homo sapiens
ggcgacaggtccctgtaatgccagctactcaggaggctgagggtgagaatcacttgaacctgggaggcagaggttgcagtgagctgcagtcatgccactgtactctagcctgggtgacagaatgagaccctatctcaaaaaaattaaaaaaataaaaaaaaaataaaaattagttgagtgtggtagtgtccgtctgtagtcccagcaactcaggaggttggggcaggaggatcacttgagcccaggagttcaaggctgcagtgagctataattgcaccattgcactcaagctcaggcaacagagtgagaccttgtctcaaaaaaaaaaaaaaaaatttaaacaagcgacagtaatatttcattagaaatgtgatgaatgctatgaaggtgtagaggatgtctttagaatatataactgggagggagaccttttgagttaaggcaggtgctggtcaggaaagtcctgaggaagttacatttggattgagaggggaaagatgaggaggagcaggcttgcctgaggcatggtaggcaagagagaaggac

SEQ ID NO: 134403 - DNA, 314 bp, Homo sapiens
gagtcccacaattctcatcctctgtgcttcttctcttgttcatcccatctcctgaaatgtcccccaatctgccttcccataaccgaattctatccattattcaagggccagttcaattcttctaagaagtttgccctgaattccacaactgagtgagagtactccatcatcagatgtgcttgattcatctcggagtttaacccagcgtgtgacacccaggtagagctcagtgagcactggccgagtgaatgatgagcacataaatgcaataccagcttctcttgccccagggtttcatccctgcctttccctgt

SEQ ID NO: 134404 - DNA, 727 bp, Homo sapiens
gtatttttagtagagatggggtttcatcatgttagccaggctggtcttgaactcctgacctcatgatccacccatcttggcctcccaaagtgctgggattacaggcatgagccaccgtgcccggcctctccaccctgtcttctataccactctccctcactggccatagcttttaggggtgctatacctcccactacagccagcatacatatgtcttgatttatacagaaggtgtgatcctgaaaatctgtttataaatcttgcctgttttggtgaatacagtaaaaagccttccaggagacgtgttgatacacaacatgttatatataattcagttttcctttagctactatattaattttgtatgcagagtatttttaaattgctatccatgctgtgcttgctcctgccatgtgaacctgagacccccagaggaccatccactcatctccttccccctagtgtcagtatctcagccctttattcatcctgaaagtattggtgagcaaccctctgtgccaagtcttgtgctagtgaactctgggaacaagtgaaccacgcagcatttacctccagggagctcatagtcacaaacagggaattattacacggtgtgctaacagattggcataggcaattagtgggaacaccagcctgagggcatccaggggaaggatgcagacgttctggcagaggggacagtttaaccccagtgaggaggtgggaa

SEQ ID NO: 134405 - DNA, 164 bp, Homo sapiens
taaatagagacgaggtctcgctgtgttgcccaggctcgtctcaaacccaagagttcataatgttagcatttagataatctccaggctctggaggcactttcctcaggtgaatggggaatgcagttcatacatttacatatttgtcatgttactatgtgaggata

SEQ ID NO: 134406 - DNA, 436 bp, Homo sapiens
caggctgagccacaaatgggccattggttctacagagagagaggcccaagacttcaaaaatggcgacactttgaaatttaaggttagcctccactgataaaaacagttctggttttaattttcatatgtgatagtcgcagcaaacagaatggttggctatctttccccaacactattcctgaagtgacaattctgcatatattcagtgaccatgtgtacatccttttctgtgacgtttaatttcctacgtcctgtctcttttggagggtcttccctatatttgatcctgatttagacgcagtcccagtgcctgttattctctgtttctcatgtcagcctgtccattttcctctgtcctagcttgcttctcatcttcacacagtgtctgttgtgatgtggttttgcatgtgagttccctgcttcagagtttggaaat

SEQ ID NO: 134407 - DNA, 344 bp, Homo sapiens
tctgatcatgaggaaccaattacaatactaaaaagtgctttataaaatacaatattcagttgataggttgagaaaataaaaacatacttgcagtaatacttaaataaataataaatagaatatgcattctgttgttgggtgtagtgttccataaatgtcatttaggccaagtgattaataatgttttccaatcttctctttctttacgtctatacttggtctttgccagaaggctgagaaaaaattatccttatcctgtatccttctttattttttcctacttcttccattatttaccaagagagctacttaaagctattaatatctagatgtgattgtgcatt

SEQ ID NO: 134408 - DNA, 396 bp, Homo sapiens
aggtactggcaagcaaggtgagctgaactaggaatagcagttgaactttaaaggagctctgtacattccaacttatggcctgtacaaggggatggagtgatagggaccctctaaactaaaagctaaccatctgaagctctctttcaggacaaagtcttgtactgaggagaaactactgggaacagaatccagcagaacagagacaggagaagaaaaggaagaaggtggcccaaataaagaaccaggaagagtaatgaccagatgtctgaaagtgctaggattccctcttcccctccaccagaaaagtcaaaagagggagctctagagccagaaagctaaagtcttcctgcccacttctctctctcagtttatgaaaattaatttcctgcaaatcaa

SEQ ID NO: 134409 - DNA, 263 bp, Homo sapiens
tgtggggaacttccacggatgggctgcagcctggctggaagagagtgcagaaatggaagccaggagccagccaaggagaggcggccctcctatagtacactgggacttcccagggtatatcctgagggggagggtggctagaagtggagcagccctcctgcagaatcataactcaggttccaattattcagattgtccaggtccaggaaatctcaggccttggatttggcttaaggtggtcccagactggtatgatcccaaca

SEQ ID NO: 134410 - DNA, 473 bp, Homo sapiens
gcagagggggtggagcaggtggagggaatctgttgttgaagacttctgtcacctatgtgtggttatgtgtgtttccgcctcttttatgaggcgcgacctttaccaagagaaagaactgacactggaatcctgctaacagaactgttgatatcaacatataagatgtatccatggtttgtttatttagcaactatttatttgtttttgtgacagttttgctcttgtgggctggagtgcagtggtgggatcttggctcactgcaacctccgcctcctgggttcaagcgattctcttgcttcagcctcccaagtagctgggattacagacccctgccaccacgcctggctaatttttgtatttttagtagagacggtgtttcgtcatgttggccagagtggtctcgaactcctgacctcaggtgatccacctgccttggcctcccacagtgctgggattacaggcgtgtgccacca

SEQ ID NO: 134411 - DNA, 273 bp, Homo sapiens
tgggcgactctagaggacctcccccgactagcccgacagggagaaagctgctgctatcagcggcaaagcagtggccctggtccctgtccttgtggagttctccatcaattcccaatggtcaagacaaaagagctgcgtggaatggctggagaagccaaatgccttacctgaagtctcttgtgagtgaactaagcacctcataacaagtgttgggacctaattattttgtacatcaaactgtgctagtcacggggctaatctgactagtcgggg

SEQ ID NO: 134412 - DNA, 331 bp, Homo sapiens
aaacatgctgctgtggctgaactaagcccgggcactgagtgcagaaccaaggcttcccccacctatgcactcaagccccgacagtggactctcgacaggagaaagctgctgctatcagcggcaaagcagtggccctggtccctgtccttgtggagttctccatcaattcccaatggtcaagacaaaagagctgcgtggaatggctggagaagccaaatgccttacctgaagtctcttgtgagtgaactaagcacctcataacaagtgttgggacctaattattttgtacatcaaactgtgctagtcacggggctaatctgactagtcgggg

SEQ ID NO: 134413 - DNA, 752 bp, Homo sapiens
ggacgtgtgcgtgacctaggagtggggagcaaggtggctgggatcctgcagtaagtaggttgtgggtgtgtgcccctaacagtcttcaggtcacatttactcctgtccttttcttcaagatggagggatccctgggcctggacctcaactgctatccttgtacccccgggagggtttgtgaccctatcctgtttggaaaacccatgctgccctcttttccctttatgtgtaattacggttggatcatctctgtgctttgctcagattctccttcctccctctggggttgaggaggaggagacacatctgaccaattaatgtgtgtttgtgaaacaggcagcagcaaacagtcatttcagcttcgaggaattaggctcacacagggtggagagatcagagcccttcagggggaatatttctgaacaaatcacggatgattaaattctctaagaaacagctccctacctaaatgagagtgagaaagatagggaagaaagcctgtctgtttccagccatgtgtccagagcctaaggggttgaggagagtccccaagcccctacaggcctcccttttctgtattaggctttgctctgcagccttgagttaatttcacccctgctgctttgtcttgggggagggagtgctggtttaggctgttgtgaggagatgactgttctgctgccacacacaatagtcgtgtcattttatcgggagcgctaccccagggctgagaactgctgcagcagagataa

SEQ ID NO: 134414 - DNA, 741 bp, Homo sapiens
agggacgactagaggatacccccgcggtgtgtgcatgcactaagtaggttgtgggtgtgtgcccctaacagtcttcaggtcacatttactcctgtccttttcttcaagatggagggatccctgggcctggacctcaactgctatccttgtacccccgggagggtttgtgaccctatcctgtttggaaaacccatgctgccctcttttccctttatgtgtaattacggttggatcatctctgtgctttgctcagattctccttcctccctctggggttgaggaggaggagacacatctgaccaattaatgtgtgtttgtgaaacaggcagcagcaaacagtcatttcagcttcgaggaattaggctcacacagggtggagagatcagagcccttcagggggaatatttctgaacaaatcacggatgattaaattctctaagaaacagctccctacctaaatgagagtgagaaagatagggaagaaagcctgtctgtttccagccatgtgtccagagcctaaggggttgaggagagtccccaagcccctacaggcctcccttttctgtattaggctttgctctgcagccttgagttaatttcacccctgctgctttgtcttgggggagggagtgctggtttaggctgttgtgaggagatgactgttctgctgccacacacaatagtcgtgtcattttatcgggagcgctaccccagggctgagaactgctgcagcagagataa

SEQ ID NO: 134415 - DNA, 388 bp, Homo sapiens
gaactcacctctacccctcaccaccctttcctgaaggcaggactttacaattcccccaaaacctgagcttcttcagcagctacggaactaacatttatttaggcatctacttcttttattttttttgagatagggtctcactctgtcacctaggctggggtgcagtggtgcaatcatagctcactgcaacctctacctcctggactcaagcgatcctcctgcctcagcctctatgcttggctggggtctacaggggtctctcagaaaaagcctggctccgtcccctggcctttctttctggtcggctcttgagaactacaaggacagaacccacaaatgcccccatgacccttcccccttatcttttcgcgtcccagattcctgaaat

SEQ ID NO: 134416 - DNA, 530 bp, Homo sapiens
taggaaaaaggtaatttgtagtctaacgatatacttgctagatcagatcatagatgtgctggaatgacagagtctaggcattttacacacagagtatttgaattcaatttttcagacccttggtaggatgctcagtattattctgaatgtttctcccattgttacgaagttagctgcggtagattgatgtgtaaatttgttgatgtgacactgatgataaatgttttggaacaaaattacttgttaagtagggatgggggtgagaaattcaaataacccggaggcagaaactgctttcaggagctttatcttacaacgtgttcaactagattcaatctctgcttcaggagaggcatgttagagacatgaggaaggcccaagggaaaagggtgtcctttattgtttaatgaggagttccaagcaagatcagggtaattatagattctagatctctaaaggaagaaagaataaccagggcctttctagggataaaggaaaggaaatacatcatgattgacatggagaggtgc

SEQ ID NO: 134417 - DNA, 530 bp, Homo sapiens
tttaatgatcgggtggggcggggggggggtctccctgtgttgcccaggctggtcttgaacttctggtctcaacctcccgaagtgctgggattaccccgcccagcccaaagcaaccccaatttaataactgattggttataattatgtagttctgttattcggattatttaggtggatggttcctggttatgtaatcagaggtaaattgctgatttggggttaagttttctttcccttcaagttaattacaagaaaggcatgaagtacctttaggttttcttggtgaggaactcagggcaccatcatcacttaagggaggagaccacccctcatattgtcttatgcccaatttctgcctccaaagaaagaagaagtaaaaactaaaaggcagaaatgaaatccacaggcagacagcccggcgccgcgtcctgggcctggttacagattgacccttgacctgaccggttgtgttatctatagattccagacattgtatggaaaagcactgtgaaaatccctgtcctgttctg

SEQ ID NO: 134418 - DNA, 652 bp, Homo sapiens
ttagaacaatggcaaaatagacttatgatgtatatcttgttttaaaattagcaatacatgctatttggggaatgcataaaattgtagtattaaaaaatccataatcccaccatgatgatcattttcaaatatattatttttatacatttgggaatatatactttgtacaactcgtattctgttttttcccccacctacccttatagcttaatatttgccatgctgttgaaaacgccgtttatccatttgcgatgtctggatactgttgtagtggtagattggtcagattgggatgagaatagcacttttcattcacatttgatgaggacataaattagtgtagcatttctggaagcagtttagcaatatgtatcaagaaccttgaaaacatccatactatttgtttgacccattaattctacttactaagaatctattctgatccctaatgtaataatcaaagatgggaacagatatttttacataagagtgttcattgtagtactgtttgtacaagtgaaaatctaaaaactaaatgttcaacagtagggagttggttaagcaaattatagtatatttatatgatgaaatattatgtaactattaagataatattttaagaaacagattttttaaatgtatgtattggaca

SEQ ID NO: 134419 - DNA, 390 bp, Homo sapiens
cttatgttgaccaccatctttaagaactgtaacactcaccgtgagggtccgtggcttcattcttgaagtcagtgagaccaagaacccaccaatttcggacacactcctagaataaattcattcaatttcagctgatttgacacatcagattctcacttttgctctcttgctcttttcaactttctgtctattcagtttttgcctttatcaatttcttcattctaaaacaacctgtgggctaagtgcggtgggtcagaacataagcttatgttctgacccacctttgggctctaggaggagagggtaggagagagtaagaagaccacataggaaatgaaagcaagagatgatggtggcttgggtggcactggaggtggtgagaagtgaatg

SEQ ID NO: 134420 - DNA, 760 bp, Homo sapiens
gaaagtaaatcatgagaaagggtttgactgaagtaatgggggctgcccctgaagccttgtggcagtacagcccagaaccaaacttcagtttcaaaattgtctttcctaatgcctggctttctggatggatcacagggcccatgaaaacatcgagaaaagaggtgaagaaagctttctatggtttgaatcttctggaaacatcagagaaagactgtccttgccatccatactataacaaaacttcaggactttgggcttcgggttcatggtttcacaactgagaagggttcatccaccgttttggaactgtgcacccattggaacccttgaggtaaagctaaccagggaaatttctcccaagaagaagatggcatccttgatgtgaacagcttttcccaagttcacagattaagacttctactgtcacaaaactctgatctttgaatgttttttcttgcttatgcctctatgaacaatagaagtggaaacggggtctgttatgtgcactaatggggtgtacttttgtgaaggagtttgcagccatccttatacatggataaccttaaactttgatagataaatgatgaaggcacaatgtaaataagaaactttaatgttgcctcatatgtacatatgttgcctcataatcagtcaaaaccaaaacattgattcactcctcttaacccacatcatgggttaaaaacaacattaacagaaggccttcactcttctaaaaggacatcattttttaggtcctttt

SEQ ID NO: 134421 - DNA, 468 bp, Homo sapiens
  misc_feature (1)..(1): n is a, c, g, or t
  misc_feature (9)..(9): n is a, c, g, or t
  misc_feature (365)..(365): n is a, c, g, or t
  misc_feature (368)..(368): n is a, c, g, or t
  misc_feature (413)..(413): n is a, c, g, or t
  misc_feature (439)..(439): n is a, c, g, or t
  misc_feature (456)..(456): n is a, c, g, or t
naagaattnggcacgagggatatgaacacatacatacacatatgtacacattcatagatacacacacctcaacaataacgttatgaaaacatcaacaacaacgttatgaaaagttcaacaacagtgttatgaatacactcattcatcactagtactgttctcctgaacatgatatgtgggggggaggggatctatgtatcatgacctctccacatctgcccgcagactacccctttttcttctgcaccacccttttccgtaccctcagtgcttggcagtgcctagctttttccaggtgcctgtttgcatgagcactggggagtgccgcaagcttattcccttttagttgaggggttaattttagnttnggcactgggccgtcgtttttacaacgtcgtgactggggaaaaccngggcgtttacccaactttaattcgcnttgcaggcacatccccntttttcggccag

SEQ ID NO: 134422 - DNA, 108 bp, Homo sapiens
atttctcagcttatcagtaagaacactgagaggttatgacagccatagtttaggggcatgcagtattagggacagaggcaaggagttgctcaagctcagcagatacta

SEQ ID NO: 134423 - DNA, 338 bp, Homo sapiens
tggatttcatagattcaatgtacttaagtcaactataattaattttgatgttaaaattattacaactttagccattgataattaaactggctcctgtgtctgttgaactgctgcttgctttctggggcacaaggcttcccttgtgccttgtctgccttgcctgttctggagctacacttggccatttctccaataggaatggtatgaaatacttgaatttaggtgttaaacatgttcattactctcaggatgtgattacttctgagccattttctatggacagtattgactttaaaattcattcattcatttttatattttcaattcaattttttaac

SEQ ID NO: 134424 - DNA, 764 bp, Homo sapiens
gaaatgaaaagacatactcaagatatggaacctggcagatgtaactaatgattagatgtaggagcaaagggggaagatggtatcagtggtgaccttcagatttctggtgtaaagtcctgggaggatggtgataacacagtaaagaagtgaaaacaaatggtttgaaaaatagatgtcttgaaagtcaggtaagtctcactcatttcaccccttctcagcttgataaaactacctaaaaatgcaacagtttcctgacagactactggttacaacacattctcccaaccaatttatatcccttaagttttggttatatgcaacattaatgtaatttggctaatttaaaccaaattaaaggggttggagaatttagaagaattctgggatagtttatataacttaaggaagagctgaacaactaagcttgacaatgggaactaaggtgcttccatgatcctcagcagcatgatctttctagaatgcattgtaggtggcttccctgtcttttctgtgtatctgttcaagcttcaaatactaagacagtctagtacaatgtgtttcgttttgttttgtttttttgagataagatcttgctctgtcacccaggctggagtgtagcagcatgatcatggctcactgtagcctcaacctcctgggctcagccacccaagtagccaggaccacgggcatgtgccaccacacctggctaattttactttttatagacacaggggtctcactatgttgcccaggttggtcttgaa

SEQ ID NO: 134425 - DNA, 657 bp, Homo sapiens
tattatccacacaggttacttaaaaacattctcggttatcttgaaattagaggagacatagcatgagtgaaattatcacagactttgggcctgatgtgaaaacaaagttgaaattaattaattgctaattgcaaagataaaagatgccaggcatggtggctcacatctataatccaagcactttgagagaccaaggcgagtagattgcttgagctcaagagttgaagaccagcttgggcaacatagcaagaccccatctctacaaagaaacaaaaattagccaggtgtggtggagtgggcctgtagtctcagctacttgggagactgaggtgggaggatcacctgagcctgggaggtccaggctgcagggagccctaattgcaccactgtattccagcctgggtgacagagcaagacctcccaaaaaaaagaaagataaaaagtatttatttgcatataacctgctgctttttagacatggcttcctgcctgtttagcaatatcataatgaaatccaatacttccaccagatctgggatctgattagatcaatctgtaaaacaaaatttaatcattaagtaatttaaagaggttataatttctaccaggcaagtctggacaacagtcttaagaaagtatcccttgtgccaactgaaa

SEQ ID NO: 134426 - DNA, 333 bp, Homo sapiens
accccgtatcccaccccttcagggctcaggcctccactagaaggtgactcatggccagggaatgccagtgagagccgatgagtggctgcatctggctgtagagtagccagtgcctagtgtggggtagtcagcagtgctcggaggacaattcacttgagctcctgggcccctttccctggaaataggtgtatttttgacagggtcttgttgaaacaacagttcagagcacaggcatgactccaggagtagggatttatggcatgtgggacaggctggttgtgtgcccagcccagcatgagcccctcaggcagcgccatgcacatgggccactga

SEQ ID NO: 134427 - DNA, 231 bp, Homo sapiens
gatcactaatatttttaaggagtagctcacaattaccagactgcactcaaaacagcagaaattctctccaagaaaatgtgtaaatagctagtttctacaggagaggaaacctctctgagtttgtcaccttcagctttggttcacactccacctgacccatttaattatacaagggcatcagtcattgaaagctaaaattaacagttcatgacttttgccagagagctctga

SEQ ID NO: 134428 - DNA, 424 bp, Homo sapiens
ggcaaagggctctgaatatcaggccaccttctggagttttgggggtagtttttgaagatcatatggaaacacatatgaagatggagggcatggggcaaatatgcgatatacaagggtgacccctcaaagccggctcactgagccaactgcaggcaaagtgcaaagttgtaaaaatcaagcccttagtgagcctcccaagccaaagaaaccagaggccctctgtctgttttccctctatcctctcttcccaaatggtttgggcaggattcaacgctaatggctgggaaagggcgtctgtgggctctccctgagatacacccacgtccctctggcatggggtctcatggcaacagcagatggctccctggtgtggtgggtttgcgtggttttctctctattttccttgttttggtttttgagaatg

SEQ ID NO: 134429 - DNA, 284 bp, Homo sapiens
tatgtgtcccctctaagtttcatattgaaatataatccccaactttggaggtggggcctggtgggaggtgtttggatcatgggggtagatctctcatgaatgacttggttgccatccccttgatgataagtgagttattggtctgagttcacacaagatctggttctttaaaagtatgacacctacccctctttattcctcctgctcccactatgcataagacacctgtcccctctttgcctttcatcatgattggaagcttcctgaggccaccccagaagcag

SEQ ID NO: 134430 - DNA, 250 bp, Homo sapiens
tatgtgtcccctctaagtttcatattgaaatataatccccaactttggaggtggggcctggtgggaggtgtttggatcatgggggtagatctctcatgaatgacttggttgccatccccttgatgataagtgagttattggtctgagttcacacaagatctggttctttaaaagtatgacacctacccctctttattcctcctgctccctccatgtggcttcaagccaccagggcacagccccccgaaca

SEQ ID NO: 134431 - DNA, 723 bp, Homo sapiens
cgggctgcaggattcggcacgaaaaacatatggagacgtttatacccattgatttgacaactgaaaatcaagagatggacaaggaggaaaccaagacaaaaccaagacttttaagatatgaagagaaaaaatatgaagatgtgaaaccattagagactcaaccagctgaaatagcagaaaaggaaacattggaatataaaacagttagaacattctctgaatctttgaagtcagagaaaacagaagattaccttagagaaagtataattcaacaacatatggtttctccagagccagcttcccttaaggagaaagggaagtcaaggagaaaaaaggatcaaactcatgcttgtccaaatgttaggaaagccaggcctgtgtcctatgatagaacagaaccaaaagatgatgatgtgataagaaatattattaggctacgagaaaagcttggttggcaaactatattaccgcagcacagtttgaaatacggaagctccaaaattgcaattcagaagattactttaaagaaacctttggaagatgatggagaatttgtttattgccttcctcggaaaagtcctaaatccctttacaatccatatgatcttcaggtagtatcggctcatactgctaaacattgcaaagaattttgggttattactgcttcatttatctcaaaggtaatgtttaatggatgttttaagctttcagaattatattaca

SEQ ID NO: 134432 - DNA, 1156 bp, Homo sapiens
aggcggttacggccaggaggcgtcggagcctggcgtggtagggctgtgctgcgcggtccttcccattcaccctagtctggcgctcgccggcgtgggcgggccggaccttcgccgcttccaggaagggccacaacggccgtcggaccacggcgcggcggccagttcctttatagttttgttcagaaaaacatatggagacgtttatacccattgatttgacaactgaaaatcaagagatggacaaggaggaaaccaagacaaaaccaagacttttaagatatgaagagaaaaaatatgaagatgtgaaaccattagagactcaaccagctgaaatagcagaaaaggaaacattggaatataaaacagttagaacattctctgaatctttgaagtcagagaaaacagaagattaccttagagaaagtataattcaacaacatatggtttctccagagccagcttcccttaaggagaaagggaagtcaaggagaaaaaaggatcaaactcatgcttgtccaaatgttaggaaagccaggcctgtgtcctatgatagaacagaaccaaaagatgatgatgtgataagaaatattattaggctacgagaaaagcttggttggcaaactatattaccgcagcacagtttgaaatacggaagctccaaaattgcaattcagaagattactttaaagaaacctttggaagatgatggagaatttgtttattgccttcctcggaaaagtcctaaatccctttacaatccatatgatcttcaggtagtatcggctcatactgctaaacattgcaaagaattttgggttattactgcttcatttatctcaaaggttattaatatagttggtagtgtaaaggaagtagaactcatacctactttggaatggctatcagaaagaagacattactatttattacggcaattcaagatattttctgatttccggaagtcagggaccccgaacggagggaccggccgaagccatggcagaagaacgtggattgtgaagatttcatgaacatttattagttccccaaattaatacttttataatttcttacacctgtctttactgcagtctccgaacataaattgtgaagatttcatggatacttatcacaataaatacccttgtgatttcct

SEQ ID NO: 134433 - DNA, 1727 bp, Homo sapiens
accacatctttgcatgaggtagatctgtatgtgcaaataaagaaatatctctaatatgcagtatcaagtgagaatggaggaaaaacttctatagatatatgaatatacacgtagatacatatgtgctgataaaaatatgtatacttttctctctggaataaatttttttatgtggtgacattcagataggggaggggcactcatgggaagagagagaactccttgatgaagggcatgtagtttttgaatgtcaatatagggtatgtgggtggtgagattataagattatacacacatttctgtagctaaaattaagttcataaatactacttttatagaaaatgtaaaaattatgagactcaaatctgaacagctatttgtgaaaagtatctcagggtgaggaggaagtttctcttctctctgttggagcacaagaaatagcattagaaaacgacaagtacagaagcagtgtgttgagggaaatcaaatttgggtatagataaagtggctgaggattcatacatagaaaaagcttaattataaaggcaagaagttacaagaagttatcagccaaatacaggctttcttaatttcttgaaaatggtacatattttttaaagaaataaaataatgcttttgtgctttattttgtaggttattaatatagttggtagtgtaaaggaagtagaactcatacctactttggaatggctatcagaaagaagacattactatttattacggcaattcaagatattttctgatttccggtgaggtgaaaaaaatgaaaccaattctttgtagtttgatcctattgaaggagcagttgcctgagtgacatctgggttctactacagtaataccagtagaaaatagtactaattcttttatctaaaaattttttacggaacaccccatttcctctgtaacttatgaagaaatgccaataattttggcatttaagaagcatttttcctttcagaattaataaagcatttgttacctgtaacttatgaggaaatgccataagttacagaagaatgagatgttccataaaatttctttagataaaggaagtttactcttttcagtattaaaactcttaattttagtctctttggataaatattgtaaaaatattttatggtcaagcaaacttaaatacaccctacagttgactctggaacaacgcaagggttaggggctctgaccccctacacagttgaaaatttgagtataacttttgactctacccaaactttgctattaatactaatagtctattgttgacaagaagctttatcagtaacataaacaatcaattaacatgttttgtctggtagatatatactgtattcttacaataaagtaagttagaggaaagaaaaaggaaaatcataagggagagaaaataaatttactactcattaaatggaagtagatcataataaaattccttcatcctcatcattttcacattgagtaggctgaggaggtggaggaaaagtagaggttggtttttgttgcaggaagtcagggaccccgaacggagggaccggccgaagccatggcagaagaacgtggattgtgaagatttcatgaacatttattagttccccaaattaatacttttataatttcttacacctgtctttactgcagtctccgaacataaattgtgaagatttcatggatacttatcacaataaatacccttgtgatttcct

SEQ ID NO: 134434 - DNA, 941 bp, Homo sapiens
aggcggttacggccaggaggcgtcggagcctggcgtggtagggctgtgctgcgcggtccttcccattcaccctagtctggcgctcgccggcgtgggcgggccggaccttcgccgcttccaggaagggccacaacggccgtcggaccacggcgcggcggccagttcctttatagttttgttcagaaaaacatatggagacgtttatacccattgatttgacaactgaaaatcaagagatggacaaggaggaaaccaagacaaaaccaagacttttaagatatgaagagaaaaaatatgaagatgtgaaaccattagagactcaaccagctgaaatagcagaaaaggaaacattggaatataaaacagttagaacattctctgaatctttgaagtcagagaaaacagaagaaccaaaagatgatgatgtgataagaaatattattaggctacgagaaaagcttggttggcaaactatattaccgcagcacagtttgaaatacggaagctccaaaattgcaattcagaagattactttaaagaaacctttggaagatgatggagaatttgtttattgccttcctcggaaaagtcctaaatccctttacaatccatatgatcttcaggtagtatcggctcatactgctaaacattgcaaagaattttgggttattactgcttcatttatctcaaagagatacttggtcatttgtggagcagtttatatataagaatctccttgggagcatgttatttaatagtgaagtttttccttttgtgtagagatttaggtttgaagattcaactttaataaattttttcatctatcaaatactttgttaatacttggggtaaatttttacaggaagaactacaaaacaagcatttgctagcttaatgggaactataataataaagaaaagaatattctttattggcacatt

SEQ ID NO: 134435 - DNA, 1915 bp, Homo sapiens
aggcggttacggccaggaggcgtcggagcctggcgtggtagggctgtgctgcgcggtccttcccattcaccctagtctggcgctcgccggcgtgggcgggccggaccttcgccgcttccaggaagggccacaacggccgtcggaccacggcgcggcggccagttcctttatagttttgttcagaaaaacatatggagacgtttatacccattgatttgacaactgaaaatcaagagatggacaaggaggaaaccaagacaaaaccaagacttttaagatatgaagagaaaaaatatgaagatgtgaaaccattagagactcaaccagctgaaatagcagaaaaggaaacattggaatataaaacagttagaacattctctgaatctttgaagtcagagaaaacagaagattaccttagagaaagtataattcaacaacatatggtttctccagagccagcttcccttaaggagaaagggaagtcaaggagaaaaaaggatcaaactcatgcttgtccaaatgttaggaaagccaggcctgtgtcctatgatagaacagaaccaaaagatgatgatgtgataagaaatattattaggctacgagaaaagcttggttggcaaactatattaccgcagcacagtttgaaatacggaagctccaaaattgcaattcagaagattactttaaagaaacctttggaagatgatggagaatttgtttattgccttcctcggaaaagtcctaaatccctttacaatccatatgatcttcaggtagtatcggctcatactgctaaacattgcaaagaattttgggttattactgcttcatttatctcaaaggttattaatatagttggtagtgtaaaggaagtagaactcatacctactttggaatggctatcagaaagaagacattactatttattacggcaattcaagatattttctgatttccggtgaggtgaaaaaaatgaaaccaattctttgtagtttgatcctattgaaggagcagttgcctgagtgacatctgggttctactacagtaataccagtagaaaatagtactaattcttttatctaaaaattttttacggaacaccccatttcctctgtaacttatgaagaaatgccaataattttggcatttaagaagcatttttcctttcagaattaataaagcatttgttacctgtaacttatgaggaaatgccataagttacagaagaatgagatgttccataaaatttctttagataaaggaagtttactcttttcagtattaaaactcttaattttagtctctttggataaatattgtaaaaatattttatggtcaagcaaacttaaatacaccctacagttgactctggaacaacgcaagggttaggggctctgaccccctacacagttgaaaatttgagtataacttttgactctacccaaactttgctattaatactaatagtctattgttgacaagaagctttatcagtaacataaacaatcaattaacatgttttgtctggtagatatatactgtattcttacaataaagtaagttagaggaaagaaaaaggaaaatcataagggagagaaaataaatttactactcattaaatggaagtagatcataataaaattccttcatcctcatcattttcacattgagtaggctgaggaggtggaggaaaagtagaggttggtttttgttgcaggaagtcagggaccccgaacggagggaccggccgaagccatggcagaagaacgtggattgtgaagatttcatgaacatttattagttccccaaattaatacttttataatttcttacacctgtctttactgcagtctccgaacataaattgtgaagatttcatggatacttatcacaataaatacccttgtgatttcct

SEQ ID NO: 134436 - DNA, 1091 bp, Homo sapiens
aggcggttacggccaggaggcgtcggagcctggcgtggtagggctgtgctgcgcggtccttcccattcaccctagtctggcgctcgccggcgtgggcgggccggaccttcgccgcttccaggaagggccacaacggccgtcggaccacggcgcggcggccagttcctttatagttttgttcagaaaaacatatggagacgtttatacccattgatttgacaactgaaaatcaagagatggacaaggaggaaaccaagacaaaaccaagacttttaagatatgaagagaaaaaatatgaagatgtgaaaccattagagactcaaccagctgaaatagcagaaaaggaaacattggaatataaaacagttagaacattctctgaatctttgaagtcagagaaaacagaagattaccttagagaaagtataattcaacaacatatggtttctccagagccagcttcccttaaggagaaagggaagtcaaggagaaaaaaggatcaaactcatgcttgtccaaatgttaggaaagccaggcctgtgtcctatgatagaacagaaccaaaagatgatgatgtgataagaaatattattaggctacgagaaaagcttggttggcaaactatattaccgcagcacagtttgaaatacggaagctccaaaattgcaattcagaagattactttaaagaaacctttggaagatgatggagaatttgtttattgccttcctcggaaaagtcctaaatccctttacaatccatatgatcttcaggtagtatcggctcatactgctaaacattgcaaagaattttgggttattactgcttcatttatctcaaagagatacttggtcatttgtggagcagtttatatataagaatctccttgggagcatgttatttaatagtgaagtttttccttttgtgtagagatttaggtttgaagattcaactttaataaattttttcatctatcaaatactttgttaatacttggggtaaatttttacaggaagaactacaaaacaagcatttgctagcttaatgggaactataataataaagaaaagaatattctttattggcacatt

SEQ ID NO: 134437 - DNA, 2734 bp, Homo sapiens
  misc_feature (67)..(67): n is a, c, g, or t
ctgatgcagtggatcggattgttgcataccggttgggcatcaggcaggctggacagcagcgctggtngggagcaggagattaaaataaatgggaatattcaaaagggagaattaattacatataacttgacagagctaattaaaccagaagcttatgaagtccgactgactcctctcaccaaatttggtgaaggagattcaacaattcgtgtgatcaaatatagtgctcctgtaaatcctcatttgagagaatttcattgtggatttgaagatggtaatatttgtttgttcactcaagatgatacagataattttgactggacaaagcaaagtacagcaacaagaaatacaaaatatactcctaatacaggacctaatgctgaccgtagtggctccaaagaaggtttttatatgtacattgagacatcacgacccagattggaaggcgaaaaggctcgacttctcagccctgttttcagcatagctcccaaaaacccttatggacccacaaacactgcatattgtttcagcttcttttatcacatgtatggacaacatataggtgtcttaaatgtttatctacgtttgaaagggcaaacaacaatagagaatccactgtggtcttcaagtgggaataaaggacaaagatggaatgaggctcatgttaatatatacccaattacttcatttcagctcatttttgaaggtatccgaggtcctggaatagaaggtgacattgctattgatgatgtatcaattgcagaaggagaatgtgcaaaacaagacctagcaactaagaattccgttgatggtgctgttgggattttggttcatatatggctttttcccattatcgtcctcatctctatcttaagtcctcgaaggtgaccttatcctggcagaggctataaaagattcaccaggcactggcatgaagaaagagtctttgtaaatggacattgaacaaacaaactaccaaagattcctccactgactactgactcaaaaataaaataataaaaacaaatttttttaagcactggggataaaaagacatcatggaagtataacttattccagactaaacataaaagataatcttgacctgagtagagaagagaccttcaggtgcttttgtggctaaaaagattacagcgtcatctggttgaactctggaaaaaaaaaaaaaaaaatgaaaaaaagaaaaaaaaaagagctatagaaatccttgtcaaagcacaaagtcatggctggttttgtttcaaatgaatagtttgcttgttaccatggaaacctaatggcctgccaacaaaaacctcactgtaaacagggtacgtgaagagctggcatttattttccttacgagaaggttttcgtagagaattaaataaatgtaggcccttttacctttggctgttacccttccttgaaaataacccgaactcagaattatttaaagcattcatgtttctccccaccttatccccatcccacctttattattattatttttctcccatggctaagctagataactgtatgctgtctctttttgcatgcactactatccaggatggtaaacctgggcttacatgttacacaggcttatcggagtttgcttgcggccacttgaacacccaaactacgtcatctgttccaatgaagaaaccaaaccaccatcttttataaattgccatggaaaccaagtgccttcaatgaaacaagcctgaataattttcaactcagaagcttgcactgctaagagtggtttgtgtaaaactattttataaacaaactacagagcctaaatgtgcaaattacaggcaagacaacaaagccgcttctgaagaagaaaggaccgaagctgctgcgtaagcccatgcagacaagatatttgttgtttaacctcctagacagccatggcctttcggcttattgtccattagaaaatcacttccattgagaccagacatggagcaacactttttttcttccaggttattaaatgggtcaaccagagcaaaaggttattaagaatacttagtgcagaaggtggtaaaacacaaaagtgatttttttactctaacctccatttgaaatgaaattggccctagctttagagggaacaagaaaatgtttgggattgcagtgcatactaactctacagtggaactgggcctgaaaaatctggctttattctaaactctgagggtaatatgcctctgccctttagtcagactctgtgcaaattgtgaaatattattttattattttcaccaagattataaaaacacttttacaaaaaaacaaaaacctgtaaaaataattttgagctacctgacgacaaatcatatctttaaccagccagttttccaatgcattgtaaatttcacttaaacctgttggttatgaaaatttgaagatcattttcccttaaattatcctcagcttttaacttcatttaaaaagacttttgtcctaagaagaatattattattatatgttctttcaacacccccaggattaaaaaaaatgattatgcaagcaattggaatataagtattaaattatagcatttgcaaatattaatataaaagcacaacaaaatgtagtggaaaatgacaaagcttgttttttaaaacaattctgtagaaatgtttgtgcaaattcagtaattcaacttaaaatataattttacagctatgttcaataaagcctctttccaggtaaggta

SEQ ID NO: 134438 - DNA, 2890 bp, Homo sapiens
  misc_feature (67)..(67): n is a, c, g, or t
ctgatgcagtggatcggattgttgcataccggttgggcatcaggcaggctggacagcagcgctggtngggagcaggagattaaaataaatgggaatattcaaaagggagaattaattacatataacttgacagagctaattaaaccagaagcttatgaagtccgactgactcctctcaccaaatttggtgaaggagattcaacaattcgtgtgatcaaatatagtgctcctgtaaatcctcatttgagagaatttcattgtggatttgaagatggtaatatttgtttgttcactcaagatgatacagataattttgactggacaaagcaaagtacagcaacaagaaatacaaaatatactcctaatacaggacctaatgctgaccgtagtggctccaaagaaggtttttatatgtacattgagacatcacgacccagattggaaggcgaaaaggctcgacttctcagccctgttttcagcatagctcccaaaaacccttatggacccacaaacactgcatattgtttcagcttcttttatcacatgtatggacaacatataggtgtcttaaatgtttatctacgtttgaaagggcaaacaacaatagagaatccactgtggtcttcaagtgggaataaaggacaaagatggaatgaggctcatgttaatatatacccaattacttcatttcagctcatttttgaaggtatccgaggtcctggaatagaaggtgacattgctattgatgatgtatcaattgcagaaggagaatgtgcaaaacaagacctagcaactaagaattccgttgatggtgctgttgggattttggttcatatatggctttttcccattatcgtcctcatctctatcttaagtcctcgaaggtgaccttatcctggcagaggctataaaagattcaccaggcactggcatgaagaaagagtctttgtaaatggacattgaacaaacaaactaccaaagattcctccactgactactgactcaaaaataaaataataaaaacaaatttttttaagcactggggataaaaagacatcatggaagtataacttattccagactaaacataaaagataatcttgacctgagtagagaagagaccttcaggtgcttttgtggctaaaaagattacagcgtcatctggttgaactctggaaaaaaaaaaaaaaaaatgaaaaaaagaaaaaaaaaagagctatagaaatccttgtcaaagcacaaagtcatggctggttttgtttcaaatgaatagtttgcttgttaccatggaaacctaatggcctgccaacaaaaacctcactgtaaacagggtacgtgaagagctggcatttattttccttacgagaaggttttcgtagagaattaaataaatgtaggcccttttacctttggctgttacccttccttgaaaataacccgaactcagaattatttaaagcattcatgtttctccccaccttatccccatcccacctttattattattatttttctcccatggctaagctagataactgtatgctgtctctttttgcatgcactactatccaggatggtaaacctgggcttacatgttacacaggcttatcggagtttgcttgcggccacttgaacacccaaactacgtcatctgttccaatgaagaaaccaaaccaccatcttttataaattgccatggaaaccaagtgccttcaatgaaacaagcctgaataattttcaactcagaagcttgcactgctaagagtggtttgtgtaaaactattttataaacaaactacagagcctaaatgtgcaaattacaggcaagacaacaaagccgcttctgaagaagaaaggaccgaagctgctgcgtaagcccatgcagacaagatatttgttgtttaacctcctagacagccatggcctttcggcttattgtccattagaaaatcacttccattgagaccagacatggagcaacactttttttcttccaggttattaaatgggtcaaccagagcaaaaggttattaagaatacttagtgcagaaggtggtaaaacacaaaagtgatttttttactctaacctccatttgaaatgaaattggccctagctttagagggaacaagaaaatgtttgggattgcagtgcatactaactctacagtggaactgggcctgaaaaatctggctttattctaaactctgagggtaatatgcctctgccctttagtcagactctgtgcaaattgtgaaatattattttattattttcaccaagattataaaaacacttttacaaaaaaacaaaaacctgtaaaaataattttgagctacctgacgacaaatcatatctttaaccagccagttttccaatgcattgtaaatttcacttaaacctgttggttatgaaaatttgaagatcattttcccttaaattatcctcagcttttaacttcatttaaaaagacttttgtcctaagaagaatattattattatatgttctttcaacacccccaggattaaaaaaaatgattatgcaagcaattggaatataagtattaaattatagcatttgcaaatattaatataaaagcacaacaaaatgtagtggaaaatgacaaagcttgttttttaaaacaattctgtagaaatgtttgtgcaaattcagtaattcaacttaaaatataattttacagctatgttcaataaagcctctttccaggtaaggtatgacaagcagtatgtgtgtttgttgagcaatgttcacttatcactaaaatgaaattagttatacaatttattggttaccatgggataaatcttcagtgctccacataccttaatgtctgcagaaagaaattttaataggaactccctgatgcactc

SEQ ID NO: 134439 - DNA, 655 bp, Homo sapiens
  misc_feature (67)..(67): n is a, c, g, or t
ctgatgcagtggatcggattgttgcataccggttgggcatcaggcaggctggacagcagcgctggtngggagcaggagattaaaataaatgggaatattcaaaagggagaattaattacatataacttgacagagctaattaaaccagaagcttatgaagtccgactgactcctctcaccaaatttggtgaaggagattcaacaattcgtgtgatcaaatatagtgctcctgtaaatcctcatttgagagaatttcattgtggatttgaagatggtaatatttgtttgttcactcaagatgatacagataattttgactggacaaagcaaagtacagcaacaagaaatacaaaatatactcctaatacaggacctaatgctgaccgtagtggctccaaagaaggtttttatatgtacattgagacatcacgacccagattggaaggcgaaaaggctcgacttctcagccctgttttcagcatagctcccaaaaacccttatggacccacaaacactgcatattgtttcagcttcttttatcacatgtatggacaacatataggtgagatagcaataattactgattcttacaaaattaatgataactaagaagaaaaaggttcataaacacacagcattaaaacaatttttggtc

SEQ ID NO: 134440 - DNA, 744 bp, Homo sapiens
  misc_feature (454)..(454): n is a, c, g, or t
  misc_feature (478)..(478): n is a, c, g, or t
caagccttggcggcaaaggagagtgggacgtaagtctggaaatgcatggcacggatgaaggtttggctccaaacacccttgcacactgagccccaaacacgaccatctccacaaccccacagacatgcacagccctcatggccacagatacgactgtgcgccctgtcacatccagcctccctgacacccacatatccacagtcccaggcacacagccactcacaatacacatacacaattccaattatgcagccacgcatacaccgtgccatgtgtcttctgtttataccaccacaaatgcatcatacacagtcacaaaatcatcacacacacacatatacgcaacatacacacatacgccacccattcctccacagcaacactcacaagggcacatacagcttcatacacacaacgccttgcacttgaggagccaatgggaagaaatccaagnaacggtgactattagtattgaccngtacttctagaaacctggcttagggagaaactgtaataaatgttatgatttgtagctaacgtgtattgaataagatctgcccggaactgtattaggtgctttctgttatctatttaatcctcatcacatttgtgggaggaaaagggactatttattttgcacatattgcagataagtaaattgaggattagagatgtctaggaataaactagtgtatagtgagccatgatcaccccagagcgactgaccggggggtcctctagacc

SEQ ID NO: 134441 - DNA, 462 bp, Homo sapiens
  misc_feature (434)..(434): n is a, c, g, or t
  misc_feature (453)..(453): n is a, c, g, or t
caagccttggcggcaaaggagagtgggacgtaagtctggaaatgcatggcacggatgaaggtttggctccaaacacccttgcacactgagccccaaacacgaccatctccacaaccccacagacatgcacagccctcatggccacagatacgactgtgcgccctgtcacatccagcctccctgacacccacatatccacagtcccaggcacacagccactcacaatacacatacacaattccaattatgcagccacgcatacaccgtgccatgtgtcttctgtttataccaccacaaatgcatcatacacagtcacaaaatcatcacacacacacatatacgcaacatacacacataatgccactggtcaacccacaatgccactggtcaacctcacaatgccactgtgtcaaccctacaatgccactggtcanacccactgattgggtaccntgatgctct

SEQ ID NO: 134442 - DNA, 413 bp, Homo sapiens
tccttgaactcctggggtcaaaagatcctcttgccccagtttcccgagtggttgggactacaggtgtgtgtcaccacgcctggctaattattttatttttcgtagagacaaggtctgactgtgttgcccaggctagtcttgagctcctaggcttaggtgatcctcccaccttggcctcccaaagtgtcaggattataggtgtgagccactgcacccagcctggatttgctcttttatcaagaggttaatatttattcttccgttcagtgaaccgtgggattgaattcccccagcgattgaaatgaaagggcttatgtataacatttcctgaggaatggtagtaccagagttcagaggagacctcaggccatttattctataaactcagaagctgtagttctagatgatgtggc

SEQ ID NO: 134443 - DNA, 128 bp, Homo sapiens
atacatgccccccactgggatggctaacctttttgtgggatagaggcttaatgataattgattacattctggaattcttggtaaagaatacaaggggtcttaggagccaggttttttagtaagggggc

SEQ ID NO: 134444 - DNA, 319 bp, Homo sapiens
ggaggtgaaagtgagggaatgccttagaattaaaatctctgccttgggagagttggtaaatttttttaaaaagctgaaaattttatgacccgtaaattatgtttattatgaaagctaagaaaatagtgagacatgatttaattttgttgatgggtgcacgggtcagaataattttatttcctgtgtcttagaatcaccttttgttattccccaaggcccttggtattttataaatgtattgccaggctattctcagggagtgttatatatcttccatgaaatgtaatagagatttaaaagataagttgtatgtcacata

SEQ ID NO: 134445 - DNA, 163 bp, Homo sapiens
gcgtatctgaacctgggccctgtaggggccatgccccaggcccaccatgaacctggaagggctggagatggttgctgtgctcgtggtcctcgctctgtttgtcaaggtcctggagcagtttggcctctttgagcctgtctccttggaaggtaatccaggtgtc

SEQ ID NO: 134446 - DNA, 302 bp, Homo sapiens
gttctgcagtcctttaatcttgtttttttaacattaccagagaggaaaaatattaatattctgtgatgcaatcaatatcttctctagtaacaataccctgttccacactgttctatacaaacacagattctaccctgaatttcagaaaccactaggaaaataacagataacagagaaattagagctcttaggtttaacttagagccaaaatcaaaagagaagagaattcagagagaggaaggaagaagctgagagggtcgtggtgtagaacacttactttcaggaacacagtgtcccttaga

SEQ ID NO: 134447 - DNA, 320 bp, Homo sapiens
gaaaagtccaacaagattttttaaaaatgaaacttggaacttcacttgaaatgcccaaggatatccaaaaatagttggaaaaagcagggcaatgaaggatttgtcttccccgacaccaaaacttgctacaaaacgacaccatgtaaaagtgtgatattgaggcagtttataactatatatattatcagtgaaacagaaaagtcaatcgatgaaacagatctgagtataaatgagaatttaacatatggttaagttagctctttaaatttattggggaataatggactattatatgaatggtgctaggatttggagacaca

SEQ ID NO: 134448 - DNA, 481 bp, Homo sapiens
caccgtctaaaattgattcattacttagctgactttgcttatcacagtagaggcggcctggctggcatgttatacttcgttgggttttgagaggccctgaaacattccacaacatgaagacaagcttgttcggttcctttgtagtagagtggggaagggggctggtggtaaaggggctctctgcccattagtggggaaggggactgcaacaattcagtttacttctttgagcatttgttgagcatctgctatgtgccaaacactgctataagccaagcagaatgaaatatgacatagtccccctatgaaactgcagtccaggttcccacacaagggtagagcattgtatggacaagtacaattgtgtatcctccctgttccaggaagaaataaatggcatgctgttctcttaatggccttttatactgttcgctagaggccatccctcagtttggggcatttcagctgatgacaaggacag

SEQ ID NO: 134449 - DNA, 883 bp, Homo sapiens
gtgcagggctgagactaacaagacatgattgaatgggggtggacgaacacccagcacctcagaagagacctaaacagatactgcccagagctgcccgtggaccttgtgagggcaccagggctgcctggccgtgtgtgtgaaggggcctagaggtttggttgacatctaggacaaggtgaggacaggacgctggtgcctccttactctcaccgcatgaacagaagcagggagcccagccgagggaggtggaggcttctggagctgatcctgctctgaacgcatcggcactggtgcttggctccaggcgacacgttgtaagagggaccttgacagcaagcatgacccgggcagctgtacccaagggcaggagggacttgacaccacagcgaaggaagagcaggtagaggacgtggtgctgtttagcttggataagcagagtgataacagaccaggagatgtcagaagggtctttatggggtactggcctcgtccctagtggctccagagagcaaggtggcacccatgaacagaagcacaaggaaccagacttggctttgtaatagaagaagaaatttctagtaatcagagctgttcaagaagggaatcagggccaggtacggtggctgggtgtaatcccagcactttggtagtcgtgggcgggtggatcgcttgagctgaggagttcaagaccagcctgggcaacgtggtgaaaccccatctctaccaaaaatacaaaacaattagctgggcgtcgtggcatgcgcctatggtcccagctacttgggaggctgagacacgagaattgcttgagccctagaggcagaggttgcagtgagccgagatcgtgccactgcactccagcctgggtgacagagctagctag

SEQ ID NO: 134450 - DNA, 240 bp, Homo sapiens
ctggtgggggatattgatcatgggagaggctatgcgcgtgtggggatagggacaaggggtatgtgggaaatctctgtaccttcctctcaattttgctttagataattttgcttttgggtactggttcttgggttttaagtaaatatttatatttgtattgactttgccacagtaggtacagcaaatttgctctaaaactgctctaagaaaataaagtcttaaaaaaaagctggtgaggag

SEQ ID NO: 134451 - DNA, 650 bp, Homo sapiens
gttacgtgacttgtgtctaaagctatcagtcagctggagctgtgaaaatcagtttgcatgtgtcaacaatttaatcttctaatatgcttgccaatagaaaactgacactagaattatttttctgtatttactgactagaaagatatggttatcaagtgcactgattgaaaaatctttaaattccagtctttaaatcgggaccatatgtgtgttctttccctagccaaatctatttgtgcattcacccacacatgtgtatacatatacacacacagtacagttacattgatatgtgtttgcgttatatatgtatgtattcacacagagcatgcatatgcctcatgcatattcatgagctttaaatgtgcttatagattaagatataaggatgttggggaagtttccctatctgttaactgagaataatactactgcctaccttccaagcaccttgtaagaattaaattagttaatataagtaaagttcttagaacaaggcctggaacatagtatgtttcctataaatattagcttttattattttagagtatgtcttcattctgtcagcttcaaatgggcttcaaaatttagcttcagaggcagtatggcaaagcctcagaattattgcataattcatttgatgaatttac

SEQ ID NO: 134452 - DNA, 747 bp, Homo sapiens
catatggccttccctagtggtaatctttgagagattaccactatcccaaattttatattaattaatgatttcctttgtagtttcagtacatatttgtatgtctgaatcatattctttagttttaccggtttgcaaaattttgtttaaatgaaatgatatcatatgtattcttctcacttgtttttttcccttcaacattatgttttggagataaacccatgttgtgtgaagctatagttcattagtttccagtgttctacaggatttcattgtacaagtgatcaatactttatttatatgttaccattaatgagcgtttgggctgtttacatttggggtctgctgtgtacatgcttgcaaatatctcctggagaacatatgcaaaagtatataactagaagtagaattactaggttggagggtatatgtgtgtttaggtttaacctgtaatgctctagtgttgtctaaaatagcaacaccagtgtacactctgacatctaaaggggtttctctgctccagtccttatcagtgcttggcattgtcaaagttaattttcaccaatctagtgggtatgaaatggtatctcctggttttaattttcatttccctgataatgtggaatgctcatctttttatatgtttattgccatttatgtttcatctggtgcctctttttgcctttagtgagtcccagttgtctctacaccatctaatcattgggtctttatttccccactgatctgcca

SEQ ID NO: 134453 - DNA, 515 bp, Homo sapiens
gaccagaggctgtctcagaactccagtgagcttcagttttcactgacaggaaagaaactagatccattctctgaagtcagtgcgcctcacttttctcagtgcacttggactcttctctacgtgttctcaccccagtgtcttgtaggttctttcaggacccagcagttctacttggcacctgttaataaaagtgcttcctccagaccctcacagaaggcaaacttgtaccaccacgaatccatcttcaggttgtattggaggcctacttctcagcattaagccccagtcaactaaaatatctgtttttcaccaatagttttgttttgtttcgtttcgttttgtttttgaaatggagtctcactctgttgcccaggctggagtgcagtggtgctatctcagctgactgcaacctctgcctcccaggttcaagcgattctcgtgcctcagcctcctgagtggctgggattacaagtgcccgccaccacgcccggctaatttttttttgtatttttagt

SEQ ID NO: 134454 - DNA, 424 bp, Homo sapiens
gaaatgaagcactacatgctgagcactgtacaaagtaaactatggatgttaatagagtgacagaaagacaatgaatgagaaacatgaaaccagccactggaggaacagtaaatactacaggcaatttagaattaccttcttgaggccgggcgtggtggctcacgcctgtaatcccagcactttgggaggccaaggtgggcggatcatgaggtcaggagatcgagaccatcctggctaacacagtgaaaccccgtctctactaaaaatacaaaaaaattagccgggcgtgatggtgggtgcctgtagtcccagctactcgggaggctgagggaggagaatggcgtgaacccgggaggcggagcttgcagtgagccaagattgtgccactgcactccagcctgggcgacagccagactctgtctca

SEQ ID NO: 134455 - DNA, 647 bp, Homo sapiens
ctatctttcacgacgtgacattggcattttgaataatccaggccagttgttttactttaggtcatcaaatatttacaaatacttactctgtgcccgattctatactagactctagggagacagaggtgagacagactccatccctgtgctcaaagagctgagacaggtagagatatgtgaacatgtatgtggtgaaagcagagcacagaggtactctggcccagcaaagcatgatgagcaaggagtatggtaaaagaagaagtcaagggaggattcctgggggaggcaatgtcagagcagagtctcttcttcagaactatgcatgtggctggatcaaataagaggctggtgaaaactaaaagaggcccagccaggcacagtggctcatgcctgtaatcccagcactttgggaggccaaaagtggatcacctgaggtcgggagttcgagaccagcctggctaacatggtgaaaccctgtctctactaataatacaaaaattagctgggcgtggtggtgcatgcttgtaatcccagctacttgggaggctgaggcaggagaatcgcttgaacctgggaggcggaggttgcagtgagctgagatcgcaccattgcactccagcctggatgacagagcgaaactccatctc

SEQ ID NO: 134456 - DNA, 595 bp, Homo sapiens
tgtggtggtgggtgcctgtagtcccagctactcgggaggctgaggcagaagaatggcgtgaacccaggaggcggagcttgcagtgagccgagattgcaccactgcattccagcattccagcctgggtgacagagcgagactctgtctcaaaaaaaaaataataataataataataattttacaacacctataggctattgatctgagttaataattaaagaaatataaaagaacatggtgctgaagtataatatttcatctactgaatcacaaatcttgaaaagaaaggccaatatccaatacaggtgaaattaatacaactgtaactattttgtggcatgataaatttattacaaaccatttagaacagtttgaatatatttggatataaatataaaaggtttgcatataaatataaaaaacatctaagaagtgttgttattttattcagcaatcttcctagaattaggaaaaaactgaaaagaaaaagaatattaaaaaatagtccctacaataattattataagcagcctacttaataaaaagggtaacggattaataagtaaattatattacatcaactccacatattatg

SEQ ID NO: 134457 - DNA, 444 bp, Homo sapiens
ttacacttttgtgttccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaattaacaataaattttccagaagaaatgaaatccaactagacaaataaagtagagcttatgaaatggttcaataaagaaggaaaattgcatagtcatgagaccagttgtttaggtgcctgaaagagccagtgttaaaatggcatgagattcgtgctagggatgatggtgctttcattgtctttgctttacacatagtagacactcaatag

SEQ ID NO: 134458 - DNA, 577 bp, Homo sapiens
gtgactagaggacccctctgcttcttttcacaactgaattttgcattctctgtctgcatgtgttgcatatttttaaaagacatgtatgagggttgcccttgcaggatggaatgcagtggaattagctagctaattctgccacagtcgttatgtgaattgggcaatgacaacctctttgagcctcagcttcttcatctgtaacgtgataatccttacctcactggggagtgatggagacaaaatgaaatggcatatatagaattgcctagcaaaccatgtctacatattagagatagtcaataaatggcaatttacctcttctttccttaagtcattccctccctctctttccgcctcccatttttttttcagaagctattataaaagccaaggtctcagcacctaaaggcattataaggttctgaggatagggagatgcactttctattgtgaaacactctcagcatccctgggcaagggacaatgtgtgagcaaattggatctatttcttaggaactgaagagggagcagcaggggtacgcgctccaaacgcaacctgggcctaacggttccggta

SEQ ID NO: 134459 - DNA, 473 bp, Homo sapiens
tgccattctgatccaatagacaaataaagtgcttgagaaatcagacttttatcattggccccaaaatgggcctatttcagcttgtcagaagttgtgtgaaagtcagattttgaatttggatttcctcttttggcctgtttttatcagactacagaggcagtgccaaatatgaactgatacggagcccagagcaacatgcatccctgctttcctccttgacgggtgtccaggaacctcctgtgtcctcagtttgcctgcatagaagcctggggaaagggtggtgatgtctgctctgaaggggtgagcagaacagccagagatatacaggtgcaactctatccaccagatgaggggatggcagccccaggacatacgcggaatggtgccgggccaggaaccagtcaggtccacacaggagcatgcataactgtgacattcaaaatgacagccacaatctaacagttaatgctgat

SEQ ID NO: 134460 - DNA, 284 bp, Homo sapiens
caaagtcatcctctttttggtgtaagaacttggggatctaatcatcatttgttcctgaggacctagaattattttctaagaaaggccttattttgcttgcagaaaatctgttagcttcttcttggcaaagataagatggccctctagttagatgaaagccaaaatgatacatccttaccatctgttcatttgatttgtagagaatatggattccgagtatctgtgccagagaatatatccctgaactctctattgtctaactcacatctactgtggaaaatgtg

SEQ ID NO: 134461 - DNA, 648 bp, Homo sapiens
aggtgattccagtatgcacactaccagagactacgtgctttcagttgccaggctcagccatggggagccatgggaagttttagaacaggagaggagcccagtttagagtttaaggaaaatcattctgtaggaggaacagaatgtaatcttgtgtgaaaagggtccggaagccccaagggcagtggcaggatcctgctagggtgatggtgatcagccatcccagtttgctcaagactggggtgtctcctgggacatggaacctgcagtgctaaaaccaagaaagtcctgggcaaacagggatgcttggtcatgctagattctcctgatgtagttctgttttcccagatttttggggagactgatgccacagacttcgcattctagaaattcctaagaaaaggctgtccatctccctgtggtgcattcacctgagtctctgagccctggcaggcgccatctcttctccacccagcagagtgatcctggcctatggaatataatttagcagtaaaaaggaacaaactactgattcacacaataatccggatgaccctcaagaatattagcctgagtaaaagaaaacagatgcaaaagagttacatactgcttaattctatttacatgaagttccagaacaggttcacccaa

SEQ ID NO: 134462 - DNA, 313 bp, Homo sapiens
  misc_feature (5)..(5): n is a, c, g, or t
ctgancctccagactgcttcagactccgatgtcacctacaatctctgtgcacacctcctcctcctccatactagtctcgtaaattctccctgcttaaatacttcttttcattccctcttccctaatcctactgcagtacttcctctcttaaggagccgggaccttgcgtgatgcaacatgacactgtgtggacagttgttttaatagtaccgggggttaggggctgtggcctttctgaggcacagtcgtaggaatgttgataataaaagcgatgataaaggtgttacagctgtaagcaggcacgtcctgggca

SEQ ID NO: 134463 - DNA, 831 bp, Homo sapiens
ggggaaaattgcatgaaccaggaaaggtttattgccactgttattacatgcaaatcaatttgtgttctgctcatttataaccctggagttcagtgcgatagcagtttaaggaaatgagtttgtattgcatcaaaaaatggtaatactaattagttacactgggtattaagtgtgctgtatgacagagctttttaattctgtgattgatagattcatgagtgtcttgcattggtgattggtacagaaaacttttcatacatgtcagccaaaatttttatttggacagcattaactcctggagaccaagcacttcttaaaataaaatacaggcttcggtttcgcctttaaaatgatttgataatattattttcaatatcacaatccagggtcatttaaaacttgtttttaggttgggatcctgaatatttatgaatcatatgatgttgggaaaagtggcaagttgacttatgagtgctattgtctttttacacactcaaataagaacacaaggtgttacacctctttttagagctcctactgctaatccttgtaattttaagtactgtaagctaaaaactcagaggcctgctaggatctctttcaaattgtggcctttaatttaaatcatgccctttaacatttgcgagatttcatctgtcttggatttcattctagtattctaaatttcttcaattctaaatagaagaaccacaagagaactgagtaaatatgcttgaaatgtattgggcttacactgaatatatgatttgttgatatttgtgaccattgtggtctatatccattatacagccagggaagacaaattgatcc

SEQ ID NO: 134464 - DNA, 316 bp, Homo sapiens
ctccgagctggtgtcacttgtaatcactggcttttcagggaacccattttattacggcttcttgagttttcttttgtgaagccacagccagtccttcttggctgactccaagtgtggtcaggaagcagtggtaacccatgtctgtctattgcaagtctacactgccacacaaagcctgaggtacagctgctgctgcgggtctgttgatctgaactgctgatttgaagtggattgagaggatggaacaatagaaggaggatatggctcaggacagtcaagtactggaagaggaaaggtacaaagaggtgttggcact

SEQ ID NO: 134465 - DNA, 326 bp, Homo sapiens
acagtgataagtcagcatccatcaacactgagacaagacccttcaccagcaaaaggatgaagacctgctagaggatcagataatagcattttcatcaataaactatttttaaatttaagtatgtacatgttttagacataatgcaattgtacacaatatgctatggtatagtataaacataacttttatacgtactgggtaacaaaattgtgtgactcactttatattatattcactttattgcagtctggaagcaaacttgaaatatctctgaggtatgcctgtatttatttatttggaaagagttacaatacaaagggggagct

SEQ ID NO: 134466 - DNA, 191 bp, Homo sapiens
ctcaggtgttgctattggtttttggatccacactttgcagagcaagggtttagagctgatgaagcctctgcccagctgccagctcacacattcctgtgaaagagccagggggtgggtctgaggagccccattttacagatgagatgactgaagtaggggtggggaagctcgcttgctggacattgagcatt

SEQ ID NO: 134467 - DNA, 310 bp, Homo sapiens
agcaaatgcaaaactgctcagtagggattcttctggatcccatggtatacagtattctcacagaaaaaagcaacccccttgaagatgagccctcaataaaaatgaaaaacccggccgggcacagtggcttatgtctgtaatcccagcactttgggaggccaaggtgggcagatcatgaggtcaggagctcgagaccagcctgaccaatatggtgaaaccttgtctctgctaaaagtacaaaaattagccaggcatggtggcgcacacctgtaatcccagctactcaggaggctgagcaggagaatcgctt

SEQ ID NO: 134468 - DNA, 335 bp, Homo sapiens
gaaaaataccttgagaatagatactatttaagtgtgctggtgctttcctattattgttagtagtaataataatctcaataaataagtgagttgtatcttttgaagtttctagagggttggaaataaatttcaaggtgccagtgttcatagctctcctttctggtcgttgaaaggaaacaagagcattcataggcttcttttggacctcttgctaggagatgtgtgcgtcatacccagttagtatatgggaaatttaatgaatttgggaatttaaagccatacccaggttttcagtctgccttcctcctcagctcagccgtctcagcactctaccc

SEQ ID NO: 134469 - DNA, 404 bp, Homo sapiens
attagaaaagctgatgtgtcacgacaggttattaaaaagatcaagtaatacacatcccatctccatttgctctttacctttgtggcatcaagagtgattgcttgggtcgggcgcggtggctcacgcctataatcccagcaatttgggaagccgaggtgggcggatcacttgaggtcaggagttcgaggccagcccagccaacatggtgaaaacccttctctgctaaaaatacaaaaattagctgggcatggtggcatgcacctgtaatcccagctactcaggaggctgaggcaggagaatcgcttgaacctgggaggcggaggttgcagtgagctgagatcatgccattgcactccagcctgggcaacagagcgagactccgtctccgtctcaaaaaaaaaaaa

SEQ ID NO: 134470 - DNA, 775 bp, Homo sapiens
ggggcccatcttttagaagcggttccctcttggggaagacctctggagaatcccctctctccttgcctaccaagtgctgtgggtgccaccatccacactgccatggaactcacagaggcagggaagctgctcaggagcttctaggtgaagtttgtgtggagtttggttcacagtagagagtgggttgtgtgtgagtccagggtggtagtaatggtggccctgagagtgtgtaatgcatcctccaccatcatccccaccccaacatctctctagttcttccctctgggccacctcctgcttaagtaacaagcttccttcagcccctgtcaaatgaattaaagaatagctttagaggaattatacaacgtcataaatgaagattagtgggttttttttttttttggtgggggggagttgaatagagtctttattaatgttaatttcacctgcttctttattttaaaattccagggtacatgtgtaggatatacaggtttgttacataggtaaacgtgtgccatggtggtttgtgaagattcgagttttagaatttgggtttctctcttattgttgggactatttaattgcttattagacacccatgaggtgttggcagcatatggaagatgtagggaggtttcctgatcagtggacttatattcttatcaaaaatgacagaacagctgggcgcagtgcctcatgcatgtaaccccagcactttgggaggctgaggcaggcagataacctgaggtcaggagttcaagaccagcctggc

SEQ ID NO: 134471 - DNA, 474 bp, Homo sapiens
cctcagcgcgaccctggagctgggggtgtttttaagtttggggcgaggccggtgaagccgaggcgcgggcggcaaggagcgctggagagcgacggggctcggcctccgcggctgcccaggggcccggggcattccgagaagagaaaaaaagcttgtacttaaatacttcctgcgaagttttgactgagacgctgcaacaattcccgagctgtttcatcgtggcaccttcctggtggcaggtggattagcacattgtctgcaacccaggaggacttggaggaaagtcccagctctgctgattctagctgagtaaccttggcaaaggtcacctcacttctctctgagtcttattttctcatctgtaaaatgaggaggaggaggaggatcatccaaacatcacgggacttcgttaaatcagtgcttcggggcacttagcacagcgcctggcgcaaggtaagcacttgataaatggga

SEQ ID NO: 134472 - DNA, 321 bp, Homo sapiens
aatacttaagtaaaaattaattttattaaaaaagtcacagaagttttgccttaaagatggatcctacaatattacaaaagaacacttgtgttactaaactttgtaattgctccttttcagtatttctttttcaagaaagatcaaggtgagctgagtgaattctggcagtccatgaagtaaagaggggtagaaaggtatgtaggtgaaatggctgaagtagcaggtagggcccagaaaacactgggtttcacagacactattaaaaacaacaaaatttattatattctgtctctgggcataaataatcacacctcaaaagga

SEQ ID NO: 134473 - DNA, 670 bp, Homo sapiens
cgttatccccacttcacagatgaggaaataggttccgaaaagaaacttactgaaggacacacagagggtcgagtcagagatccgctccaagccctatcttactctagtggccaccttctttttacttcacatcccatcataaaatataaaactaaacgaagtgttgatggttgtttaatgcgagcaatgcaggctgccaagtagaacaattaagactctgaaatagctattttgctttgactacttggcttatttaacaatctacagttactagctagatggataattgtacagcctctcaattactttaggttatgtggacataagcctggcgccgtttgattctgactctaatgatatttaatttcatattcctaatagctccttgtctagtgagtatcctagaggatagagaaaggtacactttgaggataacctcagttgcatgtactcaagcggtcttcaggtagcatgcatgccctccctttaaagaaacttagttcaggaaagttaggctgacaaataaatatactaggacatcatggtttcattacagaatgactctctcttttaaggggattcaccaccatttttgtctccttagcaagacccactagcatatttaaaatattattttaatatatgaatataaattatacctctttttaga

SEQ ID NO: 134474 - DNA, 223 bp, Homo sapiens
atgtcatatagttcgaattatacagtatatagccttttaaggttggcttcttttactaagcaaatatccttttaaatacatagctgagcttgcaagaaaacaagggaaatgacatccccagaagtcaaaaatgtagaggaactggaaaatcagcactaagcagggagtgatactctggttgctctgttgtatgtgtctgcatatgcatgcatgtatgcacata

SEQ ID NO: 134475 - DNA, 163 bp, Homo sapiens
cgagatcgcgccactgcactccagcccgggcaacagagcgagactccgtctcaaaaaaataaaaaaaataaagaacattggacaacatcgatcagcacgatctgactgatgcctacagaaccctccacccaaccacagaggaactcatgttcttctttttttg

SEQ ID NO: 134476 - DNA, 758 bp, Homo sapiens
acccattatgtcccccacttttggtatatgtgggctactgtaaggggacttggagagaaaggtcatcagcaatgttgttattatccttatgatacaggatcatgtcaatcaatcaagagaatctaagtaactgatccaaaattaaatttgaattacctagaccatcttttcactaggctgccaccaagagagttaagaaccaggctttctaaacccttcattctaaatcaagggaatgaaagaagaatcatgcctaggaatggtcaaggcagaatcctaaatggtctatatagttcccccacctttcatcttgattattatccaggaagcagccaaagggaatgctctctttcagagacagccaaatccagtgaccaaactgccttactaaggaagaggtgagaagagtagagctggaaattttcctatgttgatttttgaggagatcctttcaatgctcaaactgaccaggtgcctgtgggtgttacagagcacgggagcccattgaataccttgaccagcagctctgtaacatcagaaagctgaaaacatgacacagattaggatcaagaaccatggtagtgtggccagagttggctgattggactggaagagcaacactgtgacctgaaaaggcactgacagcagtgaggcagcactttagcccagaacagttagtaaaagtttcaacttagtcatttttccaggaatgaataaaagcaatgcctcatgtgttgtggcctccttcactactaaaa

SEQ ID NO: 134477 - DNA, 290 bp, Homo sapiens
agctgggactacaggcaagcgccaccacacccagctaatttttgtattttttgtagagatggagtttcaccatgttagccaggctgttctcaatttcttgacctcatgatccgccggcctcggcctcccaaagtgctgggattacaggcgtgagccaccttgcccggcctcaggtcaagttattcttagtgcgctcactcggagactattgaaattctgctgaggatttaactgccatatagttaatatagttaagcaagactaggaaacctgttgagcacaatgcttct

SEQ ID NO: 134478 - DNA, 879 bp, Homo sapiens
gtggatacattaaggttgaggagtctatattagagatgcacatggagatgcagagtagtccattgaataaccaagagtccaggtgagacctcaaggctggagatagagattccatactcaactttcctatatgtttgaagagtttcatgatacactgtagtgggtagagggaagaattgtattttgttattaataacagtcctgaatatcattggctttgacaaaatgaggacttcttttcatgtcaataaatatggatggtggccatcaagggctgatctgagagcttgaaatgtcatacatgccccagcttagttctgtctttattttcttctgtcttagcatgtggcttgcatcttcaatgttgcctcatggtcacaaaagggctgcccagctccaaagtccatattcttagggtggtgagtgggtgctgatggcagcctggtttgaaaatctccactggagagaagacacagcaggattcagatgcaaatgaccagagcactccaagttggaaagaactgctgagcgggtctgtagagcccatcgctctctcctgtctattcatcagctaggctgaagctcctgacagactcacaccagtatcttgctgctccagaaaggtcgaagatggcagttttcccaaactccggcttgcccagatgtctgctcaccctcattcttctccagctgcccaagctggtttcagataggtctctctctctggcctgcagagttaaaacatctcaataaatataaagtataaaaagaagctggagcccaaccacttcggcacatgttcacaggatctcggggctgtgtcacaagccactgggcactcatatctggctgagaataaatctcttgcaatattttaca

SEQ ID NO: 134479 - DNA, 689 bp, Homo sapiens
taaggcatgggagtatacttttgtaacaaatagctgagtctcagccaatcccagtagccgaacttcagtcggcggcagtcaaccctgcagccaagtgatcagactatgttcaaataaggccaactctgagctgtaaccaattaagctgtttctgtgtgtcacttcccttgtggaatggagctcactgaacctctctgatggctgcccgatcgttctgatgcttagggtggtgagtgggtgctgatggcagcctggtttgaaaatctccactggagagaagacacagcaggattcagatgcaaatgaccagagcactccaagttggaaagaactgctgagcgggtctgtagagcccatcgctctctcctgtctattcatcagctaggctgaagctcctgacagactcacaccagtatcttgctgctccagaaaggtcgaagatggcagttttcccaaactccggcttgcccagatgtctgctcaccctcattcttctccagctgcccaagctggtttcagataggtctctctctctggcctgcagagttaaaacatctcaataaatataaagtataaaaagaagctggagcccaaccacttcggcacatgttcacaggatctcggggctgtgtcacaagccactgggcactcatatctggctgagaataaatctcttgcaatattttaca

SEQ ID NO: 134480 - DNA, 275 bp, Homo sapiens
taaggcatgggagtatacttttgtaacaaatagctgagtctcagccaatcccagtagccgaacttcagtcggcggcagtcaaccctgcagccaagtgatcagactatgttcaaataaggccaactctgagctgtaaccaattaagctgtttctgtgtgtcacttcccttgtggaatggagctcactgaacctctctgatggctgcccgatcgttctgatggtttgcaaattgttctttgttcaaattaaaccctgctaaatttaatttgtctaaa

SEQ ID NO: 134481 - DNA, 341 bp, Homo sapiens
ggcaaatccagaatctgcagcgtgggccagcaggctgaagacgcaggagagctaatggtgcagaagctgatgtcagtttcacaaggttgacatgcgacaatcacagaaggtccacgtcagaagaggcttcatcaatccccagtcaatcccaggctctcactggacccaggacaaagaggagaccaaaggaagggctgctccagcagcaccaccagcacccacatgggaatgggggcatccgtccaccacccagcagagatggagggacttgctgcagggcttctgcatcagaggggaccctcatggctctgttgttaccatggtaacaaaggggccacaga

SEQ ID NO: 134482 - DNA, 305 bp, Homo sapiens
cagtaagagaagaagtaacgaacaaaagatatacaactagaaaacaatcaataaaatgacaggaatgagtacttacctatcaataaccctgaatgtaaataaataacattccctattaaaagatatagactggctgaataaaaagaaaaatatgacccaactatatgtggactacgagaaactcatctcaccaataaagacacacatagtcttaaagtgaagggatggaaaaatatattcatgcaaatggaaaccaaaagcaagcaggagtagctatacttacatcagataaaacagacatcaag

SEQ ID NO: 134483 - DNA, 257 bp, Homo sapiens
gggagagagtggaagggcctgttcccagcccatcaaagtggggcgcccttctcatatctacttctcagggaaaacctgcttttctgtcttcattagaaagcaccagggctactgacacaactctacaactctagggaggaaaggatttaaaagtgagtgaactcaataattagataactgcacattaaaccatagtgaggtattctttttcacctttctggttgaattgacaaagatcaaaggctcagaaaatgtgt

SEQ ID NO: 134484 - DNA, 399 bp, Homo sapiens
ccagaggaaaagatagagtacctgtgggatgttctgggagatggtgtcattaaagtttttaccgctgggagcctctcccttcccatctgctgctctttctactatgccgccttgtgttgtgctgacccatccaaagtgcttcataaatttgtgggacgccaaatacaaagcattgtcctcccttctgtggacatattttccttgattgtggggtgcccttgtaagatgctcaacaaaacctggcaagttttgtagtaggcattggcttggaagaaagatggacagccagatgtgttaagggtaggaagagtttgcttatttttggttttgtttagatgaatgtgatcattaaatttataaaaatgtaccagcagtgaccctggtaaccctgtggaaaag

SEQ ID NO: 134485 - DNA, 155 bp, Homo sapiens
gtgctctgcttgtgcacggactctgggactctcaccctgcggagcgtttccctgggggtctgcccacttcctgggaggggcgccaggcctgggtggagcgctctgcggcagagcccagcaccttatacctatgtatgggatagaggtaaaatctt

SEQ ID NO: 134486 - DNA, 381 bp, Homo sapiens
tccagattgaaggacatccaaaaatgcctccccctggaagatattgttgggtccagaaaatatccaggtgaccagagagacacagtgtttggaggtgagggtggattgagggtcagctggtgagtatgtatgttacctacacatctggagattgagttgcctcctgggtccacccacatccatctgccctcttccaattccttcccctcactagacttaaatgatcttttcaagaggcatatctggtcatgtgtttcctttgcttaaatgcttctagaggtttcaactgtttttttaaggtcaaggcagatgtccagaacgtggacccctccatctcgccagactcttgtcatgccatgccttctgggttgcagccagagt

SEQ ID NO: 134487 - DNA, 127 bp, Homo sapiens
cctttgtataccaacttttaaaatttattttttttcttttgtattatctcttctatatgaactttagagtcagcttatggattctgttaagcattttttaattttattggggtttctgtttggattg

SEQ ID NO: 134488 - DNA, 610 bp, Homo sapiens
cagggtttcaccatgttggctgggctgctcttgaactcctgacctcgtgattcgcctacctcggcctcccagaatgctgggattacagacgtgagccaccacgcctggccaatttttgcatttttaatggagatagggtttcaccttgttggccaggctggtcttgaactcctcaagtgatccacctgccttggcctcccaaaataataggattacagcatgagccactgctcctggtctaatttttaaaatcccttcttaaattcacaagtcattcaaacgtgtggattaaacattatctattctgctgatttaacattttaatataaaaaacaggaagctattaatttgtaatgtaatgaaagctatgatgttttgatggagaaagtactatggacacaaaatggaaaaaagcattaaatctcttttcaggggtttagattaaggaaatctccaaattggttttcttttgagctggactttaaaaataggagtagatatatatataggaagcaagcagtagtaaaggcatcagtaactcttggatttgcatgaataattcattctaacaagatcttcagtttaagggaaagggagaagcagggaaaaa

SEQ ID NO: 134489 - DNA, 763 bp, Homo sapiens
cacctgcgtgtgctcacagagcatatggatttttccctgcggtgccttcacttgtggctggaagagccttctctgtgatcctgtgtcctgggtgctctgttggcctccttcttgccaccgaggaagacacggaggctagagagggctcactgaacagtgaaatgattggaacctaaggagcttcagcagaaggtgtcatgatggggctaggctctcccgagggctgtgtggcctcagcgtcttgttgggcagatcctgctccctgacacagcggggctaagagccagcctgtgtcacacacctgtgaattaacatgcctggctgaccctcactggagaagggctacacgtttgtgacgaaagcagaagaggtgtttattgtagaccaaatccaagctgtcattttacttttattagaaattatttgggatttggctcatgcctataatcccagcactttgggaggctgaggtgggagaatcacctgagctcagtcgtttgagactgccttggcaacatggtgagacctcatcttctactcaaatttaaaaaattagccgggcgcagtggcgtgcacctgtactcccagctactcaggaggctcagttgggaggatcacttgagcccaggaggtggaggctgcagtgagcccagatatgctcatgaagcactgtgggtttctcctgcagtgcaccaccgcactccagcctgggtgacggagagagaccccatctcaacaaaaataaaaaagaaaagaaaatggg

SEQ ID NO: 134490 - DNA, 396 bp, Homo sapiens
ttaggcagattaaacgagtcctggccaggtgcgtggctcatgcctgtaattccaccacatgcatgctcttctggagcagaatccctgcctgcctcgtcgcctcaggaagtggcctacaccacccctgtccatctgacccatcttatgggtcagatggactcctgatagggagacttggtgaatacagtctccttccagaggtcgggggtcaggtagctgtaggtcttagaaatggcatcaaaggtggccttggcgaagttgcccagggtggcagtgcagccccgggctgaggtgtagcagtcatcgataccagccatcatgagcagcttcttaggcacaggtgcggagacgatgccagtgcccctgggtgcagggatgaggcgtaccagcacagag

SEQ ID NO: 134491 - DNA, 222 bp, Homo sapiens
aaaagtacacttactgtccaggtcttggtttctaagatcactttccaataaaaggaaccaaggtttcttggagtattggttggttctaggactagaaccaggaaatatacaagagaggaaatatacaagatgagtctggagcatcttatagtgccaaaatgtaaaaagtgcttaaaatcaaacaaaattcttgatatgaatttgccaaaaattaaataaaac

SEQ ID NO: 134492 - DNA, 792 bp, Homo sapiens
agcgagactccatcttaaaacaaacaaacaaacaaaaaaactgggaagaacacaactatgctgtttatcgtgtgtggatttgtcattctggctttgtgcaacagaaaaaccaatattgtacaaataagatgtttattttcctcttgtaatgaaaggtccagagatggggcatgctgggctggtgcagttgtgccaggatattaacaagtattcacctcctttcctctgtctgttcagtggtttttgtacatgtggtcccaaatgattgttatgcctccaggtatttctttcacattctagtcaggaagaaggggaagaggcaaaggctgaaaggcaaaagagactgtgccaaccaaatggtaagcaaatgccttctatggattagaggaacacaagggaaaacaggttgtgaatggctctggggaagccagtcagtaatagtctctgccacagtgtggaacaaagggttcaatgaaaggtgggaaagaaatctttgagttaatgttaagcagttaaaacccacattcttaatgataagtacaatttatgaactataactgtctcccacactgtgtaaagacttttcataatcaaccaaaacacattttgttgactttcatgtccatgtaagtataaagacttaacatttaggataattttttttaagcaaagccttataatgctgatgttgtccttatctttttagataagtgataggaaaacaccacagagaaatttggtatttataatagtgaagagaacagagtcatattagattttacctttgctcta

SEQ ID NO: 134493 - DNA, 235 bp, Homo sapiens
ggatgctctgagcctcagtttccatatttacaatctaccctctgtgacagacttgtgaatgtagctgagctatcatgaatataaatatgttttttaagtacaatcattcttctgatgtaattaacctgaagctggatgtgagcaccttcctatgatgttggaaagcaaagtccctgtattggatgtaaaaggcaagaagatgaaacagaaaggcctgttcacggtgagagggaga

SEQ ID NO: 134494 - DNA, 242 bp, Homo sapiens
tgtgcagatgcaagaggcactgaagaggcagtacaggcaggacctaggttgaccggctgtagagggtgacctggaagagaccagggtgacgtctccctgggggatggttgtactgcagcccacacaccgagaggggatgcgggatcaatcacaaacggtgagactgaagtggccgttggtcccatgggtctggagtttaggagggagacctggagggaagataccaggtcagagcaggtaga

SEQ ID NO: 134495 - DNA, 305 bp, Homo sapiens
ctaccattgaattatttcgtcatgttctatttaattattgctttaattggcattggtgaccacaaataataataaatactattaactggtgtaacagcttcactagtctatttcactgccccatgctgttgtaactgaagcccccagcacaagcattcccagctcgtggtcatctaagacctttgaggtcattcttacatgcattgctagtgttttccatattccttgatggtagccaatttttccttcttaaaataactttcttcattcctagtaagcttcatatgtattttatgtattcttcc

SEQ ID NO: 134496 - DNA, 637 bp, Homo sapiens
gaacattctctacttaataagaaaaacaaagatgactcaacatacaatgtcagaccatcagaagatataaatttagatataaaatataaggaaagaagtacctgcatgaaagaaacacaaaaaccttattatggtgaagttataaaaaaatcattcagtacatttaggtcattaaacattggagccctggaagagctgcctgaagtgaataaacctgctttccttctagaccctgagaaatactttaggaaagaaccagaggaagagcgtccccaaattctggaggccccgtcactttttaaaactttgaaagctgtatttgatgagaaaaacctgtttcccaaggaaattctgcatcatgaacgaaaagccaagcaattatgccaagaaaaaagttgtgaagtgaagaaaaataagaagtaattacaacagaaaaaccttcactgttacataaggtacagatataaaatgcagaaaaagcatcaagaattctgccttttattttattttatatttaaacttcaggaagttttctcttcatgggataatttagtactgcttttatctatcatctgtcaatttctctgtattcttaataaaataaatattgaatacaaaaacaacaaaacaagcccac

SEQ ID NO: 134497 - DNA, 410 bp, Homo sapiens
gcatgcctgtaatcccagctactcaggaggctgaggctggagagtcgcttgaacccaggaggcagaggttgcagtgagccaagatcacgccatcgcactccagcctgggcaacaagaacgaaacttcaaaaaaaaaaaaaggactatgtaggactccaaaagagatattttcagaaaaaaataaaagtgacaacacgagtgataatgttaactatgcagaaaattgtataaaggagatgttttgtaatatgattaagatgttcaaagaaacaaaaaataaggcagttattcactacagtagaggcagaaagctgtacaaaaaaagaaatgtaatcatggttacaaattagttctccagtgaacaatatttatatagccataataataaaaaccctgaatctgaattcagt

SEQ ID NO: 134498 - DNA, 756 bp, Homo sapiens
taatatgttgtttttgaggttcatccatgttgtagcatggagcaggcttcattcctttttatggctgagcagtatctcattgtatggctagactgtgtttttcccattcttagatgaggaatatgaccatggtttatcctttcgtccattggcggacatttggagcatttctaccctttgggattgtggatagagctgccgtgaacatgggtttcatgtatttgtttgggtacctgctttcagttctttggggtctctacttaggagtggaatttctaagtcatcatgtaactgcatttaatctttccttgctttctttagccaactttgctgacagatacctaagtgtagtgtctaggggctgactgccgggagacggagccaggctgtgtagaggggattggctttggggaacttgctttgaccacagcacgtctgtgttgacctggacccacatttgctccaatccacattcctggggagggtggttctcctgtattgactgttttccttcaggtgcttggatgaagctgaaaagacactaagaccttctgtgcctcagatccctgagtgcccgatttgtgggaaaccgtttcttaccttaaagagcagaaccagtcacttgaagcagtgtgctgtgaagatggaggttggcccccagctcctgcttcaggctgtgcggctgcagacagcacagcctgagggtagcagcagcccacccatgttcaggtaagtcgacgaaaaggaagaaaacca

SEQ ID NO: 134499 - DNA, 623 bp, Homo sapiens
gtgaaccatatatgtttcatcatcatggagatcttggagaattatctgagcaccaggttcatatgtattcgatctcagaggcatctattggacaacaaaacactctttcattctttggggtctctacttaggagtggaatttctaagtcatcatgtaactgcatttaatctttccttgctttctttagccaactttgctgacagatacctaagtgtagtgtctaggggctgactgccgggagacggagccaggctgtgtagaggggattggctttggggaacttgctttgaccacagcacgtctgtgttgacctggacccacatttgctccaatccacattcctggggagggtggttctcctgtattgactgttttccttcaggtgcttggatgaagctgaaaagacactaagaccttctgtgcctcagatccctgagtgcccgatttgtgggaaaccgtttcttaccttaaagagcagaaccagtcacttgaagcagtgtgctgtgaagatggaggttggcccccagctcctgcttcaggctgtgcggctgcagacagcacagcctgagggtagcagcagcccacccatgttcaggtaagtcgacgaaaaggaagaaaacca

SEQ ID NO: 134500 - DNA, 1252 bp, Homo sapiens
gtgaaccatatatgtttcatcatcatggagatcttggagaattatctgagcaccaggttcatatgtattcgatctcagaggcatctattggacaacaaaacactctttcagttgtgaactttatttatttattattattattttttgagacagagttttgctcttgttgcccaggttagagtgcagtggcacgatctcggctcactgcaatctccgcctcccaggttcaagcgattctcttgcctctgcctcccgagtagctgggattacaggcatctgctaccacgcctggccaattttttgtattttcagttgaaacgaggtttcaccatattggccaggctggtctcgaacttctgacctcaggtgatccaccccccgcctcgtcctccaaaagagctgggattacaagtgtgagccaccgcgcccggcccagttgtggactttaacagagggaagctttaaacatgtttaaccacaggcccaatttgaacaaagatacttcaatcattatagagaggaaaacagtactttttgttcaattgtgcaaactctccaagtatctaatggagaagtagagaagaaccctaatgaaactgagtgtgaatgaggctcagctaggcttctacttgggttcactttctcatctgtctgcctgtcctgggattgaccctcgctcctctgaagaccagcctgaaagccttaaaactggtcagatgatggatgagtctgatgaggactttaaagaactctgcgctagctttttccaaagggtgaaaaaacatggaatcaaggaagtgtcaggagaaaggaagacacaaaaggctgcctcaaacggcactcagataagaagcaaattgaaaaggaccaaacaaactgctaccaagaccaaaacccttcaaggccctgcagagaagaaacctccgtctggcagccaggcccctaggactaaaaagcaaagggtaaccaaatggcaagcaagtgaaccggcccactctgtgaatggggaggggggtgtgcttgcctctgctccagatccacctgtgctccgggaaacagcacaaaacacccagacgggtaaccagcaagaaccatcgccaaacctttccagagagaaaaccagagagaatgtgcccaacagcgactcccagcctcctccttcctgtttgacaacagcagtgccaagtccctccaaaccccgcacagcacaattggtcctacagcgaatgcagcagttcaagagagcagaccc

SEQ ID NO: 134501 - DNA, 235 bp, Homo sapiens
aaactagttgataaaggactcttgaaacttgcgtctaacctgtatctggtagaaaagtcttttatttctccagctacaacagatggttgtgaatattttcctccttgccagagaatgtgcccaacagcgactcccagcctcctccttcctgtttgacaacagcagtgccaagtccctccaaaccccgcacagcacaattggtcctacagcgaatgcagcagttcaagagagcaga

SEQ ID NO: 134502 - DNA, 177 bp, Homo sapiens
gtggttatgatatttagtggcaattaacttgaactaatgaattcatattggaattgatactaattttgctacttattaccgttactattatcctgttatatatatctatatataggctgtgttatgtatacctatattctatccatatggagatatttcagtaatttaacaatggta

SEQ ID NO: 134503 - DNA, 316 bp, Homo sapiens
aaaggccagtgaagggctgtgcacatgtccagagctgtgtgcatactcaggagacgtgaaaaggccctaaacaattacctgagattgaccctgaggttctatgcaagtggcaaatgaaggctaagacagagttataaactgccttcctgaacattgaaaatgcaccccagtatacacacagggactcttagctacagcaaaggtctgtgattctggtatttaaggaaatatctgtccaaccattatctgactactaacctaatgaagcagtcacttcagtggccacacatgacaaagagtattactttacagaatt

SEQ ID NO: 134504 - DNA, 634 bp, Homo sapiens
gtcaataacctgactaagataattgatgtgagcttaagcacaaaggaggcatggctgagctccatggagaaggactgaggtatgatttttaaaatgaggcttataactgctgacatttttataagagtcaaactgaccccagtggagctcatcccacactgcatggggtctatctgcttaaacaagcattctgttgagttcctgatttttatatcctgacagagaagaaatagctttgtcctgagaaattccattggtaagaatcaatagttacctgcttcttctatcaaactttaatatgattcatgtataatgttttgatttgagctggtctgcagcctggtaagcctgccaagttgccttcaagatataagctcagataattacatgagttgacctattgaattatttcagcaaatttgaataccgctgaaatttgtatgtggaaaatgaagatttggatcttggcatactcgatattggattgctattgatttcagaaggaacagatcagcaggttcagttatgtcgtgtggtctcagaccattagcagaggaaaggattcctgaattcccatctacttattgttgtcagggtccagtgcagagcatttacgtatgataaaggggaggag

SEQ ID NO: 134505 - DNA, 550 bp, Homo sapiens
aggctgtgttaattatgcctcaaattcatagttccttctgaatatcctgttacctagggactaaattgtaaagttaacctttaataaagtttgaataacatagagaagaagagggaaggaattgatttataaacttgcccgtttccctgtaataaggaagaaaatatgtatagctgctgtagaccttgcttctgtaactggttgagagattgtagttcatatttataactacttctgctgtacattccatgtttcctttgttctcattcaagatctcagctggtggggtaacctaaatcttcattaataaagaatatggctttgggaggctgaggcgggtggatcacgaggtcaggagatcgagaccatcctggctagcacagtgaaaccccgtttctactaaaaatataaaaaattagctgggcgtggtggcgggtacctgtagtcccagctactcaggaggctgaggcaggagaatcgcttcaacccaggaggcagacgtggcagtgagctgagatcacaccactgcactccagcctgggtgacagag

SEQ ID NO: 134506 - DNA, 740 bp, Homo sapiens
cctttgttgaggtggaagtggtggatgtcaatgaaaacctccacactccctatttcccagactttgctgttgttggatctgtaaaggaaaactcacgcattggaacaagcgtgctgcaggtgactgctcgagatgaagactccggaagggatggagagatccagtactccatcagggatggcagtggtcttggaaggttcagtatagacgacgagagtggggtcatcactgccgcagacattcttgatcgggagacaatggggtcatactggctaacagtgtatgccacagacaggggcgttgttccactctactccaccattgaggtctacattgaagttgaagatgtgaatgacaatgccccgctgacctcagaacctatatattatcctgttgtcatggaaaactctccaaaggacgtatctgtcattcagatccaggctgaagatcctgactccagttccaatgaaaaactgacatacaggattacaagtggaaatcctcagaatttttttgccatcaatatcaaaacagggtccttgctctgttgcccaggtggaaatgcaggggcatgatcgtaagtcactgcaatctcgaactcctggattcaagggataaccctggctacaggctcttgaagtagctgggactattggcattgggcccgcatggccaggtaatttttcaaataggttggggaggcctcctattgtttgccaacggggttgatctcctgggcc

SEQ ID NO: 134507 - DNA, 453 bp, Homo sapiens
cggtgactctaaggatccccgcttgcttcctcttcagcccagtgggaacagttcttctgtctaaccttgcggggttgctgttacagtccagagcaagactggatgtggacgtaaggtgggagagttgcagcctgcacccctgaaattcttaaacacccaggcttgttcatgacacaccatcatgcacacactcattgtgtgcatggccagggagagggtgagggagctgggtgacagcggctgcctccctattctgatggactcagtccacaccgatgtggactcacaccctctatgccctgaacgaagaccattagtgcagacgtggatggggccttatggctcacattatcctgagagctgggcagcataacggcgtgcggtatgttcacgagcaaatgggggcctggggagaaggagtgccctcctgaaggccacatggccaagaagcag

SEQ ID NO: 134508 - DNA, 2952 bp, Homo sapiens
ccggggtgctcaaagtacctgtagctgcggcgctgaggtcggaacgtctgcgtgtgtgcgggctggttttgtggcggctgctgctagagctggagcatttgccgggttggtggctcctgcacatttttacagttctccagtccttctctttcgtcagtataaaagattaaactctacagaagaatgcaatcaagtgatggcttttcctttagaatttgaatatggaggctacaggaacagatgaagttgacaagctaaaaaccaaatttatatctgcttggaacaacatgaaatatagttgggtgttgaaaacaaagacgtattttagtagaaattctcctgtattattgcttggaaaatgttaccattttaaatatgaagatgaagataaaacgttacctgcagagtcgggatgtacaatagaggatcacgtaattgcaggaaatgtagaagaatttcgtaaagatttcatttctagaatatggctgacctacagggaagaattccctcaaatagaaggctcagctttgacaacagactgtgggtggggctgcacattgagaactggccagatgctcttggctcaaggactcatactacactttcttggtagagcttggacctggcctgatgctttgaatattgaaaattcagactctgaatcatggacttcccacactgtcaaaaaatttactgcatcatttgaagcatcactttcaggggaaagagaattcaaaaccccaacaatttctctgaaggaaacaattgggaaatattctgatgatcatgaaatgcgaaatgaagtttatcataggaaaatcatctcttggtttggtgattcccccttggctctttttggcttacatcaactaatagaatatggaaagaagtctgggaaaaaagcaggagattggtatggaccagctgtggttgctcacattttaagaaaagcagttgaagaagcaaggcatcctgatttacaaggaataactatttatgttgcacaagattgtacagtttacaattctgatgtaattgataaacagagtgcttccatgacttctgataatgcagatgacaaagctgttattattctagttcctgttagacttggtggagaaagaaccaacaccgactacttagaatttgtgaagggtattttaagcctggaatattgtgtgggtattattggtggcaaacctaaacagtcatattactttgctggatttcaagatgacagtttgatttacatggatcctcattactgccaatcttttgtagatgtcagcataaaggatttccctcttgagacattccactgcccttctcccaaaaagatgtcttttcgaaaaatggatcccagctgtacaataggattttactgtcgaaatgttcaggacttcaaacgagcttctgaagaaatcaccaagatgctgaaattttcttctaaggagaaatatcccttatttacttttgtaaatggtcattccagagactatgattttacatctactacaaccaatgaagaagaccttttttcagaggatgaaaagaaacaattaaaaagatttagcacggaagagtttgtcttgctttaaagattagcacatttgtgcttgataagaagaattccattgaaaggggaaaaatgaagagaaacaagtatatctgaaatgtttattttcacaaatatcttaattttatatgttctttaaaaaagaacatttgaaaatataacagttaaagatatttttctaaaagagaaatgatttaatgaatcttgctttctaataaataaattgagtgattctggttgcattcctatttccctaagatctactagtgataattctaccttaactgtaagccttttagtcttcaaagtcttccacctgagcccattgttctcatggaggttttgtgatattaaccctcccccaaagactgggatcaccaaatagtttcaaaattctcagtttgtactgaagaccagaagatcagagaaggaaactttaatgctgtctagcctcctgctattaatgcaatcaaagaatacttttgcatatgtcttgataattaaatagtatttgttaactgtgatatgcatacacttatataagcagaattatgagttaaagtaatacttagcaatatgattttataatggctcctcattatgcttgctgttgaaccttttatgaggagtgaatataaagtattggttttccctcacaaatttaaagattatgttattaatactattataactgcatcaatcaagtcagataaaggcaactataaaatagtagtagtgtttgtttcctatctcaagggcgaaattttatgggaactcaatttattatgcagtttttaagtttaaaataccaagaaagatgtcactagattctcttctatgtgatttttgttttttatataaagcagtgtagtggtgtttagaagctgaggccacctgtaaggcaaatctgccttaagtgtattatgtgttacttaaaggcaaatttgtgatctaaaagtacaagagtgatttttgagctaggattataaaatacataataaagatgtgagaagataaaatgcttttgttttggttttaatgttgggattattttaatcctttcatttgaaaaatcagtgtctcaaatgaattctgttcatttataataaatgcatatattgctctgaaaacaatattaatttttttaagtggagctttcatgtttcagtgtagaaacgtgacttataaagacataaaattgtgtatcatctaaagtcattgatctcttccatcagaaaacctgtttgtttagagttgcatgtaaagctgaaagagagggtgggcggattgttttagtatacctgatgagaaaaatcaggtttgacatttctcagtgaagattacttactgagttgaaataaatagtctgaaatcta

SEQ ID NO: 134509 - DNA, 572 bp, Homo sapiens
ctataaataaacaatacaatgctaatcattttttgtcttttagccagaacaggcaaaggagtagcactgggtgaatgtaaatgaaagaagctaacaggagaggttcagggctaaaacagtagatttgtcgtgtggtcttagtgtgcactattgcatccaataaggaattcttctatactttctgttacagatgctgaaattttcttctaaggagaaatatcccttatttacttttgtaaatggtcattccagagactatgattttacatctactacaaccaatgaagaagaccttttttcagaggatgaaaagaaacaattaaaaagatttagcacggaagagtttgtcttgctttaaagattagcacatttgtgcttgataagaagaattccattgaaaggggaaaaatgaagagaaacaagtatatctgaaatgtttattttcacaaatatcttaattttatatgttctttaaaaaagaacatttgaaaatataacagttaaagatatttttctaaaagagaaatgatttaatgaatcttgctttctaataaataaattgagtgattctg

SEQ ID NO: 134510 - DNA, 433 bp, Homo sapiens
atgaagtataatgagttttataagataaatataatacacagaaagctgactatgctgaaattttcttctaaggagaaatatcccttatttacttttgtaaatggtcattccagagactatgattttacatctactacaaccaatgaagaagaccttttttcagaggatgaaaagaaacaattaaaaagatttagcacggaagagtttgtcttgctttaaagattagcacatttgtgcttgataagaagaattccattgaaaggggaaaaatgaagagaaacaagtatatctgaaatgtttattttcacaaatatcttaattttatatgttctttaaaaaagaacatttgaaaatataacagttaaagatatttttctaaaagagaaatgatttaatgaatcttgctttctaataaataaattgagtgattctg

SEQ ID NO: 134511 - DNA, 424 bp, Homo sapiens
gttacccgcctccgcggcgtctctgtgagagaagtaagaaggttacagctacaattcttctttgagaaatatcccttatttacttttgtaaatggtcattccagagactatgattttacatctactacaaccaatgaagaagaccttttttcagaggatgaaaagaaacaattaaaaagatttagcacggaagagtttgtcttgctttaaagattagcacatttgtgcttgataagaagaattccattgaaaggggaaaaatgaagagaaacaagtatatctgaaatgtttattttcacaaatatcttaattttatatgttctttaaaaaagaacatttgaaaatataacagttaaagatatttttctaaaagagaaatgatttaatgaatcttgctttctaataaataaattgagtgattctg

SEQ ID NO: 134512 - DNA, 1687 bp, Homo sapiens
cccagagggagtggaaaggctttgaaagtcagtataaaagattaaactctacagaagaatgcaatcaagtgatggcttttcctttagaatttgaatatggaggctacaggaacagatgaagttgacaagctaaaaaccaaatttatatctgcttggaacaacatgaaatatagttgggtgttgaaaacaaagacgtattttagtagaaattctcctgtattattgcttggaaaatgttaccattttaaatatgaagatgaagataaaacgttacctgcagagtcgggatgtacaatagaggatcacgtaattgcaggaaatgtagaagaatttcgtaaagatttcatttctagaatatggctgacctacagggaagaattccctcaaatagaaggctcagctttgacaacagactgtgggtggggctgcacattgagaactggccagatgctcttggctcaaggactcatactacactttcttggtagagcttggacctggcctgatgctttgaatattgaaaattcagactctgaatcatggacttcccacactgtcaaaaaatttactgcatcatttgaagcatcactttcaggggaaagagaattcaaaaccccaacaatttctctgaaggaaacaattgggaaatattctgatgatcatgaaatgcgaaatgaagtttatcataggaaaatcatctcttggtttggtgattcccccttggctctttttggcttacatcaactaatagaatatggaaagaagtctgggaaaaaagcaggagattggtatggaccagctgtggttgctcacattttaagaaaagcagttgaagaagcaaggcatcctgatttacaaggaataactatttatgttgcacaagattgtacagtttacaattctgatgtaattgataaacagagtgcttccatgacttctgataatgcagatgacaaagctgttattattctagttcctgttagacttggtggagaaagaaccaacaccgactacttagaatttgtgaagggtattttaagcctggaatattgtgtgggtattattggtggcaaacctaaacagtcatattactttgctggatttcaagatgacagtttgatttacatggatcctcattactgccaatcttttgtagatgtcagcataaaggatttccctcttgagacattccactgcccttctcccaaaaagatgtcttttcgaaaaatggatcccagctgtacaataggattttactgtcgaaatgttcaggacttcaaacgagcttctgaagaaatcaccaagatgctgaaattttcttctaaggagaaatatcccttatttacttttgtaaatggtcattccagagactatgattttacatctactacaaccaatgaagaagaccttttttcagaggatgaaaagaaacaattaaaaagatttagcacggaagagtttgtcttgctttaaagattagcacatttgtgcttgataagaagaattccattgaaaggggaaaaatgaagagaaacaagtatatctgaaatgtttattttcacaaatatcttaattttatatgttctttaaaaaagaacatttgaaaatataacagttaaagatatttttctaaaagagaaatgatttaatgaatcttgctttctaataaataaattgagtgattctg

SEQ ID NO: 134513 - DNA, 2114 bp, Homo sapiens
ccggggtgctcaaagtacctgtagctgcggcgctgaggtcggaacgtctgcgtgtgtgcgggctggttttgtggcggctgctgctagagctggagcatttgccggtcagtataaaagattaaactctacagaagaatgcaatcaagtgatggcttttcctttagaatttgaatatggaggctacaggaacagatgaagttgacaagctaaaaaccaaatttatatctgcttggaacaacatgaaatatagttgggtgttgaaaacaaagacgtattttagtagaaattctcctgtattattgcttggaaaatgttaccattttaaatatgaagatgaagataaaacgttacctgcagagtcgggatgtacaatagaggatcacgtaattgcaggaaatgtagaagaatttcgtaaagatttcatttctagaatatggctgacctacagggaagaattccctcaaatagaaggctcagctttgacaacagactgtgggtggggctgcacattgagaactggccagatgctcttggctcaaggactcatactacactttcttggtagagcttggacctggcctgatgctttgaatattgaaaattcagactctgaatcatggacttcccacactgtcaaaaaatttactgcatcatttgaagcatcactttcaggggaaagagaattcaaaaccccaacaatttctctgaaggaaacaattgggaaatattctgatgatcatgaaatgcgaaatgaagtttatcataggaaaatcatctcttggtttggtgattcccccttggctctttttggcttacatcaactaatagaatatggaaagaagtctgggaaaaaagcaggagattggtatggaccagctgtggttgctcacattttaagaaaagcagttgaagaagcaaggcatcctgatttacaaggaataactatttatgttgcacaagattgtacagtttacaattctgatgtaattgataaacagagtgcttccatgacttctgataatgcagatgacaaagctgttattattctagttcctgttagacttggtggagaaagaaccaacaccgactacttagaatttgtgaagggtattttaagcctggaatattgtgtgggtattattggtggcaaacctaaacagtcatattactttgctggatttcaagatgacagtttgatttacatggatcctcattactgccaatcttttgtagatgtcagcataaaggatttccctcttgagacattccactgcccttctcccaaaaagatgtcttttcgaaaaatggatcccagctgtacaataggattttactgtcgaaatgttcaggacttcaaacgagcttctgaagaaatcaccaagatgctgaaattttcttctaaggagaaatatcccttatttacttttgtaaatggtcattccagagactatgattttacatctactacaaccaatgaagaagaccttttttcagaggatgaaaagaaacaattaaaaagatttagcacggaagagtttgtcttgctttaaagattagcacatttgtgcttgataagaagaattccattgaaaggggaaaaatgaagagaaacaagtatatctgaaatgtttattttcacaaatatcttaattttatatgttctttaaaaaagaacatttgaaaatataacagttaaagatatttttctaaaagagaaatgatttaatgaatcttgctttctaataaataaattgagtgattctggttgcattcctatttccctaagatctactagtgataattctaccttaactgtaagccttttagtcttcaaagtcttccacctgagcccattgttctcatggaggttttgtgatattaaccctcccccaaagactgggatcaccaaatagtttcaaaattctcagtttgtactgaagaccagaagatcagagaaggaaactttaatgctgtctagcctcctgctattaatgcaatcaaagaatacttttgcatatgtcttgataattaaatcatattgctaagtattactttaactcataattctgcttatataagtgtatgcagatcacagttaacaaatactatttaag

SEQ ID NO: 134514 - DNA, 1408 bp, Homo sapiens
ccggggtgctcaaagtacctgtagctgcggcgctgaggtcggaacgtctgcgtgtgtgcgggctggttttgtggcggctgctgctagagctggagcatttgccggtcagtataaaagattaaactctacagaagaatgcaatcaagtgatggcttttcctttagaatttgaatatggaggctacaggaacagatgaagttgacaagctaaaaaccaaatttatatctgcttggaacaacatgaaatatagttgggtgttgaaaacaaagacgtattttagtagaaattctcctgtattattgcttggaaaatgttaccattttaaatatgaagatgaagataaaacgttacctgcagagtcgggatgtacaatagaggatcacgtaattgcaggaaatgtagaagaatttcgtaaagatttcatttctagaatatggctgacctacagggaagaattccctcaaatagaaggctcagctttgacaacagactgtgggtggggctgcacattgagaactggccagatgctcttggctcaaggactcatactacactttcttggtagagcttggacctggcctgatgctttgaatattgaaaattcagactctgaatcatggacttcccacactgtcaaaaaatttactgcatcatttgaagcatcactttcaggggaaagagaattcaaaaccccaacaatttctctgaaggaaacaattgggaaatattctgatgatcatgaaatgcgaaatgaagtttatcataggaaaatcatctcttggtttggtgattcccccttggctctttttggcttacatcaactaatagaatatggaaagaagtctgggaaaaaagcaggagattggtatggaccagctgtggttgctcacattttaagaaaagcagttgaagaagcaaggcatcctgatttacaaggaataactatttatgttgcacaagattgtacagtttacaattctgatgtaattgataaacagagtgcttccatgacttctgataatgcagatgacaaagctgttattattctagttcctgttagacttggtggagaaagaaccaacaccgactacttagaatttgtgaagggtattttaagcctggaatattgtgtgggtattattggtggcaaacctaaacagtcatattactttgctggatttcaagatgacagtttgatttacatggatcctcattactgccaatcttttgtagatgtcagcataaaggatttccctcttgaggtcattttgtgatccagtattttaattcagaaaaatttgagaatacataaatgaaacatgtaattattacatggttttgattgttttcccagttggtgcttttacagactaaagtaattttacagaataaaataacttaaatcact

SEQ ID NO: 134515 - DNA, 1712 bp, Homo sapiens
ctataaataaacaatacaatgctaatcattttttgtcttttagccagaacaggcaaaggagtagcactgggtgaatgtaaatgaaagaagctaacaggagaggttcagggctaaaacagtagatttgtcgtgtggtcttagtgtgcactattgcatccaataaggaattcttctatactttctgttacagatgctgaaattttcttctaaggagaaatatcccttatttacttttgtaaatggtcattccagagactatgattttacatctactacaaccaatgaagaagaccttttttcagaggatgaaaagaaacaattaaaaagatttagcacggaagagtttgtcttgctttaaagattagcacatttgtgcttgataagaagaattccattgaaaggggaaaaatgaagagaaacaagtatatctgaaatgtttattttcacaaatatcttaattttatatgttctttaaaaaagaacatttgaaaatataacagttaaagatatttttctaaaagagaaatgatttaatgaatcttgctttctaataaataaattgagtgattctggttgcattcctatttccctaagatctactagtgataattctaccttaactgtaagccttttagtcttcaaagtcttccacctgagcccattgttctcatggaggttttgtgatattaaccctcccccaaagactgggatcaccaaatagtttcaaaattctcagtttgtactgaagaccagaagatcagagaaggaaactttaatgctgtctagcctcctgctattaatgcaatcaaagaatacttttgcatatgtcttgataattaaatagtatttgttaactgtgatatgcatacacttatataagcagaattatgagttaaagtaatacttagcaatatgattttataatggctcctcattatgcttgctgttgaaccttttatgaggagtgaatataaagtattggttttccctcacaaatttaaagattatgttattaatactattataactgcatcaatcaagtcagataaaggcaactataaaatagtagtagtgtttgtttcctatctcaagggcgaaattttatgggaactcaatttattatgcagtttttaagtttaaaataccaagaaagatgtcactagattctcttctatgtgatttttgttttttatataaagcagtgtagtggtgtttagaagctgaggccacctgtaaggcaaatctgccttaagtgtattatgtgttacttaaaggcaaatttgtgatctaaaagtacaagagtgatttttgagctaggattataaaatacataataaagatgtgagaagataaaatgcttttgttttggttttaatgttgggattattttaatcctttcatttgaaaaatcagtgtctcaaatgaattctgttcatttataataaatgcatatattgctctgaaaacaatattaatttttttaagtggagctttcatgtttcagtgtagaaacgtgacttataaagacataaaattgtgtatcatctaaagtcattgatctcttccatcagaaaacctgtttgtttagagttgcatgtaaagctgaaagagagggtgggcggattgttttagtatacctgatgagaaaaatcaggtttgacatttctcagtgaagattacttactgagttgaaataaatagtctgaaatcta

SEQ ID NO: 134516 - DNA, 1566 bp, Homo sapiens
tttttttttccttcctttctccacccggccaagaaaaaaaggttatgctgaaattttcttctaaggagaaatatcccttatttacttttgtaaatggtcattccagagactatgattttacatctactacaaccaatgaagaagaccttttttcagaggatgaaaagaaacaattaaaaagatttagcacggaagagtttgtcttgctttaaagattagcacatttgtgcttgataagaagaattccattgaaaggggaaaaatgaagagaaacaagtatatctgaaatgtttattttcacaaatatcttaattttatatgttctttaaaaaagaacatttgaaaatataacagttaaagatatttttctaaaagagaaatgatttaatgaatcttgctttctaataaataaattgagtgattctggttgcattcctatttccctaagatctactagtgataattctaccttaactgtaagccttttagtcttcaaagtcttccacctgagcccattgttctcatggaggttttgtgatattaaccctcccccaaagactgggatcaccaaatagtttcaaaattctcagtttgtactgaagaccagaagatcagagaaggaaactttaatgctgtctagcctcctgctattaatgcaatcaaagaatacttttgcatatgtcttgataattaaatagtatttgttaactgtgatatgcatacacttatataagcagaattatgagttaaagtaatacttagcaatatgattttataatggctcctcattatgcttgctgttgaaccttttatgaggagtgaatataaagtattggttttccctcacaaatttaaagattatgttattaatactattataactgcatcaatcaagtcagataaaggcaactataaaatagtagtagtgtttgtttcctatctcaagggcgaaattttatgggaactcaatttattatgcagtttttaagtttaaaataccaagaaagatgtcactagattctcttctatgtgatttttgttttttatataaagcagtgtagtggtgtttagaagctgaggccacctgtaaggcaaatctgccttaagtgtattatgtgttacttaaaggcaaatttgtgatctaaaagtacaagagtgatttttgagctaggattataaaatacataataaagatgtgagaagataaaatgcttttgttttggttttaatgttgggattattttaatcctttcatttgaaaaatcagtgtctcaaatgaattctgttcatttataataaatgcatatattgctctgaaaacaatattaatttttttaagtggagctttcatgtttcagtgtagaaacgtgacttataaagacataaaattgtgtatcatctaaagtcattgatctcttccatcagaaaacctgtttgtttagagttgcatgtaaagctgaaagagagggtgggcggattgttttagtatacctgatgagaaaaatcaggtttgacatttctcagtgaagattacttactgagttgaaataaatagtctgaaatcta

SEQ ID NO: 134517 - DNA, 1584 bp, Homo sapiens
ccgcgctctgtaagcaattaacgtttgtctgacccgtgacgaagtgtgagaggcggtctactatgctgaaattttcttctaaggagaaatatcccttatttacttttgtaaatggtcattccagagactatgattttacatctactacaaccaatgaagaagaccttttttcagaggatgaaaagaaacaattaaaaagatttagcacggaagagtttgtcttgctttaaagattagcacatttgtgcttgataagaagaattccattgaaaggggaaaaatgaagagaaacaagtatatctgaaatgtttattttcacaaatatcttaattttatatgttctttaaaaaagaacatttgaaaatataacagttaaagatatttttctaaaagagaaatgatttaatgaatcttgctttctaataaataaattgagtgattctggttgcattcctatttccctaagatctactagtgataattctaccttaactgtaagccttttagtcttcaaagtcttccacctgagcccattgttctcatggaggttttgtgatattaaccctcccccaaagactgggatcaccaaatagtttcaaaattctcagtttgtactgaagaccagaagatcagagaaggaaactttaatgctgtctagcctcctgctattaatgcaatcaaagaatacttttgcatatgtcttgataattaaatagtatttgttaactgtgatatgcatacacttatataagcagaattatgagttaaagtaatacttagcaatatgattttataatggctcctcattatgcttgctgttgaaccttttatgaggagtgaatataaagtattggttttccctcacaaatttaaagattatgttattaatactattataactgcatcaatcaagtcagataaaggcaactataaaatagtagtagtgtttgtttcctatctcaagggcgaaattttatgggaactcaatttattatgcagtttttaagtttaaaataccaagaaagatgtcactagattctcttctatgtgatttttgttttttatataaagcagtgtagtggtgtttagaagctgaggccacctgtaaggcaaatctgccttaagtgtattatgtgttacttaaaggcaaatttgtgatctaaaagtacaagagtgatttttgagctaggattataaaatacataataaagatgtgagaagataaaatgcttttgttttggttttaatgttgggattattttaatcctttcatttgaaaaatcagtgtctcaaatgaattctgttcatttataataaatgcatatattgctctgaaaacaatattaatttttttaagtggagctttcatgtttcagtgtagaaacgtgacttataaagacataaaattgtgtatcatctaaagtcattgatctcttccatcagaaaacctgtttgtttagagttgcatgtaaagctgaaagagagggtgggcggattgttttagtatacctgatgagaaaaatcaggtttgacatttctcagtgaagattacttactgagttgaaataaatagtctgaaatcta

SEQ ID NO: 134518 - DNA, 1579 bp, Homo sapiens
agtttggttttttgattgacgcaattgttttttttgtgtatttttatatatgtcattatgctgaaattttcttctaaggagaaatatcccttatttacttttgtaaatggtcattccagagactatgattttacatctactacaaccaatgaagaagaccttttttcagaggatgaaaagaaacaattaaaaagatttagcacggaagagtttgtcttgctttaaagattagcacatttgtgcttgataagaagaattccattgaaaggggaaaaatgaagagaaacaagtatatctgaaatgtttattttcacaaatatcttaattttatatgttctttaaaaaagaacatttgaaaatataacagttaaagatatttttctaaaagagaaatgatttaatgaatcttgctttctaataaataaattgagtgattctggttgcattcctatttccctaagatctactagtgataattctaccttaactgtaagccttttagtcttcaaagtcttccacctgagcccattgttctcatggaggttttgtgatattaaccctcccccaaagactgggatcaccaaatagtttcaaaattctcagtttgtactgaagaccagaagatcagagaaggaaactttaatgctgtctagcctcctgctattaatgcaatcaaagaatacttttgcatatgtcttgataattaaatagtatttgttaactgtgatatgcatacacttatataagcagaattatgagttaaagtaatacttagcaatatgattttataatggctcctcattatgcttgctgttgaaccttttatgaggagtgaatataaagtattggttttccctcacaaatttaaagattatgttattaatactattataactgcatcaatcaagtcagataaaggcaactataaaatagtagtagtgtttgtttcctatctcaagggcgaaattttatgggaactcaatttattatgcagtttttaagtttaaaataccaagaaagatgtcactagattctcttctatgtgatttttgttttttatataaagcagtgtagtggtgtttagaagctgaggccacctgtaaggcaaatctgccttaagtgtattatgtgttacttaaaggcaaatttgtgatctaaaagtacaagagtgatttttgagctaggattataaaatacataataaagatgtgagaagataaaatgcttttgttttggttttaatgttgggattattttaatcctttcatttgaaaaatcagtgtctcaaatgaattctgttcatttataataaatgcatatattgctctgaaaacaatattaatttttttaagtggagctttcatgtttcagtgtagaaacgtgacttataaagacataaaattgtgtatcatctaaagtcattgatctcttccatcagaaaacctgtttgtttagagttgcatgtaaagctgaaagagagggtgggcggattgttttagtatacctgatgagaaaaatcaggtttgacatttctcagtgaagattacttactgagttgaaataaatagtctgaaatcta

SEQ ID NO: 134519 - DNA, 1764 bp, Homo sapiens
ccggggtgctcaaagtacctgtagctgcggcgctgaggtcggaacgtctgcgtgtgtgcgggctggttttgtggcggctgctgctagagctggagcatttgccggtcagtataaaagattaaactctacagaagaatgcaatcaagtgatggcttttcctttagaatttgaatatggaggctacaggaacagatgaagttgacaagctaaaaaccaaatttatatctgcttggaacaacatgaaatatagttgggtgttgaaaacaaagacgtattttagtagaaattctcctgtattattgcttggaaaatgttaccattttaaatatgaagatgaagataaaacgttacctgcagagtcgggatgtacaatagaggatcacgtaattgcaggaaatgtagaagaatttcgtaaagatttcatttctagaatatggctgacctacagggaagaattccctcaaatagaaggctcagctttgacaacagactgtgggtggggctgcacattgagaactggccagatgctcttggctcaaggactcatactacactttcttggtagagcttggacctggcctgatgctttgaatattgaaaattcagactctgaatcatggacttcccacactgtcaaaaaatttactgcatcatttgaagcatcactttcaggggaaagagaattcaaaaccccaacaatttctctgaaggaaacaattgggaaatattctgatgatcatgaaatgcgaaatgaagtttatcataggaaaatcatctcttggtttggtgattcccccttggctctttttggcttacatcaactaatagaatatggaaagaagtctgggaaaaaagcaggagattggtatggaccagctgtggttgctcacattttaagaaaagcagttgaagaagcaaggcatcctgatttacaaggaataactatttatgttgcacaagattgtacagtttacaattctgatgtaattgataaacagagtgcttccatgacttctgataatgcagatgacaaagctgttattattctagttcctgttagacttggtggagaaagaaccaacaccgactacttagaatttgtgaagggtattttaagcctggaatattgtgtgggtattattggtggcaaacctaaacagtcatattactttgctggatttcaagatgacagtttgatttacatggatcctcattactgccaatcttttgtagatgtcagcataaaggatttccctcttgagacattccactgcccttctcccaaaaagatgtcttttcgaaaaatggatcccagctgtacaataggattttactgtcgaaatgttcaggacttcaaacgagcttctgaagaaatcaccaagatgctgaaattttcttctaaggagaaatatcccttatttacttttgtaaatggtcattccagagactatgattttacatctactacaaccaatgaagaagaccttttttcagaggatgaaaagaaacaattaaaaagatttagcacggaagagtttgtcttgctttaaagattagcacatttgtgcttgataagaagaattccattgaaaggggaaaaatgaagagaaacaagtatatctgaaatgtttattttcacaaatatcttaattttatatgttctttaaaaaagaacatttgaaaatataacagttaaagatatttttctaaaagagaaatgatttaatgaatcttgctttctaataaataaattgagtgattctg

SEQ ID NO: 134520 - DNA, 2136 bp, Homo sapiens
gacccgagtcagcagtggcaacctgctcaggtccccttccacgccatggaagctttgttctttggctctttgcaataaatcttgctgctgttcactctttgggtccacatggcctttatgagctgtaacactcaccatgaaggtctgcagcttcactcctgaagccagtgagatcatggacccctggggagggacgaacaactccagacgcgccacctttaagagctgtaacactcactgcgaaggtctgcagcttcactcctgaagtcagcgagaccacaaagccaccagaaggaagaaactccagacacatctgaacatctgaaggaatgaactctggacacagcaatctttaagaactgtaacactcactgcgagggtccatggcttcattcttgaagtcagcaagaccaagaacccactaattctggacacatttttggcagcccagatgggactatcgcctatcaccaagcgtcagtataaaagattaaactctacagaagaatgcaatcaagtgatggcttttcctttagaatttgaatatggaggctacaggaacagatgaagttgacaagctaaaaaccaaatttatatctgcttggaacaacatgaaatatagttgggtgttgaaaacaaagacgtattttagtagaaattctcctgtattattgcttggaaaatgttaccattttaaatatgaagatgaagataaaacgttacctgcagagtcgggatgtacaatagaggatcacgtaattgcaggaaatgtagaagaatttcgtaaagatttcatttctagaatatggctgacctacagggaagaattccctcaaatagaaggctcagctttgacaacagactgtgggtggggctgcacattgagaactggccagatgctcttggctcaaggactcatactacactttcttggtagagcttggacctggcctgatgctttgaatattgaaaattcagactctgaatcatggacttcccacactgtcaaaaaatttactgcatcatttgaagcatcactttcaggggaaagagaattcaaaaccccaacaatttctctgaaggaaacaattgggaaatattctgatgatcatgaaatgcgaaatgaagtttatcataggaaaatcatctcttggtttggtgattcccccttggctctttttggcttacatcaactaatagaatatggaaagaagtctgggaaaaaagcaggagattggtatggaccagctgtggttgctcacattttaagaaaagcagttgaagaagcaaggcatcctgatttacaaggaataactatttatgttgcacaagattgtacagtttacaattctgatgtaattgataaacagagtgcttccatgacttctgataatgcagatgacaaagctgttattattctagttcctgttagacttggtggagaaagaaccaacaccgactacttagaatttgtgaagggtattttaagcctggaatattgtgtgggtattattggtggcaaacctaaacagtcatattactttgctggatttcaagatgacagtttgatttacatggatcctcattactgccaatcttttgtagatgtcagcataaaggatttccctcttgagacattccactgcccttctcccaaaaagatgtcttttcgaaaaatggatcccagctgtacaataggattttactgtcgaaatgttcaggacttcaaacgagcttctgaagaaatcaccaagatgctgaaattttcttctaaggagaaatatcccttatttacttttgtaaatggtcattccagagactatgattttacatctactacaaccaatgaagaagaccttttttcagaggatgaaaagaaacaattaaaaagatttagcacggaagagtttgtcttgctttaaagattagcacatttgtgcttgataagaagaattccattgaaaggggaaaaatgaagagaaacaagtatatctgaaatgtttattttcacaaatatcttaattttatatgttctttaaaaaagaacatttgaaaatataacagttaaagatatttttctaaaagagaaatgatttaatgaatcttgctttctaataaataaattgagtgattctg

SEQ ID NO: 134521 - DNA, 1776 bp, Homo sapiens
ccggggtgctcaaagtacctgtagctgcggcgctgaggtcggaacgtctgcgtgtgtgcgggctggttttgtggcggctgctgctagagctggagcatttgccggatgtcagcataaaggatttccctcttgagacattccactgcccttctcccaaaaagatgtcttttcgaaaaatggatcccagctgtacaataggattttactgtcgaaatgttcaggacttcaaacgagcttctgaagaaatcaccaagatgctgaaattttcttctaaggagaaatatcccttatttacttttgtaaatggtcattccagagactatgattttacatctactacaaccaatgaagaagaccttttttcagaggatgaaaagaaacaattaaaaagatttagcacggaagagtttgtcttgctttaaagattagcacatttgtgcttgataagaagaattccattgaaaggggaaaaatgaagagaaacaagtatatctgaaatgtttattttcacaaatatcttaattttatatgttctttaaaaaagaacatttgaaaatataacagttaaagatatttttctaaaagagaaatgatttaatgaatcttgctttctaataaataaattgagtgattctggttgcattcctatttccctaagatctactagtgataattctaccttaactgtaagccttttagtcttcaaagtcttccacctgagcccattgttctcatggaggttttgtgatattaaccctcccccaaagactgggatcaccaaatagtttcaaaattctcagtttgtactgaagaccagaagatcagagaaggaaactttaatgctgtctagcctcctgctattaatgcaatcaaagaatacttttgcatatgtcttgataattaaatagtatttgttaactgtgatatgcatacacttatataagcagaattatgagttaaagtaatacttagcaatatgattttataatggctcctcattatgcttgctgttgaaccttttatgaggagtgaatataaagtattggttttccctcacaaatttaaagattatgttattaatactattataactgcatcaatcaagtcagataaaggcaactataaaatagtagtagtgtttgtttcctatctcaagggcgaaattttatgggaactcaatttattatgcagtttttaagtttaaaataccaagaaagatgtcactagattctcttctatgtgatttttgttttttatataaagcagtgtagtggtgtttagaagctgaggccacctgtaaggcaaatctgccttaagtgtattatgtgttacttaaaggcaaatttgtgatctaaaagtacaagagtgatttttgagctaggattataaaatacataataaagatgtgagaagataaaatgcttttgttttggttttaatgttgggattattttaatcctttcatttgaaaaatcagtgtctcaaatgaattctgttcatttataataaatgcatatattgctctgaaaacaatattaatttttttaagtggagctttcatgtttcagtgtagaaacgtgacttataaagacataaaattgtgtatcatctaaagtcattgatctcttccatcagaaaacctgtttgtttagagttgcatgtaaagctgaaagagagggtgggcggattgttttagtatacctgatgagaaaaatcaggtttgacatttctcagtgaagattacttactgagttgaaataaatagtctgaaatcta

SEQ ID NO: 134522 - DNA, 724 bp, Homo sapiens
atctaagactccattcacttattgcatagagctaataaattaaacaattcatctatgtgttaatttttgtgcttaatctttctcattccttctctaaatcaagttgaacttccatgtatctgtttctttttaatgttaggatagcaaagtgtttacataaggattttagggactaaagaccaaaaatatttctggctgctgggaaatcagattggtggtggggtctatcttcaagtttatttcccattgacaaggcatatttgaaaaaatatgtttatttggattaagaacttgggttctgatttgttgtactattttatatgtaattttatggctgaggatctgaacgtacattagaaccctcatgtaaactctcaggtttataaactgatacccctgttgctatgaatttttttgaaaaaatcttattcaacgtaactactatattccagctggttgtacgtcccaaaagtctggtcattgtataaatggaattatttttattttcttccctctgaatatttggcatatttacttttatctatgtctaatcttatctcttatccatatggaaaggcgagtttgaagtgtccagtcacacaaatctgtctgtctataaatagacagccatactttatccaactgtgctgaaacacatagacatttaaaaccaaatgaaatatcaacccaactttcggaaaaggactattcatgtcctttttga

SEQ ID NO: 134523 - DNA, 383 bp, Homo sapiens
tgtgacagtcattgggacggaacgtcagtttgaaggcgggctcagagttgaggggagggtctggcttctgtggagctctacgtgctggtcactatggtcgtagtaaccgttgtccttcagttacggcacagaggctcacatggaggccaatccaatggtaccatcccaggagggagggcgtgctccagccttagtgcccgcagcctggtcctgccactagcctagccgccctggctctcttcctgctctttgtcttcctcactctgccctctgggccctgccggcacctgccgccacacctttcctcctcttacagttctggctggcctctgccctgtcagatgtcagagggaatctttacagtgcgtcccagtcctcggccc

SEQ ID NO: 134524 - DNA, 539 bp, Homo sapiens
atgctgagtgtctagaggatccctttcagtcgagacggattcggacttggcaggagcaaagactgctgtgggcaccacgtaagagtctggtgctgcctactgaggagaaaggagtcagggtcttgtgggtgctggtgagctggaagctggtccacaactgcacctgccacaggaggactaaataaaacaagaggcaagtgatggacgaatggagtggctgtccagttgcttcgtgtcactctgtaaagcatactaggatcttcttaaaagggatggcctcaggttataggcagcatgatggctagttttaatgaatttaatgctggcttagagccaggggtggggtacagcccagagggtaggttattgcaagtcaggaccagaggtggtggcccagttgggtggctggatacatttagagggtgtgggcaagcctgtggctcttattcacaggattcactgcctggaacagtctaggcgtggctggattttgggctttggatcgcaaaagaggtagaccctgcccactgccatcctgc

SEQ ID NO: 134525 - DNA, 607 bp, Homo sapiens
ggattccagcactgattgaccatgttgacataattaaaattttcaaatcctgttcactggctgtgatagagtaagaatttagttaaatcccaagagccaacctgtcctattacctttagaagtgaatatacctcctgccatctgtacttcctcccctgcccttctgtagaggtagctctcttccccactgactccacactgcacttccaacactagggacctctctgttcagatcttacttcacttcctggcagcattcagcatcgttgagccttaacacccttttctcctgacttctatgacatcatacccttctgggtttcatgctgctttcatgaccattccttttctggcccttttctcactgctgcaatcctgctggtctcccattcagaccagtctctcatactgttctggctatttttcaaatatgtcaccaatacttattttggaaaatgttatgtattcctgcctcagggtcttaacactgaccttttcctctgcctgtctttttgttccctttttgctcacgtctcaccttttgaatgatgcttatcctgactcctctttaatttcactacggtaaccacactcctgagccacactc

SEQ ID NO: 134526 - DNA, 301 bp, Homo sapiens
cagcttttgaccttttcctgcatctaaatggacattcatggcggcaggaggtgctagactagacccagcagaggacctacagcccaccatgtggctcagcttaggacgtgggagtagagtttccagagcatacacttgtcagggccaagggcttgtgcaagtaagtgggaatagaggcggtgctcatttgaggagagtgtgtgccagcccagcggccacgtaccaggtacctgggccctgcagctgtgtccagtccaaggcagagactgaatattctcctagagcatctagaaatgggcac

SEQ ID NO: 134527 - DNA, 787 bp, Homo sapiens
ggataattttgcctgagatgttccaactaagtattttgatcaaactttatagtggaaatggtagagcatggccataaaaattgttttccctaggttttgcttaatcttggtttaaaccagatttactagtttccaggataaactgagaaatttatattagacttttacacaatttcctagacttatctagagaggtatactaattacttttgtattaaagagattgctgaatcttttgaatattgcagaggaattgatcttgtcaatattttattttttgaaaaagatcatagagtaatatgaaactctttgtatgacattggcattctaatttggttttaaaaaaatgcagtttatcagaagtccccatatggtgcttaatcagacgttatagacagaaaagatggaatcctgtttcagaaccagcatgcatagttgtgcagattgtatactgtaccatgcattagttgaggcattcatgcaagagtcaacttgtgtattaggacagtttctggctgatggcagtaaagtgtctggaggaaggagcagctatttctgtttttacaaagactttgtaggggctagcagtagtactgtggcctatattttcagtttctatttacaaatgagtacttgttgaagtgattgagaagaatgtgtacatgatatctcattttatgtgatattactgcatactgtagcactcacttattggcaacctcagttatctgtaacagagtccacagccaaaataaagtaaaactgggccagtgaagtgaaaataaat

SEQ ID NO: 134528 - DNA, 462 bp, Homo sapiens
tggcatgtgtatcagaggcttgtcttgatttccacagataattttcgtactaaattgacctttctcgaagtgaactacatttctatcctctgtaaagtttaacactggacatcacaaaatggtaccccgcaagctgaatctagcaaccagatatgttttgtttggcttatactgtgtttagagaaacatttgaacatttttacactaaattgataattttacactaaattggactttctttaaatgaactacactttatatcctctataaactttaaaaccggatgtcacagaatgacaccctttaagctgaatccagctacacgatgtgttttgtttggcttaaatagtggttaaagaaacatttgaattagtttccatcatttaaaaattaagagattctacataaaaatctggattcctggcttcttttgaaaagtaggatgagttggcaatgcccatc

SEQ ID NO: 134529 - DNA, 283 bp, Homo sapiens
accacgttgccaggactcggctcctcggctcaaggaaaagggacagcggttccgtggctgtgctctgacacacctagaaatttcccgctcaagagagcaaactgaatcctttagtattaatgatttctcttcctcccaaaacccactaaaatgatgaaaagcaggattggaaagcacttccagcaatgcctgggagcggacggacaggtgcatcagctgacaagaaacacagaggaacttcccgaaactagagatctctggggatggagctgcttgggaaggc

SEQ ID NO: 134530 - DNA, 168 bp, Homo sapiens
gagattctaaaaggcgggatggggttgaaaaaatacctgttggttagtgttcactattgaaccatgagtacactaaaagctgaaagcccagattcgccattatgtaatatatccatgtaagaaaactgcccttgcaccctctaaatctataaaaataaaatagcaaca

SEQ ID NO: 134531 - DNA, 289 bp, Homo sapiens
ctagccagcatttgccagattctttcttgcttcatctcctttatcatctttctgtttcaagaagattttgcttgctttagtcattagacttgacctctattttgagtactgccagcctgtggatgtcctgctatcaactcttcaaattcaccatgtctaagatcaaaccactttcctgtatccaaatttatcctccaagacttgctatctctttgaaattactattttcccagacaccctagatagaaatcagaaatcacatttgaccttcctgcccttcttcacccat

SEQ ID NO: 134532 - DNA, 719 bp, Homo sapiens
ggactgtgcaccgagccttgggaacctacatgttgccccttgtctttcttttcacctgaaacaattagtttggcatattggacatgctgaccttgaagggtttatggaatgtttagatggaaatttctatgaaaccactggacatgttagtctagagcccttggttaagggtttatagtgagttagttaaaaaggcttcccagtgcacttcccacttttcagtctacccaatcttttaggatgtgcagagaagaagtgtagtttacatgtggtcctgttgctctgttcctggaagggagttcaaagggaagagaccaagtctccactccaatataaaccttctgaaagtttttttctttcaatggctccaaattgcacactctacaattgagaagttcagaaaattgagtaactcatattaaaattttcaagaccgcaaaggtttttcacataatagaacaattttaagggtgaagtaaatgaattcaaactaatttatttttcttttcatatatgtctaataaaaatgactgacggattgtttggactttaacgtgtttagatgtgagtctccccccttttattcagtgacaagtgcaaagcaacttgccaacaatttttttttcaattttgtaattttaacactgacaataagaaacattctatagaaagtttgactttgaactggaatatttttgccatatctctgcctagaggga

SEQ ID NO: 134533 - DNA, 148 bp, Homo sapiens
tcagctcggtaccgacgctctctctgtggggagctgcgtacaggagacctgagttcctcgaatagggcacagcttgaaaggatgtttgaacaagaagatctttatgccattagtatctagcaagagacaaaccttggaaacccctctc

SEQ ID NO: 134534 - DNA, 294 bp, Homo sapiens
cattctgtactcccattctcactctaagccctgggcagaccaaaatcctttagttcccctgattgctccttctgcctaagatagtctatttactttctgcctgaccaactacagttcattctttaggcattgattgcattgtcacatgctctcagaggcctttcctggccacccattctggctttagcctgccttttctctgcatgcctgcaatgccctgcttttccctcacccatcccttctcacactttttttttttttttgaaacagagtctcgctctgtcgcccaggctg

SEQ ID NO: 134535 - DNA, 432 bp, Homo sapiens
aatatgctctaactcttgtgtaaatacagtctgactctccttgaatcccttaagtgtgatgtcatctgggaatgttcttcatagaaataacagatttgaagagcctaaagaccaattttatattttattagtaatttggtattcatccagatggggaaagggaccagaaaatatcccctttcatgagaatgttataaatcacaaattcccttaaaaatgtacaggcagcttcataccagatactaccacaaggatgaggaagacacagtccctgaactttgtatccatctaatgataccacttactcagcaccacatacttgtattaagcacatcatgtctattatattatttaatctaatggaaatgttattattccaattttatacttgaggaaacaggcctagagaactgtctttcctcttgggaaaag

SEQ ID NO: 134536 - DNA, 135 bp, Homo sapiens
tcacttctgaggttagaaaacaacaataaaatcaacctacagaatgcaaaagaaagaaagatcaaagcagatatgaattaattagaagatatgagagaaaaaccagaattgacaaatacaaaagttgatttattg

SEQ ID NO: 134537 - DNA, 810 bp, Homo sapiens
ctgtgggttatcaggtaatggaaacttcattatttatttgctggcaggatcatacaatgaacacggtattttcaagtgagatctgaaagtgctctggcacttaaacatttagtattttatcttaaacatattctagatcatttgactcataactgtcacttgaccctggggtcaaaatttgcatttgtgtttatgtttttagtgatgccaagtaaatactgttttggttgttggggactaatattaaggaaaagaatagagatgttcttaataagatggttttgagttaaatgaccaaattattttgtaatatgtggcattaatgtcgcataattgaaactaagaaaaagtgcatgtcttattatgaggcactcagtagtccagtcattccaaacttaaaagatatcttgtggtgcagttggtacattttcatgttgtgagcagagatttaaattcagcaaaaccacatcacctgtttttttaaagtgtaacttgttaaatttaaatttgtttggaagttttattagtcagtattgggtggtatatggtaatcagtcagtaattgctaatgtaagtataggtggttatatagatactatgcatacgttattctggttatgtcggtaggtttataacttaggaactatttgtctttgaacctacggactttccttcaagcggttccacgtgggggtcattccagcaccgttagagggtgcccggatcactttaaagggggggggcgcccccacacgggggggcacactggacccataaaaccacggcggccaaggggcgtcacccacacgc

SEQ ID NO: 134538 - DNA, 220 bp, Homo sapiens
tgctgggattacaggcgtgagccaccgcgcctggccaaaaagctgattctttagtgaaattggcaaacctctagaaaaagacagagaagatgcaaaattaccagtatcaggactgaaaagagatatcacaagagaccccataggatagatataccatcctccatgatatgattatttcacattgtatacctatatcaaaacatctcatttatcccataaa

SEQ ID NO: 134539 - DNA, 373 bp, Homo sapiens
tcaagtcccattctttgtgttgacagaatcttccgccagtctttcctgtatcagcaaatggcaccatcatcaccctgctgctcggaataaaaatagaggagttaccccggatgcctctccattttcaagcatcatattcagcccatcagcaagtcctaggatctgtaatctccaaaatatacccagagttcaaccattcactccgtctccactgccagcacccgagcccagccaccaccatctcctgccagaccgcctgtcctggcctcctgcctggtctccctgttccactcccgtgtcattgtcatctattctccacaccacagccaggccctctatttaattcattaaacagattgtatgagtcccctga

SEQ ID NO: 134540 - DNA, 323 bp, Homo sapiens
aaaatgaaaggattggactgaatgatttcctaagtttcttctggttctaaatctttcattttttactgtgtcatcaagtatcctttcatctttggagctgtttaaaaatggttaatgattagcttacaaaaatcagccaattcctctaaattatcacttagtcctatttgctaaacttataatctgtgaaactgttagcacatagaacatttatactaacctctcatttgctttgtagattctagcccatgaggcaaattaattgcataactgatacacctaagtatacagaatacagtcatgcaacactagacacattcata

SEQ ID NO: 134541 - DNA, 581 bp, Homo sapiens
tgtcaactctgtttttcctccatgtttttttcttcaagatttggcctctactactgcctgatagagcagatgagcaggcaggatggtagccccaggggtaccagcagcttccatatgaggaaccaaggccttagatgtgtggcctaccctctcccagcacacagtgctggctccaaggagagcaagcacacatagttaatttggggggcaacccattccatgcaaccattgtagctatgtaactttgagtcagctggtaaatatgtatatcttgtgttaaaaatgacatttctggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctc

SEQ ID NO: 134542 - DNA, 5747 bp, Homo sapiens
  misc_feature (5686)..(5686): n is a, c, g, or t
ctgcttacctccccacgaacttgcacatctccaatgcagaggagtcctttttccttaaagaagccaaccaagacctcacaaggaactccagtctgcaggcccgggtggagccattcttcatctaccgagccaggacaccccctattatcaatgccagctatggcccattttcagtggagaagataatcccccaggagctcctgttgacatctacagcctttggaaacatggacaaatttcccttcaactggaaattgaaatcccacatccttgacagctccatctactccaacagacccaaagtgcagaccttgttttatgtcactggcatgggctgggatgacagtgaccttacggaagatctaccctgtgtcaagatgtttgctttccctgaggccagggaagtggcagccagctgtcggctgcaaggggccccagggctgtgtgtggctgagctggagctgctgcccgagtggttcagctcaggcctggacctggaaccagaggaggagatcccagccctgctcgggggcaccacgatggagctcttcttcacgctctacccagctgacaaggctggccagtgtcctctggaggaggaaggcaagtgggagaacaatatccactcgggcctggagagcccccagcaagcgtttccagcccgagagaggattgggagtgtggtggtctacccaacccaagatgatctgaagtggtccctggtgagcttggacgagaatgtggtcatctcggtacctctgaatctagtccgggaaggggacacggccacctttttggtctctctgaccagtagctctgtggcagaccagttcactcttagaattaaggcggcagcaggtgtgaagataacggcagtgagagtcagcagtgaggaccaatgggcagtccaggaggaaattgataatggcagcactcagacgtcggccaccctcacctgcatgggccatcgcccggacacgcagagcagggtaaatggatccttctatgagatcttgcaagtggactttggaattgataatagcagtgacctggctggggcccagcagattacctggcaggtggagtacccgattgaggactccatgagtgagctggtcgtctccgagatcttcgtcagccagacaaccttcgtgggcatcgtccctcttgccatggacaccgaggttttgaacactgccattctcactggaaagcctgtttcagttcctgtcaaagtcgtgggggtccaggaggatggttctgtggtcgatgtgtctgagtctgtggaatgcaagtctgccgatgaagatgtcattaaggtaaggggggatttatctacagctgtcctaagtgctcagagctttttgtcgttccttcttttgtctccaaggtcttgttctcactgagcatcccatgctctaaagggctggaggccagaatgacctcacgaaggaggaaacagctgaccgcagagactccctggaatcagcaggcggctgcagcaggtgatgctgcttccctctccctggaaaggggaatccctgacccttaatctccagcagaaagaatttattctcctccccttcttgtctcccctattcttctctctatctttcctcgtaagacaatattttcctaactttagcaatccaaataagaccttctcattttttgcaaactcactgtgcctaataatattatttactcaatatattttctttaaatgccttgcttctttcgggtagccagttagctcagtgggttagagtgtggtgctaataaatgcattactttttcaaacttaaaaactaatttagcttcattataagacaataaagtccgtgagcttggtgtattacattttttgttaatatgcattaaaataaataactattcaaataaaattaagttcacccatgtgccacctaactgaacttgaatataaccagtgggatacagtttaggaaatgggacatttctgctagattcttcactcaaattagctatgtttctgactccaaattctgctaggaaccagaaaatatttttttcatgctctctgaaggggtctttttgaaccaccaaatttaatatttctgcctattttttcttagcacattggttgctattgcttttgcagcagagacctcagggagaaaggatttgaatttttagaatgactgatccttcctcctttaaattattaagagagccccaaagtccaatctattcagctattttagaaaaatacaataactcagagttctgcccttcctcacattctacaagctcttgtttagaggttacatgaaacttggtctcagtattgaaaacttcgtggtagacaggaaaacctttaggggtttccctatagtagaaaaggtctgggaggggttgatttcttcttgttgtgacctacaggatgctgtgtcttaagcaagagacagtttcggaaaaaaagactgatgtattcgtgaggtctaattaacaaagaaattaattcctaggaaactcaagtttggcatagactctttcctggacatggaatgctcatcgtccttagatatggaaggtggactggcttaaaacctgcacacatagccctgcctggggttcctggtggtccttgtattctgtaggcaggtttgattaaatatatggccttaaatattcagagtttagaaagagctgagccaagtcacaggagattatatgcaccaatgacaaatatggatgatgaactgctgttggttgctattgacaatgcgcaagttttacactatttttactattcccatgtcattctagaaaggagacactgataagagatggtatctgtatgcttacgtcataatgggctcaaacaaatgattcagtctgtagtttcctaagccttttgttctgacctaagagcctgctatgaagccccatggggtggaatcctccttctcttgccctgaagagctctactctagaggggcaggtccaagttcacagatcccgttattgccatatacctggttttctccactccacacaaatgtactaaaagtatcctctgctcatcctcatagacgttgttttggaagatgatacctttttgctcagctgtcacctatatagcctcaggaggatggggattcgtctaacaaattattgcccagtcttcagaggaacaaagtgaaacctgcagatcgcaagctcagagctgtattcacactttttaaggggattccaggactgttgcaagtttgggggcttgtgtcaattgaggcgatttaattaaatggctgtgatgcatttactatggcttcagtgtcaatgtttgtagtaaattttactataactccaagttgaatggagttgtccacagagctatgaccttggcatcatcccagggacatcctcaaatacatggcacattcattagcaccctttggagagatcctctgagtctgtggagttgtcacacagtcatacttcagagtacagaaaacactgaatgatttttagggagagtcttgcagggctcaccaaagatctttgtgccttggaaccatgagttagataagggaaaaatgtgaatttagaaagatgtaagttatggtaatatccaaacaaatgaacttgtttggcctgtgattgtatgacttttgcgggacagaatcagaggacatacatgattttgaaaagctggaaccttggcctaatctggcaagattaaaagagataaatgtaaaatttcaagttgacaactatagtagtccttccttatctgtggtttcactttccgtggtttcatttcactgtggtcaatcacagtccaaaaacgttaaatgaaaattttcagaaagaagcaattcatgttttaaattgtgtactgttctgagtatcgtgaagaaatcttgagtcttcctgctccatcccacctgggttgtaactcatgactttgtctggcatatccatgctgtagataccacccacctctgagtcatttagtagctgcctgggtgatcaaatagactgtcgcggtatcacagtgcttgtgttcaagtcacccttatgttatttacaaatgaccccaaagtataagagtagtgatgctggcaattcggctagaccaacaagaagtcataaagtgcttcttttaagtgaaaaggtgagagttcttgacttaataaggaaggaaaaagatcatatgctggagttactaagatctacagtcagagcgaatcgtctatccatgaaatcgtgatgaaggaaaaaacattcatcgtagttttgctgtcacatctcaaatacaaaagttaaggccacagtgtgtgataaattcttcattaagatgtgaaaagacattaaatttaggtgaaagacatgaacagaaacttgttctgctggatgacagtctgattcagttctatctgtggtttcaggcatccactgggggtcttagactatattacccatggatgggaggagactgggagactgctgtacttttaggttaaaaaaaaaaaaaacaagtagaggattgtgtgtgtgtgtgtgtgtgtgtgtgcgcacacacacaagaagccttagcgtttttatcagtattgggatccagtgagtcaactgtttgataaggctgctacaggttgatttttattagcatgaatgggtgtgtgcctcagagcagaggtcacaggcaggcagtctgcagaccagatctgacccagaagtgtgtggggggtgcggggagggtctgcatagtttaaaaattgttacttaatttgttgcccccatgtaaaaattggcaagttcgcacagaaatctggatttacagtttcttatgaaaaatcacaggaccaggtggtcctgggtctccatgatttcctgtgaacctcgtctggagttgaagagaggatgctcctctgcataaaacctgtgccctccagctcactgtagtctccaccactcccttttgtctttcacatggaggttgaaggatatttgtcatttctggtcacacttgtgctcctagtttttgatagtggatttcagaggaaggtgagatattttttgtactccagtctctaaaaataaataagcaacaaatgatagacttcactctctcactctgatggagaattctgtatctttctaggccgtaagaagaacaataaaaaattgggttgtgctctgccaaaaagtgtctgagaggctgaggactcttgaaatcaaatcacaggagaaatgattgaaggaagtgtgagtgttaagcctattgatgagaagaaaaggctcaggggtgaggtggagagggagacatgacagctttttgtaagtctttcaagggccatcatgtagaagatggagtagctttgtgctttttagattccaagaatggaagttgaaaggtaccagttttagctcaatataaagaaaaagactgcagaggtagtgagttctttggttgagcttccagacatgtgatgttgctaaagatcctgactccaccttcctcaccgtttgaccttgggcaaattacttaccatctctgagcctagtttccttatctataaaatggggatggtaatgatacagtggaaacgtacttttctagagatttgttctaaagtcacagcaaacggcagaactaacaataaccaaactactccctaatccttgaaaatccccagtctcnctgggtcatccagattgcgccactgcaccccagcccgggtgacagagcgagactccgtctc

SEQ ID NO: 134543 - DNA, 929 bp, Homo sapiens
ctgcttacctccccacgaacttgcacatctccaatgcagaggagtcctttttccttaaagaagccaaccaagacctcacaaggaactccagtctgcaggcccgggtggagccattcttcatctaccgagccaggacaccccctattatcaatgccagctatggcccattttcagtggagaagataatcccccaggagctcctgttgacatctacagcctttggaaacatggacaaatttcccttcaactggaaattgaaatcccacatccttgacagctccatctactccaacagacccaaagtgcagaccttgttttatgtcactggcatgggctgggatgacagtgaccttacggaagatctaccctgtgtcaagatgtttgctttccctgaggccagggaagtggcagccagctgtcggctgcaaggggccccagggctgtgtgtggctgagctggagctgctgcccgagtggttcagctcaggcctggacctggaaccagaggaggagatcccagccctgctcgggggcaccacgatggagctcttcttcacgctctacccagctgacaaggctggccagtgtcctctggaggaggaaggcaagtgggagaacaatatccactcgggcctggagagcccccagcaagcgtttccagcccgagagaggattgggagtgtggtggtctacccaacccaagatgatctgaagtggtccctggtgagcttggacgagaatgtggtcatctcggtacctctgaatctagtccgggaaggggacacggccacctttttggtctctctgaccagtagctctgtggcagaccagttcactcttaggtaagaggctttgccaggtgggatggaacagaagccaactcttagtaatcaatgaattgtcaatgaataaaatgggtgttgatcattt

SEQ ID NO: 134544 - DNA, 372 bp, Homo sapiens
gctgggccgcatgagagtgcacgcatttatgctgtctgaaggtcacaatcacattaccatatcaagctgaaaatgtcaccgttatctgcagttagacatgttttattgggaatacatttttcctctctgaatctgttatgaatgcgttggttggctgggttcagtaataaatatgtgagacctttcatttcaaacaacaaaaacaacaaaataaaacacttttcaggtttctgttataagggaggagagactcagtcctgggagagcagccagcaaggtctgccatgatggccaaatgaaaccattgttcccctccatccatccccccacacctactccttctccaggcttgtttgagtagatggcaccccc

SEQ ID NO: 134545 - DNA, 318 bp, Homo sapiens
ggattctttgatgtcaagaagggaaaaataaaagcatttttccttcccctctgttgttttctacagcagaatgtgaacaggaaataaagtgagctttgctccctaaattctccctactgaaaaatgcaaataagagctgtgaaaaagaaaaatattgtcagtgaagaggaaggagactttgatgaaaacacattaacttgaaatcaatattctgagttttgtatctacaatccccgagcaactttgtgctcaactttatttttagaaacttttagtacctgaaagagtaggattatggcaagaataatggcaatgctt

SEQ ID NO: 134546 - DNA, 251 bp, Homo sapiens
atgttttgagttggcaatgttgaccagctactaaaaattgttccaacaattaaaccaagaaagaaacacaagtaattattaccttcaccatgacaatcaggtcataactggaggataattttaggatgacagtaacaaaaagaacaatagctcgcatttccagtgcacttaccataagctaggcattgttctaagccctttacatggatgatttcaattaagcctcacaataatcctatgggtagatacca

SEQ ID NO: 134547 - DNA, 511 bp, Homo sapiens
ggccaagtttgctcacttcacctgtattcatgctttacgactaaggaatcagtggaactgagatctttaaagcctgtggtatttgatctcacaaaatgcatctttcccaaaagataagtaattcctaaaaactggcagtgaagacaggtgtgtgcagggttccgtgggtctctagattccacactgtattgggcagccccatccaacccagtccagcccctcatgggtccagcgccttggtggtccagcttcttgatggctcatctgagagacatggcaccatctccctcagggtgcagcacagattggaggcttcttcctcattgcctgagaacttggctcatttacgaaattgtgggaaaactgaggagtgtggatttctccccttgattggcatatcggcatcaggaagcagtcaatttgagagcagaaggcttattctaacccaactgttagaattctaaaggagaaaaaataattcaatgaaagtgtttataagaataaagcaagt

SEQ ID NO: 134548 - DNA, 597 bp, Homo sapiens
tctgttatttcaaatcagctgaaaactattctttattctgaacgtttgcccattttctttacctgctattgttgtagtttctctcaactatcaccatctaaccttcaaagagaataaagtaaataaaagcagcattctctcttgggctgccagccccctctggattttctttatttcatgactgttaaaaaattatggctacaaacagggaaaagagaaagaaatcaggcttttcttcctcagtagagaccgtatttctattcaggcagatgagaaaaatctagatttgataggaataaaaataagggatttattttgactattctttttgattttatattacttaactttttataagtgagaaaccatatgtaaaatgttaaacaagtttcttggcaaatggcagatgtttcatatattatctcctttcatcccctttccacccaacactaaaacaaattgtaggaccgggaaagcaaagtcagagcatgaacctgtatttgtgccatcccaggaccctttagacaaattgaattttcattcttataccagtcagcatgaacaagtgcaatttactgtagccccttttctgtataa

SEQ ID NO: 134549 - DNA, 552 bp, Homo sapiens
gaatccagaatttttctagctgagaggcaatctcagtcaggcatggtggctcatgcctttaatcccagcacttggaaggctgaggctggagtatcacttgagcccatgagtttgagaccagcctaggcaacatggcgaaacccagtctttactaattttttaaaaaactttttgtagagatggggtctcaatacgttgtctaggttgggcttgaactcccgacctcgggatcctcccatctcagcctcccaaagcgctgggggtacgaagccattatgcctggcccctatttttgaggaataaattcaagatttttttttttttcttatgaatcttagacttctggttagtggcgtgaaaacagagtttttagcatttagttctggcaatattaatccatttatattatttgaaggttgtgctgtactttttaaagttaaatgtctaactttcgtagttttcatagcagtgataaatatttacaacaaaggatatggagagaaattattattttttttccttcaagtttgaattcatagaaatgacatattt

SEQ ID NO: 134550 - DNA, 415 bp, Homo sapiens
gttttcttagtgggacagttgcacaagtcattttcccctccttgatctcctttctcagctgtgaaatgggtcaataattaatatctaccatgcaggccgggcgcagtggctcacgcctgtaattccagcactttgggaggccgaggcgggcggatcactaggtcaggagattgagaccatcctggctaacacgctgaaatcccgtctctactaaaaatgcaaaaaaaagttagccaggcgtggtggcgggcgcctgtagtcccagctactcgggaggctgagacaggagaatggcgtgaacccgggaggcggagtttgcagtgagccaagatcatgccactgcactccagcctgggtgatagagcgagactccgtctcaaaaaaataaataaataaatatctaccatgcaaaagg

SEQ ID NO: 134551 - DNA, 526 bp, Homo sapiens
tattcattaatgccatcagcgggggctgtctctacacatggacgtgggacacggaatttgaaaccatgacaaataccaaatgacttttagctactgggccaaacccaataactcaaggtgtaactacttcatttaacagcctaatctcaagacactctacaagtaccacagatgtttgaacaaaatgcaaaaggaaagtacaattattacgattttgcacatgagaaaactaagtccctaaatacttgatacttcctcgagtaaggaagaatatcctggacccagatccatcaatggataagatccatcaacatcatattcttatttccatgatttgaggaggctgaaaattccattagcttctattagggcacaataatgagtgccaattatgaagcagagtcagtggcacgtcccattttggacgttagctgtgaattcctctgaattgtgcaggttgttcctgatctaactcagccaccgcatgggggtaagcacgggggcatctgctggagctctggtcatt

SEQ ID NO: 134552 - DNA, 626 bp, Homo sapiens
tgggagacttcactcttctccacttatttattcagttatttgcttatatcagtatggactaaatggatattttatgggaatatgtttttaatatggtggaaattaataatataaccagctcccagttgaagttttctcagattacatttttctttgaaacagaaatggagatgtttgttaagatccagttggagcatatgttatctcagattactcattaatagaaaaaaatctcagtcatatctggaaattacacaatctgccagggctcatgtgatagatacctgcctgcacagtatttaagagttcatgcacccttcttgttttgatagatacatgttttcatcactgccgttgttacttcctttctgtcaagaggtgaataacagtaggtggacaaagtttagggagccacatttaccaacttctgtgaatatacccaagaagattctggcaaaacatagattcaaattacagttgatgctgtggatggctatgggttaactactcttctactttgacacggattatttgttgcttttatgtttctaaattctcaattaaaaagaagtgtatccttaatctggccaactgaaagtgaacttgttcattcacctctaccttgc

SEQ ID NO: 134553 - DNA, 482 bp, Homo sapiens
taagtgggtaccatttgtatttccattttcagataagaaaactgaaacagatgttcagcgacttgcccaatctcagaaatctactaaggtgtaaagactgggttcccacccaaccagacggactcaagaacacacacactgcctctgcaccctctgctgccaatgaaaatgtgaatggaccagttgtggtggctcacgccttaatcccagcaatttgggagaccgaggcaggtggatcacgaggtcaggagatcaagaccatgctggccaacatagtgaaaccctgtctctactaaaaatgcacacacacacacacacacaaattagctgggcgtggtggcgtgtgcctgtaatcccagttacccgggaggctgaggcaggagaatcgcttgaacccaggaggcagaagttgcagtgagccgagattgggtcactgcactccaccctggtgacagactgggactctgtctcaaaaaatatat

SEQ ID NO: 134554 - DNA, 565 bp, Homo sapiens
tcattgtgtatttaattcagcccaagaatcaattatagtaaatatttaattcaggcatctttaagctatacaacccatgaaacttaatgttacgcatttcgaaaccataatgatatgatggtgcccaccttcattggaacatttttcaccgctgcttctccagtgtattttcttaaaattaaaagcttctgcacattggaaagagaacttcccttggagccagagcattataatcacagctctgtcacattctagctttatgtctcggtgatatgatgtaaccctagttcagtttcctcatctataagatggcaataataatattgtcctgtgcttcacaaaagtgccaagaatattaaatgacataatgtacatatgcaaaaatactttataaacagtaaacacaatttaagtgtatattgattcagtagaattgctgctctcgtaacacagattgcagctgatctgagtaacattatcaaatagattctagtgtctcactgttaaatgtagcgtctggctttctacaagagaaatgcctggatataacatctcagtgatgagc

SEQ ID NO: 134555 - DNA, 308 bp, Homo sapiens
ttaagagaagcatttttaaataaaagttcagcctgttacaaaattccctaatgtgagatacaggctggaatgaggcaattccacagagaaatcattgtgggaataattcacatctaatgtagtttcatgaaggatgctatttccagagtctaactttttctccctttttctctcactttttgattttattgctgtttttttttttttttacattaggagaaattgaaaacctgtttaggtttcatagcttcacatttctgaagcaagtgacacagcagagagttgggatgcatctgatttgtgcctca

SEQ ID NO: 134556 - DNA, 270 bp, Homo sapiens
tcggtgttcaggcatcttctgcatggggcaaacatccagaggagcagcagacatcatgaccagtgtaccacactcctgagagtgtggcatggtactggaccaaaagacagccaagggagcagtagtgaggggctttagccctaagtggggaaaaaagcccaaagaagcacagcaagatgcagacacccaagtttagccaaagtggtcaagtacttgttggcaactgagttgatgttgtaggtggagcctgagaagtggagatgggtgagt

SEQ ID NO: 134557 - DNA, 534 bp, Homo sapiens
agaaatattatatttcctttttgtttttgagactgggtcttgctctgtcacccaggctggagtgcagtgatatgatcatggctcactgcagccttgacctcccgggctcaagtgatcctcccacctcagcctcccaagtagctgggaccacaagcatgtgccatcacaactggctaattttctgatttgttgtagagatgaggtgtcacgatgttgctcaggctagtcttgagctcctgggctgaaacagtcctctagcctttgtctcccaaagtgctgggattacaggcataaaccaccatgcccagccttattaatgtaatgcatttgattaaaggaacctgccctagatcctgctaggggttacataatataccatatatggccctatactgcctttctaaaatctgaaaagttcttcattctgaaacatgtggcaccaaaggtttcagatgaaattggggacctttattttctaaatcacagaccccccccccaatagcttatcaacttttgttaagatatcaatgcctt

SEQ ID NO: 134558 - DNA, 303 bp, Homo sapiens
gttcccatattctacaatgttcatatgtaaaagaaataccacctgtcacacaggataaattccttcagtttagtagcttgcagttacatactatccaaccaccattatttatttcacaaaagccttcacacacaccatacaatggaatattactcaaccacaaaaaaggaatgaagtagtaatccatgctaaaatataaatgaaccttgaaacattatgccaagtgaaagaagccagaaacaaaaagctatatattatatgatttaatttatataaatgtccagagtaggcaaatctatagag

SEQ ID NO: 134559 - DNA, 343 bp, Homo sapiens
gacatgcagctggtgaacgaggcgccaggaacagctcttagacttatccactgtaagtgtgtctgcaggcatgtggaatgaatggccacacaaataaatagataaagaaactaactgtgggatgaatgaatgaatcttcccaaatgccaacttcaagctgccattccctgatgcaggacagcaggaaaaaaggggaagttgggtggtgggatgtatttttcatgtctgtgagcctcatctaattccataaaggattcagttcacactaaaatcagaaatgaaaatccagacaagaaaagccaacatcaacattaatcatcattaccagcacttagcatttgta

SEQ ID NO: 134560 - DNA, 227 bp, Homo sapiens
tgtgaaaccctccagttcctaagcttatagactctgtggacaggagaaggaggccagaagttaaagtgcatcgagaggtcttgttagtggaatggccactgcattcccttttcttttttagtcagcctggaatttggagtttgagctctgaggcagggagacctgggctggtgtggagtggagtggtgcagagttgtgcagttgtgagctggtgtggtgtagagtgg

SEQ ID NO: 134561 - DNA, 670 bp, Homo sapiens
aggcttgaattttttcccagaaagtgagtttttcttctctaccgcatgactgggctgcaaagttttcaaactttcatggtctgctttgctgttatatatagtgtctagtttttaataatctctttgttcacacatatgagtgtacactttcagaaacagccaggttacatcttgaatgttttactgcttacaaatttcttccaccagccttgtcctaataaaattaagttgtatcatttaaaaaaaacaaaaaaaaataaaaaaaaacaaaaaaaaacaaacacaaaaacaaaaaaaacaaaaaaaaacacacaacaacaatacacagaagaaaacaacaacacaaccacgccacaaacaagtcacccacgaatacaccgagacacaacacatgaaacaggacaaaggaaatagaaaaacataacgaatacagtgaacggccacgcaacacccgagagcaacacaaggcagcgcctggcacacaaacacagacagcaggagcaggcccgaagcgtggcgcccacaccagagatgacgaaacaaacagaccacagaagtcatgactaccccgacgacaacagccgctaaagtcgacaaaaaatgaaagctgctcccactaagcaacaaatgacaagggccgcgtcaaggcgcaccacggaccacaagccat

SEQ ID NO: 134562 - DNA, 190 bp, Homo sapiens
acaatgcaaacagctataaactggtgaatgcagaaacagaaggtagcactcacacacagtgaaccattactcagcaacggaaaggagctactgacatacccaacaacacgggtgaatctcagaagcattattctgagtcaaagaagccagacccaaagacagcatactatatgattccatttatagaaaa

SEQ ID NO: 134563 - DNA, 737 bp, Homo sapiens
cgcggtgtctcacacctgtaatcccagcactttgagaggttgagacgggcagatcacgaggtcaggagatcgagaccatcctggctaacacagtggaaccccgtccactaaaaatacaaaaaattagccgggtgtggtggcgggcacctgtagtcccagctacttgggaggctgaggcaggagaatggcatgaacctgggaggcggagtttgcagtgagccgagattgcgccactgcactccagcctgggtgacagagcgagactctgtctcaaaaaaataaataaatactaaatactactactggtactttcaggcaggcaacacccttaacctctaaacagaacgaactattttccccacatatggttttcagagcactaggaagaaacactgaaacagaaaggcatctgtttagaagcagaactttaactccttgtaaaacagcctgcccgtacctgtggccaaagcaaaagcaaacgggctaagtggcccagaccctcctaactctgcctgtctttcaagagaactcctaccatccccagcatgcagttgcttttgagctccctttgtatctcaaaatccataaaaatgttgagtaccacagatcgttctttcaatcatcagttcagaatacagaaacagaccaaaggcaatgcaaagacaatctataatttaaaaattccttgacctctatctgcctcgtaagtccatctagctaaaatgtacatttcatat

SEQ ID NO: 134564 - DNA, 281 bp, Homo sapiens
tgatgatggccatcttcgggaggtcacaagatttgtaacttccccagtcgctcctatagataacatcattattgtcaaatagtgtctaagattggtctttgagatatttttcagacttttgcattctgatgacagcccaaatgcacagcaaggaactaagtcataccaaggaatgaagtcaactggtcctgtgactactccccctcccctgaaactgactcagcacacaaagacagtttaaacactcttctgatttcatccccaaccatcaactgcaccca

SEQ ID NO: 134565 - DNA, 454 bp, Homo sapiens
aaactcaatcaacaaaggcggaagggaagtctaaaatggaaaactgattcaaaccaatgaatccaactgtatttcaaataaataacaacactgaagggggagatggggttaaaacaaaacaaaacaaaacaaaacaaatccaagtgacttatgaacacagaacttgaattactgcaggtgaggggtgcagtcccaatgagatgggggagaaccgcaaacaaacccggaatgcctgcgggcaggtttgcttctgtggtgtcctgggcagagcaattctaaagcttttttagacacatctcaggactgagtgagtgcacgtactaacggtgctgggagtcacagtttcagtaggaggaagacaaaagtctggaaagggaggaagtcaggaagttaactcatgattcctgagtatgcacaggtagacgtgtgtgtccatgagtgtgtctatacctct

SEQ ID NO: 134566 - DNA, 427 bp, Homo sapiens
agcgtgaggcggaggatgcacagagcgtgaggcgggggttgtgcagagcacaaagcggggaggtgtgcagagcacaagatgggggtggagagcatgaggcaggggtgtgtgcagagcacgaggcggtggggtggagagcaagaggcagggtgtgcagaacccagtggctgtgcagcgtagcaagataccagatacggtccctggcaagaagctgagatacctccactggtacagagataggctcacaaacaccgaacaagatgagccatttctcaaattttctgttttccaaaaataagaacaggaaggactcttccacagcatccagcctgtgcaaacctccctcctctgggcagatgggaccgttggtccttcccacagctggtcaggaggaccaggatgcggccaaaaccctctctcaccttcc

SEQ ID NO: 134567 - DNA, 664 bp, Homo sapiens
gtctcttagtataaaattaccatgttttaccactcagattatgcactgcacatctgtgaggataccattctcatagtctgtgatgtaaaaggaaccctgtcggttgtacaaatcactttgcttcttcaaggtttttgatatagccatagaactctttattttcacgaaatcttgtatagaaggccagcctataaaagaaataaaagtgaaactgctctgtttgaaacagagatgagagtttagagccctgcctgctcagtttccctctttttctatgcaatcaattgctgtggtgcttcctaggatccctaggattcctcagaagagttttgaagtctctagactagatcatgaatatagttctagccattcagaattctataatctctctggctgagtatcaaatacatccgtcgcaccatgtttggcactgaaagtgggtaggaatgggagccatggcccctgatctccaagagttgataatattgttttagaggtcagcagaaaatgggaagggaaaatgaacttaaataagatctcataaatagaaacacttattcagaaaagaagggctggggcaatgaagaatgactccctaaagacagtaacattggaatggagcattgatagaagagatgtggagaggcagaggggaaaagcagca

SEQ ID NO: 134568 - DNA, 449 bp, Homo sapiens
ggatcacctgaggtcaggagttcaagaccagcctggctaacatggcaaaaccctgtctctactaaaaatacaaaaattagccaggcatggtggcacacgcccatagtcccagctacttgggagattgaggtgggagaatcacttgaacccaagaagtggaggttgcagtgagccaagatcatgccactgcactccagcctgggtgacagagcaagactctgtctcaggaaacaaacaaaccaaccaaccaaaaaagaccagtgagccaaacggaataaaaagagatcaacatttaggcacataatattcaaaaagaggaatttttgaaagcagcaaaagaaagatgacttaccatatataagggaacaacaatatgatcaacagttgatttctcatcagaaaccatggatgccgtaaggcaggaagatgacatattcaaagctgaaagg

SEQ ID NO: 134569 - DNA, 855 bp, Homo sapiens
gccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcaagaaaggcaaggaccctgttgccgggccagctgccaaccaagggtttcacgggcattgtgtgggcctcatcggggggcactacaaatgggccaacgtccgggtccgggagttgttaaacggtgcttccaaaggatgtgtggcgggcaccgcacatttcctgtggtggcccaatacaatcccgtggccacaaaggctcttcccattcgttccccctgttgtctggcaagcagggcataacgtggggggggaaacaacagaatccggcgaaaggcccccaacaaatggtccccttttggcaactgtgtcgacagtgccagctgcaagacgcttctagttggtcttggttacgccctcattcccttgcaaaccccagggggcacagttggcattttcggtctctcggacaagcgttgttggcctaaaagaaggctgctacaattgactgggttgggtaatccgaatgacgtgtaacacccttccatgccggggggttgcaaatgtgccaccctgggcaacttcgccaaggccacctttgatgccatttctaagacctacagctacctgacccccgacctctggaaggagactgtatttaccaagtctccctatcaggaattcactgaccacctcgttaagacccacaccagag

SEQ ID NO: 134570 - DNA, 242 bp, Homo sapiens
ctagggtttgtggatatagtgatttctgccatcatgcaggttaccattgaagcagagattatagatgttaatcagaagtataatgagtgccaaaaaggttatatataactatatgtgtgtatgtacaggatagggggctggcaatatataaggagaggaatggcagtacattaagaggggaccctaacaggctggacagagttgatgcaatggtaagttctgagtagaggccattgtagtgt

SEQ ID NO: 134571 - DNA, 621 bp, Homo sapiens
  misc_feature (257)..(257): n is a, c, g, or t
tctaacctttctgttacaactgtacctctccttctgtactgaaagtcctggttttcaagaacacagggcacgatagaattagaacatcccacaattactcatttcttttatttatcttacacttacagctgtctcagaataacaatagaaatacaaccacaaataatatggcaattgaaacaattaaaaagttttcatttgcttttctcattctttcccaatttttttttttttggagatggagtctcgcgctctantcggggtgacagagcaagactccatctcaaaaaaaaaaaaaagaacaaatttgggtcaaccctaaggggttataaaaacacaacaacaacactcactattacgacatcggaaagagccggaaatccccaaaaattaaaacgacaccagacagaatcgacacccctattcgcgacaagggacacaaagacacccaaagactgagcgactggtgcccatgagaccttagaagaaacgtagagcaaacaccacacaagtggcaccacagtaaaaaacaacacacccatctagagggagagaccagatcacacaaggcacgagtacggggtggaacacgtgtatctggcccaaacgaaaggagcgaca

SEQ ID NO: 134572 - DNA, 385 bp, Homo sapiens
ccaatcaacatgacatctaacctctccaatacagaaaaaaaaatttcctcatttcaagcttttaaagttttataggatattagttcagatgtcagagcaaacagccaggcagtgctattccttgatgttaaggaagaatagaaaagcatcagggaaacgcaggtgagattgcctggacttttgatgggggtcagagaaggccagccctggtcaagccttccagtgacctgcacctctgtcacacttattgcagggcctgcatgctaatcatcagcaagccctgggcctgcctgcggtgacagggagacttcatcttgcatgcgactatgaataattcataaacatggttatctggaaatatgtggtcatcattagcattttaatg

SEQ ID NO: 134573 - DNA, 755 bp, Homo sapiens
gaagaattgtggaaattaaatcttttttcctttcagaggaagaaagatatgtcaggttttcaatacaaaaagaaaaaacgtatatgtatttattgaatgcttcattctggacccaaaattaaatacataacatcttatttaatgctcacaacattttatgaggcaagagatgagatgttcgtttgatatatgaaaacagtgactatactatcaggcaacctacagattgggagaaaatttttgcaatctacccatctgacaagggcctaatatccagaatttacaagaaacttaaacaaatttaccagaaaaagacaaccccatcaaaatggacaaaagatatgaacaccccatcaaaatggacaaaagatatgaacaccccatcaaaatggacaaatgatatgaacagacacttcttaaaagaagacatttacgtggccaagaagcatatgaaaaaagctcaacatcactgatcctcatagaaatgcaaatcaaaatggcaataagataccatctcacgccagttaagaatggcgattattaaaaagtcaggaagcaaatagatgctggcaaggctgtggagaaataggaacccctttacactgttggtgggaatgtaaattagtgtaatcattgtggaagacagtatggtgattccccaagaatctagaaccagaaatatcatttgacccagccagcaatcctattactgggtatatacccaaaggaatataaatcattctactataaagaga

SEQ ID NO: 134574 - DNA, 377 bp, Homo sapiens
ttgcaggttctgtcatggatccattcaataactaactggtttagatcctggttaagaggtttctcctctctctttccccttaactacaccacaatgtcaaataagctctagcttaggcaacaggggatatcagtatattcttagcttcctttcaagaggagaaggctattccagcctttggctttaagcagtaagcatagctaatactcctcttatggaacatttttagtccttgtttacccagaggagggggaactttgagccactattgagtgctcatagactcagagctttgcaggtccacagcttatatccccattcacagccttgtgtttcttctcatcttcttgtgacttagcctttctaaataaaaagta

SEQ ID NO: 134575 - DNA, 416 bp, Homo sapiens
tgagaacaggaatgttgtctttgcttttcattgctgtgccccctgtaattacagcagtgattatttatttatttattgggtatctcattgtggtttttcttttgttacttatttattttattttattttagattcaggaggtacatgtacaggtttattatgtggttatagtgtgtaatggtgaggtttgtgcttctagtgtgttcatcacccagacagtgaatgttgtacccaatagataatttttcagccctcatcttcctccagcacttcccctttcaagtccccagtgtctattaattccatctttatgtccacatatacccatcatttatgtcccacttagaagggagatgatgtggtatttgactttctgtttcggagttagttcatttaggataatgacctccagctcc

SEQ ID NO: 134576 - DNA, 701 bp, Homo sapiens
tgactcaagggtttaaaaccactgatcatgcattattgtacaaataggctattctgccccaagggtgactcctgagaagctagtctttaaaatatcatcacagacatccctgtggatgtggaagactgtgcattctcaagctgtaccttcttggaagcaatgagagagggatgaaatatgctacacattttgagatcctcaccaaatgtgggaccagaaaatgaaaactttctgatatgtgctatcagcctgcacaacacacatgcatccagagacaaaaggtaaaaatataactggtaattaaacataagttttgaccagtaagtggcttatgccaatccaggaacacatcctaggtagcagagcaaaaaaagtaaaaacaaggagaaaggggggaaaaacaaggggaaaaaaaatctagcagagatatgagaggctaaacatagttaaggaaatagactttgagaattagttcagtcaagtaactaaacaaataaacaaaatggccaagtagacaacagctaccacctgcaggggatgaataacgagagtcactacaatctattagcaaaatatcaagttttaaagaaagacaattataaagcattcaaaggaacaggaagaatctaacacacacacacacatacacacacatcaggcagtagaaacttcctctgaaggtggaattagtaaataaacat

SEQ ID NO: 134577 - DNA, 394 bp, Homo sapiens
ggagggtaaggaaactgaaatatgacaaggttaaatgattcagatgaggggccggaaagcacgcctcccgagacccattcctggaagcgggtctttaaagctgctctcagtttaaaatcaaccaaatgctcagatatcagatgcggaaactgaggcacagggaatttgaacaacttgctcaaggtcataaagctagaaggaggcacagccaagcatgggcttgtgtgacctcaaagcctatgttctcgccactgctctaaactgtttattctgttggcttgtcataatgattgaagacaatgtatataaatcacagagggtaggactcagcttgtaatatgtcctccatacattttatcgaacattattaattaataaacaacagataaataac

SEQ ID NO: 134578 - DNA, 182 bp, Homo sapiens
gtgctgaatacttcttgaataaatcagaaaatgacttagatgtaaaagtaacatctttgttgcttgattcaacatagcttactcatttcattggtccagttatagattctgttagatatgagttctaaatttcttttcaaagaatcaatatgtcagtatgttcaattctttgccttctactt

SEQ ID NO: 134579 - DNA, 815 bp, Homo sapiens
gtttattctgagttttgctaatacagaaagaaacattttgtttgtgaagtgatgttggccttataatgcatagcacctgaattcagtatattgccatgatatctttttctaaaccatttgtgttcatttgagagctgattaagtcctttgctttttttcttttttgagacagggtctctgtcacccaggctggagtgcagtggcacagtgacggctccctgcagccttgacctcccgagctcaagtgattctcccacctcagcctcctgagtagctgggactgtaggcgtgcgccaccatgtctggctaatttttgttattattttttgtagagatgaggtctcactatgttgcctaggctggtcttgagcttctgggctcaagcagtcctctcaccctggcctctaaatgtgctgggatctatagccctttgctttttgataattcctgtattattttttggaaattatccattctgacagaaaagagcctgggtggagaagaagagaaaggatggtaaacatataacttacaaagtaactattaagataatattgttgggattaaagcaaaaacccatagtgagttatgggtatttgtaatgaatattaacaggaaccctgaaactaatctgttgagtcctaacaggaggttcaaaatgacaatatcaaacaatacctttttaaacttttatgttttaattttttttgtacagacagtctcactgtgttgaccaagctggtcttgaactcctgacctcaagcagtcctcccacctcagcctcccaaagtgctgggattacaggtgtgagccac

SEQ ID NO: 134580 - DNA, 561 bp, Homo sapiens
gccctgaccgtgtgacttggagggcacaggcaaccaggcagaagcatccccagcaccactctcctgtcttctgccctagtttactacaccagtgtagcctggggcatttttgtcccagacctcctttctgcccagtgttttcctaagaaatagttactactgggaaaaaaagtcataatatccctgaatgtctgctttacagaagagatctgtggtctcaagcaggtaggtcctttaatgcattgtattttaactaatctattcacaatatgctctaattagtgttactactctagtaaaaattaaactagtaacactacattttatatggtatttgctacatggcaagcactgttctaaacactttgcttatgttaacccagttaatcctcacacccactttacaatataggttctgtcattggcctaaggtcacagagttagtgagaggtcatactgaggttcacacccacaatgcttggcaccagaagtcagttctcttaacctcttcttacataatgcaatgcagttgaattgcaaacccatgactttttcttcatg

SEQ ID NO: 134581 - DNA, 305 bp, Homo sapiens
gtcttagtatttaatcctcatgacaactttatcagatgtgtagtactatctttatattatggataagaaaatataggctcaaagagagtaattaacttgtccaaggctttgtcaatgaaatgctggccatagcaatattgggcagctttgcctctgtgccaacacccgtgctgctctgaccagactcccactgaagtctgcttaagctgctgctaagaccactttggatctcacaatctagcctctttcaaggggaggcctaaacaccatgcctcacatccctgtttgtttcagtcactacccgc

SEQ ID NO: 134582 - DNA, 836 bp, Homo sapiens
ttcgataaagaaaatatggcatatatatataccatggaatactatgcagccacttaaaaaagaaagaaatcatgttctttgcagcagaatggatgcaactggaggccattatcctatgcaaattaacacaaacacagaaaaccagttattgcatgttctcacttataagtgggcactaaatcttgggtagacatggacatacagttaggaacagtagactctgggaactccaaaaggtgggagggagagaaaggggcaagagctgaaaaacttcctgttgggtattacgtccactatctgagtgatgggatcaatagaagcccaaatttaatattatccaatatacccttgtaacaaacctgcacatgtggcccctgaatcaaaaataaaaatggaaatttaaaaaataaaggtaaaaaatttaagatgctgtattaataaacactctcaacctgtacaaaaattttaaaaagggttagatagattgtattatttctatttaacgaacatttaatttgatattaagaagataatgctaaatattactttaataaggaaaaaataattcaataatcaatgtaaaaatccatatacaaattactcatagtgaataaatataaaacatacacctgccaacaaacacacacacataagaaactggacagggccgggtgcggtggctcacgcctgtaatctcagcactttgggaggccgaggcaggcggatcacgaggtcaagagatcaagaccatcctggccaacgtggtgaaacccgtgtctactaaaaatacaaaaattagctgggtgtggtgatgcatacttgtagtcccagctact

SEQ ID NO: 134583 - DNA, 441 bp, Homo sapiens
ggtcgcacttctgcacccaggcgcacttcggcacccaggcgcacttctgcacccaggcccacttctgcacccaggcgacttctggggtgcatgcacgaggggtcttcctgctgtagggcaggccagatggggctcaggctgtcggggcgctcacacctggcgctttggctgtcataggtgcggctgactgcacagaagtcactggggcctttgacttctacacactccctgtggggctccgcactgtgcccgtcaccgagagccagtgggtgagagccagtttcatttgtggtagaggcagcagaggttgtagaaatgctccttgaggcagatgccacaccccagtttcatggagtgatttgggctgagccgagtctgcagcaggcagaaggctctgagatgttgtcctagcctgggcagaggacaattcagagctcgggg

SEQ ID NO: 134584 - DNA, 533 bp, Homo sapiens
catcctataatgacctctgactctttctgcttctgcttaaccttcacatgtcttgtttctcattatttcttagtgatccagacaaggaacccctttccttatttttttccccaaattactcacataaggcgttggttgatgtgacaggctttgtctaattctgggagcaaatgggagggagtaattttgtacctatgtaaaaacaatttagaattgaatattagacatctttgaacttaaatgtcctttatccattacaaattttttacaggtcaccttactcttcagggttccaatacgctgcttggttaattctctcttcccttcttccacccctttcacctttattcattaattcattcacccattcactgatccaacaaataagcattgagtgttttccctgtcaggtgctggagacacagtgatgatcaacataaactcacaatacacagtctagggaaagagaataaaatctcaagttttcagtgcaattgttagcttaatttctgtgtggcatgtattctaaaaag

SEQ ID NO: 134585 - DNA, 215 bp, Homo sapiens
caggtggtggtaagagctttgaaagaataagcaaggtaactaactggtcagaggaagggagatgggtgcattccctcagatagaccgccccagaggtctgcctctctgacatgacatttgagcagagacccaacaggaaaaggaagaggctgctctatggccgggtacggtggctcacacctgtaatcccagcactttgggaggcccaggcgggc

SEQ ID NO: 134586 - DNA, 428 bp, Homo sapiens
ttctcttaactctgaaagaaggagttaatgggtattagggacatctagcatctcagcctgcagccagccccctaccaaggttatctccttctaacttcagttgatctgtgctaagagaacacatgcaaattcttactatcatttaagaaatgcataggaaaggccgggcacggtggctcatgcctgtgctgaggcgggcaggtcacaaggtcaagagatggagaccatcctggccaacatgatgaaaccccatctctaccaaaaatacaaaaattagctgcgcgtggtgccacgcgcctgtagtcacagctacttggcaggctgagacaggagaatcacttcaaccccggaggcagagattgcagtaagccgagatcatgccactcactgcattccagcctagggacagagcgaaactccgtctcaaa

SEQ ID NO: 134587 - DNA, 652 bp, Homo sapiens
cacagatctgtttctgaagtctctgttttataccattggttatttttatctgttaataggcaactgccacactgttttaattgttataaatttcttataaagtttgatatcttatcctataaatcatatttgtcatagatattcttgacacttttcttgtacaaataaatgttagaaacagcttgttttgtaaatagctttttgtgattttggttagaattgcatttaatcttagatcaatttcaggagaattgacattgcaataatgttggggttctccattcataaatatggttatcaccaattcatttagatctttttaaatgtacttataaagttttgtaaattttttcttaaagaacttgcaaatcgtatactagaaatggcattttaagccttcaatttcttatataacaatcgtataagatagcaattgattttttaatcaacccttttttcttcaactttgatgtgctttttattaattccaatggtttgaaatattctgagattttccacttaaattatcttgttgtctgttaaaagcaatggttttggccgggcacagtggctcacacctgtaatcccagcactttgggaggccaaggcaggcggatcatgaggtcaggagatccagactatcctggctaac

SEQ ID NO: 134588 - DNA, 561 bp, Homo sapiens
  misc_feature (136)..(136): n is a, c, g, or t
  misc_feature (144)..(144): n is a, c, g, or t
  misc_feature (153)..(153): n is a, c, g, or t
tgacagatacgatcgagctcggaccctagtttagaagttcaatagcaataacaagcaattctttctcctggggaagaagacactgagtcgaggaactaataactaatgaattttttttttttggagatggagcctngctctatngcccaggcnggttaaataaatgtatgtaggtgttatatcacacccctgaataattcctccgaatcggggtgggggtgtcagtcatctgtactccacccagaagtcaatgccacattcctgagtctacatacccgtgaaatgataggaacccatgtgcccataaggtcctggaggggaatgcaaagttggtcaagacatgggagctagacagcaaggaaaaggaattgcaaagggaagttagtagttaaataagttaccacatatccatgtaatataatactaagatagacaaatgcaaagttgtagaaaatagttaaggaatattttcaagatactgtatcagagaaatcactttacaaaacaggttgaacaatacaattatatctacgctattggaagttctccactaggggttag

SEQ ID NO: 134589 - DNA, 220 bp, Homo sapiens
gaaagataagggaatactaaaaacaactttgtatacataaatttgacaacttgaattggaccaattcctcatccaatatgaactaatatgatgagtcctataacttaaggcaattgaatttatgattaacaaacttccaaagaagatttgtccagacccaggtgatttcactggagaattctgccaaatgtaaaagaagaattaacatcaattatacaca

SEQ ID NO: 134590 - DNA, 303 bp, Homo sapiens
tgaaagctagtaaaaacttatactactttggttaagtttttgtgtggcatataatcatcaatagaaacatagaagtaacattaactgtcccatttttttattgtctccctgtataaactatcattttaaaaaatccaactgccagcatgtccaatttctccaaattcttgaagcaaataaaataatgataaatgctgcattcaactctaagacatacaatgcattgcttttaacgtctctgatcacggtggatttacaactgatgacaggtctgagtctaacaggcagtgctttctttctttc

SEQ ID NO: 134591 - DNA, 241 bp, Homo sapiens
tgttaagcgccatctgttcatagtagccgtgcactgcctcatctccctgtataaactatcattttaaaaaatccaactgccagcatgtccaatttctccaaattcttgaagcaaataaaataatgataaatgctgcattcaactctaagacatacaatgcattgcttttaacgtctctgatcacggtggatttacaactgatgacaggtctgagtctaacaggcagtgctttctttctttc

SEQ ID NO: 134592 - DNA, 542 bp, Homo sapiens
gtttaagtatcatattgtcagtactaaccttttgtttattaggacataagacctaagaatctagacattaatctgatgtgattgttctgtttgttatagttagcctgtactccctttttttgttctttgtacttcccctttcattttgagtacatatatgtgtcatttgtaactgcagatttttccaattattcttcctcagtcttttcctttgggtaagtaactcagcatacataattcagccacctggtaattgtaacgccaccatctctccactaaaagaactgtagtagcatcaggctaaatagcattaagttatctaacacattacagtagagtaaaccaattccttcaggtatacttttctcttccatttttggcttctcactctcttttttttgtttgtttttatagatgggtcaatgcccattatcactctagatggataagggagccttaattatatacttatatttttgcactgtcagattggagtggggtaaaaatgtttcttcttttatgtctaatactctttttttttt

SEQ ID NO: 134593 - DNA, 712 bp, Homo sapiens
caagggcaggagttcgagatcagcctgaccaacatggtgaaaccccatctctactaaaaataccaaaaattagctgggcatggtggcgggcgcctgtaatcccagctactcgggaggctgaagcaggagaatcacttgaacccaagaggcagaggttgcagtgagcgagatcacaccactgcactccagcccaggtaagagtgcgagactcgtctcaaaaaaaataaatgaatacaccaaacaaaaataaacaaaaaaaaagtagggaatacaaaataatctcagaaggttacattcaaagttaaaaatgaaaataaatactaaaaaaaatttgtaatgaaaaaggtggtgtggtcattagagaaacgcaaatcaaaaccacaatgagataccatctcacgtgagtcacaatggctattgttaaaaagtcagaaaaacgacagatgctggtgaggttgtggataaaaagaaacatttatacactgttggagggagtgtaaattatttcaaccattggggaagacagtgtggcaattcctcaaggacctaaaaaaaaaaaaaaaaaaaaaaaaaaaatatgttctgggcgccatgggcccctaaaaaaattttttaaacacatctgtttgggcgcgcggccccatgtgtaagtgcaccgggcaaggggtcccaagagacacccggaaacaacggggggggttctcccaattaa

SEQ ID NO: 134594 - DNA, 365 bp, Homo sapiens
ttcaggtttcaaaacaaccttatgatgtaggcgttttcccattttatgaatgaagaaactgagggatacagagtttaagtaatttgctcaaactatacagctagtgactgccagagctcagttaagcctttttgtttagtgcctggggttttgggccaggtcctaggcattttggaaaactgaagagagaactaggcaccacagagctgggctaaaggagctgacactgtggtgggattcctaatagaaccctgtggtttgctggcacagggccctctacaggcaggtggggtaagagctggggcagataaggaaagacaccacagtttaacatctgatgctcagctcagagaggagacctctct

SEQ ID NO: 134595 - DNA, 368 bp, Homo sapiens
caacagagtgagactctgtctcaaaacaaaaacaaaaacgaaaacaaaaaacaaaacaaaaaaacaccaaaaaacaagtaaggggggcgggatgcaaaatgcttggcaatcccaccccaattcaggcaggactggtttccccaagagattttctgaggcagccagctcctccgtggcaggacttgccatggtaaagggtagggccgggtgaggcaggggagtgggggctggggatgatgtgtaatatttccatcggcaaataacaagattcccacccccaaggatggaaagtattaagtgtatcgtctcacaaagcaggaagcaaggctggcttcccggctgttgattcagcggctcagtgacatcag

SEQ ID NO: 134596 - DNA, 128 bp, Homo sapiens
tggtagtcactagccacatttggctcttgagcacttgaaatgatgcaagtaaaaccgaggaactgaatatttaattttttgttgttgttgtttgtttttgagatggagtctcgctctgtcgtccaggc

SEQ ID NO: 134597 - DNA, 361 bp, Homo sapiens
acagtctctcaaacactaaaataaatttgtatgcatttttattgtaattataaaaccaaaatttttctgaaatttgactctgattgctttatacttcctgaaattacctctgcaacatcaaaatttatttaaagcaaagtactgtcacctttaatacactactgggatgaaaacataaaagcgtattctaaagccaaaaacaaacttttaaagaaatatactagctattatatacaaaattatcaaaatatgagtacagatacataacaaattcttgttgaagttgaaaaaagttggttactaatattaacagttcaccagttactttttattatggcctctgaaccttgaattaccttca

SEQ ID NO: 134598 - DNA, 449 bp, Homo sapiens
ggtgcactgtggtgccccagtgcctggaacagtgttggctgcctggaacagtattggtgcacaatatgcagtaggcattcaattagtgcttgctgaatgagggagcctcagcgttttaaaatcagaccttgaaaacgttgcaaagttcttagaatcccaggcttgaagaattggagactgggaggcagtgaggctgggtgagtctggaaggctgcgggcccatctgccccatcctggtcggctgtgtgtgtgtctctctttttgaatctgtctctgtctttttctctctctgtcactgtctctttctgtctctgtcttgtttacctccttctcattgtttctctgtgtgttgtctgtctctgtttctgtctctctcttttctctgcctcttctctcctctcctctccccacagcttccttccctgcccccctcctcctttcttcctctc

SEQ ID NO: 134599 - DNA, 771 bp, Homo sapiens
  misc_feature (5)..(10): n is a, c, g, or t
  misc_feature (12)..(15): n is a, c, g, or t
aagannnnnnannnntgtatataaaagtagtctttcataactgtctgtatttctaagttaatatataagtttatctagataaaaaatacttaagaaacataaaccaaaatattttatgaaattgtttttatattagctaagtataaatttattgctgtataacaaattaccacttggtggtaaacagtgaacatttatcttaacagtttctgaggttcaagaatttaggagcaatttacctgagtgattctatcttagattctcttataaggctatatttaagattttggttatagttgcagtgatccgaaggcttcactggagcaggaggacaagcttctaagatgactcacttacatgccactgcaggagtcctcagtgtttcactggcttttagcagagtgcttcattccattgccacatagacctgtttttggtgttacttaagtgccctcacaacgtggcagcttcctttttccagaacaagggtaaagagataaagactgagccacaatgtcatttataatctagcctcaaaagttacacacagtgttttctgtttgttgagcaaataacttctattcagtatgaaaggtgctttacagggcatgaataccagagatggggatcgttggggccatcttggagactagctaccacgttaagaataaataatacttcttaaattaagcatttttatttcatattacaccatgtcagaatgcatttaggctttactcagtagcctgcagaccggaaaatttcaaaaaa

SEQ ID NO: 134600 - DNA, 866 bp, Homo sapiens
taaggtctcaactgtatgtcttagaattcctgccctacacccctctatccctcaggcacgtgggattcccctacccactcctgtctgtctagtgtttttatttgaaccacatacactaacaagcgacctgtgaagagtgtttctacctgttcttgatgggaggatgctatacctatgccagcattttctgaaaaactttagagctctcagctagccagaaatggactctgccctttcctgtttcaaaggtcagctccaccagcctgagctgcccactcagtttgtttcctgttagagggacaccctcagctctcagctcttttaaacagcaaagatgacagacatgtcctgaataattgaactcaaataaccttccctctttatttttccagaccatttcctggttagtcagcactcaggtctttctaagggggagagaattctccatagacccctaattacatatttacagtacttggtgtttcatttttgcaataacatctagtagggtcctttttctttatatagaaaaacatgaaaaagcaagacatttcataatcactggttagttaactttggttaatttttttcaaagcacatagtaagaaaattcaagcagtttagaaaagtataaaattccatttactaccactgtagtcccttacccaaagataattactgctactgttttcttgtgaatcttgggaaagtaaattttgtaagtatacatgcatacttccatattgctgctccgtgtagcactgattcattataatgctatttgactataaaatatttcgtacaaaattattcatgtacatatgccagtccataataattcactcttattttgcccatcctaagga

SEQ ID NO: 134601 - DNA, 328 bp, Homo sapiens
tgagtaatcaatattgtggaaaagtgctagagcagacctaccttatataaattaatttgtttgaattgctctattcactatgaataaatatttattggagtaccttctatatgctggggacctcagccatgagatacgcaggtggaaaaaataacacttaagcagcttattgtatagcagagaggtggttgaattgatagacaattaaaatacaacgtgttgaaaggcctgttaaagccacagggtcactcagtggcaggagggattcagtcagcctgggccagccatggcaagtaagtggcctttggaaagttaccaaggtaagaca

SEQ ID NO: 134602 - DNA, 265 bp, Homo sapiens
attaaagagaataaatcagtgaaggagaaagaagaggtacaataaagcaacaaaacctaaagttggttttttgaaaagattaataaaatcagtctgggcgtggtggctcatgcctgtaatcccagcactttgggaggctgaggcgggtggatcacttgaggtcaggagtttgagaccagcctggccagcatggtgaaaccccatctctaccaaaaatacaaaaaattagctggatgtggtggtccacacctgtaatcccagctac

SEQ ID NO: 134603 - DNA, 475 bp, Homo sapiens
tgatagctgtgaagaggcgctctgctaagtgtcattgaccttagaatccacaaagctctggggctttggagacttagaactttattttgctagatttaaagtgtactcttctcttaacgtagaattcatgtaaaactacatcataagacacacctatcaacccagcaggctaatttattcaagaatcaactgacaggcagaccagaaattttttgtcagtttggtaagtgtgaaagtaaagccaaattattattatttaagaactattacatttattcttaatagaaaagtagtatggttattttttaaaaatccaatcccaatatgtgcgagtcctttctcattccaccttatgagataacaaatgttagcagcttagtctgtatatattcttcccaagtgtctgtaattgcaataagctccattgctctattgctttatttttctgtagttctctagttatgttttgcactcc

SEQ ID NO: 134604 - DNA, 430 bp, Homo sapiens
agctgtggatggagagaagctgcctggcacaagaaaaactagcacagcgggagtcactgctgcaaaggtcaagtctgaattggtcttgccaatctgcactgctctctggggaagtcaggttgttgtataaaggcttgaagcggaagtttctgaagcagtcaagataaggagggaggaacacaggtggtgagaattgaagatcagcttctaggagaaaaggaaatagctaagccttcggggtcagtcatctctagtactgcacactcagctatgagggagatatcaggagaagagagaaaggactctctgaatacaagtccttgcgggctggacaaagtggaagctgtcagcctcccatggcgtcttgcttaggggagctcgtaccttgtgcaagactgagggccttggcggggaccagtgctgttctatg

SEQ ID NO: 134605 - DNA, 231 bp, Homo sapiens
caggtgatccacctgcctcagcctcccaaagtgagatctaagtctttaatccattttttttatggcaagaggtagggttctagctttattcttctgcatatggatatccagttgtcccagctccatttattaacgagactgtcctttccccggtgtatgtgtttgacacttttgtagaaaatgagttcattatagatgtatggatttatttctatgttctctattctgttc

SEQ ID NO: 134606 - DNA, 738 bp, Homo sapiens
gctctgtgaaaggtgttctgttttttcacctagctgcatctaaaatcaattgaggtcatagatggaatgtaaataaggaatagtgtggatggacaggatgggaagccagcagtgcactgttgagttatatcatattgctaatctgttacatagtggttttattttattcctacagctgtacttctagtgtacttaattaggtagtgcctaagtgcccatcatattcattttctaaaaaagtttgtctgcatgtaaactgttgtagtttggataatgtactttaaaatatcttccccagaaagcttaaaaatgacttccctaaaaattttcataagtgctaataaaatgaactccaatctattttcaagtcatacccttcggttcttttctgcttcacttagacaattatatttaatcattataaaaagatggagtccagttccttaaatcctcatcttcttagaattcatatttgtaagaattctaaatgttgttaaatagagtttgacatggtatcattgttaactagtgaatacaaatacttacataaatagaatatgaaattttgatttaatacaatcaattctattcaacaaacaatcttgccagacataacacatactctaaaatcaactacacaatctgccataaaagaatcctcagcaaattaaaaaaccaacatcatatcaaccacattctcagaccacagaacaataaaaatagaaatcaatactaaga

SEQ ID NO: 134607 - DNA, 364 bp, Homo sapiens
attgacattttatatcccctccaaaaaagggcagctcgactcccttaaagaaaaactccaccgcggcaagttaaggtttaatcctgccccctacaccccaccagccacatgctcaccaactatcatctgcaggattccgggagctgtttgttctctcatatctaacagagctacacagggaagtcgagaacccaacatataagaaaggtttcacagctgttgttaaccctggctatactttaaaatctcccagggcactttaggaaacccccagaggttctgattcaattgcagccaggtggggtcttcacattagtatgttttagaatccaggtaattccaatgtgtcttaaaatgacccatc

SEQ ID NO: 134608 - DNA, 416 bp, Homo sapiens
ttctttctcttctctttttccttccttccttcctcccctctttccttccttccttttctttctttctttttcttttctttcttccttccttcctttctttctgtctttctcttctctttttccttccttccttcctcccttctttccttccttcctttcttcttctttttctttcctttctctttctttctttcagaactgcaagccagatggaatgactgaacagtcccagctcggccttactgcacctgatggccccaatagctccaggactatcttgcctcgcttgttcagcccagagccgctcccctacttctcctcaggggacatagatggggcaggtggcctgggagatggcacactctctaactggccctctctgagtccctgtcacaccctcagccagtggtgagggg

SEQ ID NO: 134609 - DNA, 189 bp, Homo sapiens
tttccagggggacattttaaaggagaagtagatttcaagtaaatgattgcaacttatcgaaaataatgtgctacttagcatctgcggcaaacatcctggcaggcagcgagaggaagcagcactggagcagatgggagtgattaggctctgattttcagacgggcttttttgtggtggttgttgcctcca

SEQ ID NO: 134610 - DNA, 281 bp, Homo sapiens
atgaccatgcacttgcagttaaagaaaaatcccagtttcactcaagaatgacctcgatgaaccagtaagaaaagatatttactaaatcttgacccttgagggctgcatgtcttttaaaaaataatagctttattgggatataactcacataccgtaaaactcactctttatacaattcactggttgtaactatggtcatagagttgtacaaccatcatcactatctaatttcagagcatttttattacctcaaaaggaaacccataccctttagcagtcac

SEQ ID NO: 134611 - DNA, 380 bp, Homo sapiens
gatgatttaaaagatttaaaatcacttcctattttgaaatgatttattgtgatcatagatttgaaattttaaaaaattatgtacctgcttgtagaatgaaaagtacacaaccttataaacaagctgggttttttaaaaaatttccactcattttactagcatttagaatctcaaaaactgggacctagatttagccagaacccagaaaactgggacctaggatctagccagaacccagatttaacctcactgccatgcctcataccctatagcagccactgtaacctacaaaagcaagtccaggtgcttcaaccataacacacacagaccggggctggccctttaccactatccatcattgtctcccagcattccctgtc

SEQ ID NO: 134612 - DNA, 376 bp, Homo sapiens
agtggaaggattttagaggaagggaagacagaaggggattattgggccagattaagggatgtttacagagttaggaaattcagagttccatggataatgggtcagaggagagggctggacatctggggcgattgaggcaatgggagggaagatgggattcattttgatggtctctaaatgaacttgtactaggtcaatgtttcttgaattaggaaacccacaagactacagccacatgctcaggggaccagagtgtactaatgaatttttaaattttggattgtaattttaatgataatctaaaacttgatttcagttcccagattagtttatgttaatttggaattgttaccatatagtgctattgaaacttcta

SEQ ID NO: 134613 - DNA, 498 bp, Homo sapiens
acccaaacaaaccggctgcagctgtataaaagtacagcacgtacaacagtgcacagtacataatatgtgataatgataataagtgactatgttattggtttatgtatttactatactttttatagttatttaagagtgtacaccttctacttattaaaaaagttaactgtggccaggcgccgtggctcatgcctgtaatcccagtgctttgggaggccgaagtggctggtctcaaactcctgacctcagatgatccgcccgcctcagcctcccaaagtgttaggattacaggtgtgagccaccatgcccgactctttttaattcttaatgtggctacttgaaaatttaaaattacagatgtggcttgcattctgtgttggtaagctgctttagagcatttcttttaacaccaggagttcttcccctcatcatctttttggctgagtcgtcactgcagcgctcatagccccgcatgtacctctccagccagaaccctta

SEQ ID NO: 134614 - DNA, 518 bp, Homo sapiens
acagggtcctgagctaggctgccccagcacgggcttgtcaccaaggctgccagggatgagtgagcgcagctgggcgcatcagcccctcctgcttgcccaccccagcccagcctcccagcgcaggaggagcatttagagcacctactggtttatgccaggcactttccagaatcttctcatttaatcttcgtcatcacctttacagccagacacttcctccttttacagatgaggagatgggggctaggagggttgagtaacttggttccagcactcagaagtggccaagtctgagtgtcggcccaggtcagcccagctctggggttcctgcagggcctgccgtggtgcccgtgctgcggtgcccgtgctgcggtgcccattctgtgccacacccttcttggatttgggctgcgcacaggctgcaccgcaccacctgcgctgggttgtgctcaggctgggacagatgtgtgttgctgtcccctgccatggactatctataggtgcagcaagatcctgcc

SEQ ID NO: 134615 - DNA, 395 bp, Homo sapiens
ctgcaaacctgtcgctacctgagttttgcgtgtttctctacacgcagctttgccaggtagctctctctgctacttctgtcccttcgagcatggcatggaagcagtagaaagagcctcagccttccttggagtcttgccacttccccagaatgccactcacgaagcagaaggcaggcttctctccctgggccctgttgctcctctgctgttaccagctcccctcaggttctccacctgctcccagcgtggacatgttcccctttctggagggaagccctttctcccctcacaccatttttctccccagtccactctatttcactcagcagtctgggctttagaaaaccggtaagagactcaagctatttcttccttcatcttatttcatttctcct

SEQ ID NO: 134616 - DNA, 172 bp, Homo sapiens
tataacattatcctttttcacaggtaaggaaattgagactctgagatattggataaggttctcaacaccatataagcagtgagtgctagagctgggattggaaccagttttgtttatcttccagtctttgttcttatccatcttactatgttctctctctctggaagattta

SEQ ID NO: 134617 - DNA, 474 bp, Homo sapiens
aggttgcagaggtatccaacatatctgtcatcattgtcttcattatcaacatcatagcaaagatttgctgcatggtcattacatggcagacacttattccttataataatctcaggacggagtttctattctcattcctattttgtagatcagaaaactatagaagaggttcagggaagttaacttgtccaagatatttgtttcacctggcatcggaaccaagatttgcgttattccaaagtgctgcccctagccaccatgctgagatgtgttcagttcccacaggtactgtagtcaacatgccaacacacttaatgcagttaaaatttggctcgtgtgtagatttaacagcctacagtaaacatttttttcccttaacttttccccagtatcttgcctaactggcttatgtagttcactagctaaggtataaccgcctgtaatttatttgtttctttttcccaactttttttt

SEQ ID NO: 134618 - DNA, 395 bp, Homo sapiens
ttattttctcatggtcatacagaggaacagagttaggattcagatcaagagttgaccgagtcttcctgttccaaaatatgaagcctgaccacatatacccagtgttaccataagaggaataaaaggacacaaggccgtggtggctgctgatgtctgttccacatgccaagctggagaaaagcttgtgaaaaatttgacatgttcacagcatatgatttggttagtgggaggtgatgattcctcaacttatgtcactaaaaatcaatccatcttcttccatttttgatcagattatccaacaatgattttagtcaaattagagcacctaatgcccttgaaagttattttgaacttttttttttttttttttttttttttttttttttttttttttt

SEQ ID NO: 134619 - DNA, 698 bp, Homo sapiens
gagatttttaaaaatacacaataaaaagctaaaaagtggtaagtgttatggggacaagaataaaatcaggaaaggagggcatgggttattaaagtattaaataatacatcatccctgagaagattaaatctgaacttcagttactactccccttgccctgcaaaagactggatacaggcaggcgtttcttttctaaaattctgtgctgtacagcaaacgtttatatgcttctctggaccccatacttctttctatgcttcaccctatagactaatgaaattaactatgcaacatttgcatgatttgattacaaaggccatttctccatgaagagacctgagcctggggacccagaggggttgtgtggtggctaaacttctcacttcctgtgttttaggataaagtatcagcaactgataacctgagatatttcttactttcaacctgaaagcacctaatataccaacaatagctgttctcccattttatagctgttgtttacacacacgactcattcattaggtttgaaaaacgtgttaacgaacactattagaaacaaatattagaaaatataaacttctgtaaattctggatattgagaacttaggtgtcttatttttagtattattctgtaattttttaatttcccccctacaaaagaggcaaataaatactgcattccccattttatagatgaa

SEQ ID NO: 134620 - DNA, 452 bp, Homo sapiens
ccccgagtcaagctatggcaacactttatgataaacacatttttttttgttcgtttgtttcccagttatggcccgtcctcattttttactaacaggcccatggctatacaatatttctgatcctgttgaccaagtagtacccaattttggcaagaaagtttaaggttatataactgagtgcaacttcaggttctctgactcttgagttttttaattcttaagacttcttttctgacttttatgtcttatgactcacactacattcataccacatttggtttcctctcatcatcttaacttctgcatgaataaagtctgaagtaaccaccttttggaagaaacactgtggctatgtgtcaagggtggcagtgttagctgggagaaggcctttcccagaagatctctgtgtaagagcctggccttccacagtcatttgaatgtccatcataaga

SEQ ID NO: 134621 - DNA, 725 bp, Homo sapiens
accttaaaatttaaaatatattcattcctaagaattctaatttgttacgcttattatgtaattttgttccatagcgtcacaattcatagtggaaggtagaacatttaaatgacttctcctctccagtgtttccaaaaattattgagtgcctgtatatttacagaccacaatggttacttaaaaataggcaatgtcatttaatgttatataattatgatatagggcagcactatacaatctaaaaaattgttttattaagtcagtcttatctttaactttatcctctctggctgtgcttagcatttgattctcagaataattcacattttactaccccaacaaggctaagaaactgaatctgtgacctcgttcttttctgatgtcctcaaaacaccagacacaacctctgaatgttttttccaggatatatagcatacagaaagactactaaggttacaaaagaataatagagtattaagggaagcaacattcagcaatttttctttctacccagaactaaaaatcatttgctaaatgtgaggccctctaacgaataatacctgggttaatgcttaggaacaaaagaccttcgttgaagtttatattcccctccagctctaaaatgtgactctgttaaacaattgtttaagaatacacagttacttatatttctagctgtgtgacaaaaatacctccaagaacaaattctggaaattctgaccccg

SEQ ID NO: 134622 - DNA, 422 bp, Homo sapiens
gacactgtcctcagactttaatttatttgcccccaaggatagacttagagggacattgaggaaaataggaagcacagtaatttaactgggacatacagaagttgtttagaatctggattactaaaaacagtttgttaaatagaagcagggtaatttctagccccattcctttctccattcctctagccctgcgttcaggactgagtaagatgaaattgcacaatgacaattgtcaattaatctatgaagattgaaatcgaacactcttggaggaaaaaatattaacagggttcccttatggagaatttctaaatttataaaagcacatgtgtaagattttacatttgtgtgaatcactaatgttatctacaaaaatgttttagcttaagccttaagtttaagtctatgtaggttggagaacc

SEQ ID NO: 134623 - DNA, 1377 bp, Homo sapiens
agtccaccgctgcttgccgcgcaggtgggggagacctggctggccggaactgggattcggggggagcattgcccttcggcgtaagcgctgctcaggtagagcccagcgctccgcttctccacagaacgtgctggcgcgcgcgtcagaagctaaccgcacagaggctggagtgcagtggtgtgatcatggctcactgcagcctcaacctccctggacttaggtgatcctcccgtctcagtcgctggagtcactgggactacaggcacgcaccactactcccagttaattttttttgtattttttgtagagtttctctacgttgcccagactggtctcaaacactttggctggagatccgcctgactcggccttctgaagtgctaagattacaggcgtgagccgccatacctggtcgctgtttcatattatatatgcaagaagtagagaaatcaaatctaataaaaataaatggacctcagttcacttttggacagcagaaaaagcaaactgtggaaagcagaattctacaatggcacgctggttcccaccccttggtgtacatgctctgcatgaagtgagcaggacctgtgaatataatgggataatcactcctgtgattacattatgttatatgattccattcccctcctggctttgaagaagtgagctgccatgtcatgagaacaccaggtggctaggacctgaagatagcctctaaggagctgaggatgtcaccctgctgacagccagcaaggaaatgggtacctcagtcctatagctgcaaggaattgaaacctgccaacaacctgaatgaacttggcagaggactctgagcttgtgatgagaacacatccccagcttgaaatcaaatcgacatattgattttagcactgtgagatactgagctgagaacacagttcagctgttcctggacttcagaaccacagaactgagatgataaatgagtggtgtttcaagttgctaagtttgtggtcatttgcttacagtaattgtaaactaatacacaagtgtaagtttgttttcttagagaagaaaaaaaacggggaaggaggtaagtgttaaaggatcaaaactctgacaaaaggctggttgcagaacatgacaggttgttgcactggaaactatttgtcatgcaagtttatgttaaaataagtagcttttgaggactttcatttttggtcttgtaaacatgccatttaatattgtccaactgataatactttttgcaaacagaaactgttaaaacctttaaagcaaatattactgtagagaagaagtaatgtgttatgaaactgtgaggatactaagaaggatcctacttaagtttcttcagcataaataaacttgagcgtttcg

SEQ ID NO: 134624 - DNA, 1233 bp, Homo sapiens
agtccaccgctgcttgccgcgcaggtgggggagacctggctggccggaactgggattcggggggagcattgcccttcggcgtaagcgctgctcaggtagagcccagcgctccgcttctccacagaacgtgctggcgcgcgcgtcagaagctaaccgcacagagagtttctctacgttgcccagactggtctcaaacactttggctggagatccgcctgactcggccttctgaagtgctaagattacaggcgtgagccgccatacctggtcgctgtttcatattatatatgcaagaagtagagaaatcaaatctaataaaaataaatggacctcagttcacttttggacagcagaaaaagcaaactgtggaaagcagaattctacaatggcacgctggttcccaccccttggtgtacatgctctgcatgaagtgagcaggacctgtgaatataatgggataatcactcctgtgattacattatgttatatgattccattcccctcctggctttgaagaagtgagctgccatgtcatgagaacaccaggtggctaggacctgaagatagcctctaaggagctgaggatgtcaccctgctgacagccagcaaggaaatgggtacctcagtcctatagctgcaaggaattgaaacctgccaacaacctgaatgaacttggcagaggactctgagcttgtgatgagaacacatccccagcttgaaatcaaatcgacatattgattttagcactgtgagatactgagctgagaacacagttcagctgttcctggacttcagaaccacagaactgagatgataaatgagtggtgtttcaagttgctaagtttgtggtcatttgcttacagtaattgtaaactaatacacaagtgtaagtttgttttcttagagaagaaaaaaaacggggaaggaggtaagtgttaaaggatcaaaactctgacaaaaggctggttgcagaacatgacaggttgttgcactggaaactatttgtcatgcaagtttatgttaaaataagtagcttttgaggactttcatttttggtcttgtaaacatgccatttaatattgtccaactgataatactttttgcaaacagaaactgttaaaacctttaaagcaaatattactgtagagaagaagtaatgtgttatgaaactgtgaggatactaagaaggatcctacttaagtttcttcagcataaataaacttgagcgtttcg

SEQ ID NO: 134625 - DNA, 384 bp, Homo sapiens
aaattcacctgtagaacgagctacaagagagaatggcaataaatgaacaaaaagttatcaaaaattataataaaaaacagaaataactcagctgccatacattcaactttccctagaactgagaaagaagcacgcacctataagttgctttgtacatccgatgagaaatggcaacaaggaaaagactgctccccaaatgtcttctctaattcttttactgcaccttttcagaagagggcttatagaagtgtaggtagtctccccacacgcacagggaggctcggtcagcggagcctaggcttcaaacattccagtagcaaaccctgagtgcgtgtgggagtacaacgtgataaacagcataaagacatcattaaaacacaatcc

SEQ ID NO: 134626 - DNA, 343 bp, Homo sapiens
gcgggggtggtggtggtgaggcttcaaggtgcggctatggggggctgcttgtcctctcctttcctgctgattctcccgcaatggtagcccaagcatccatgcaatttgtgagtcagaatgctcagatgctgttccagggaacagacgggccgagcttatatcacagatctatcgtcgtcatcatcatcaccgtcattaaaaaaaaaaatcaggctaggctctgtggctcatgcctgtaatcccagcattttgggaggccaaggcaggtggatcccctgaggtcaagaattccagaccaacctggccaacgtggcaaaaccccctctctactaaaaatacaaaa

SEQ ID NO: 134627 - DNA, 268 bp, Homo sapiens
attaggcgtggtggcatatgcctgtaatcccagctgcttgggaggctgaggcagaagaattgcttgaactcgggaggtggaggttgcagtgagctgagagcatgccactgcactccagcctgggtgacagagcaagactctgtctaaaaaaagaaaatgctatacgatgtttgctttctttcattcaaaattatgatgagcaaaatatgtaaatctagtttattcattttaacagctatttaatattttataaatatgccacagttta

SEQ ID NO: 134628 - DNA, 531 bp, Homo sapiens
agtaacaaaattgaccaaatcgggacttggaaacaggagctgatgtgccagcatacattttgagctaattttcacattcatcagcttttgaaaatatttacaggttggcttgctttgctgcctgactgtgaaggatgggaaagtatttagtgctccttataggctgtgtggaaattttcttctggagagagtttggttgggataatgattgagctctaaactgggaataaagtcatctgggttttcctttcacctgttttgtgatcataggcgtagaattaccttattaattagtgttgattattgtgtaatatttgagttatagggtattttttagcacatcatcacagcagaattttccacctggagtgtgttcacgaggacttcggggtattatgaagcgctctaataggcgcctctctttagatagtggaggaattgaaactgtatttgggaagtatgtcctgcgttggaaaacagcatatactttttttctttttaacaattgaagtcgttgctttttgggaatcc

SEQ ID NO: 134629 - DNA, 355 bp, Homo sapiens
tgcagtggcactgtctcagcctcctgggttcaagcaattctcctgcctcagcctcctgagtagctgggattacaggcgcctgccaccatgcctggctaatttttgtatttttagtagagacagggtttcaccatgttggccaggctggtatcaaactcctgacctcaggtgatctgcctgcctcggcctcccaaaatgctgggattacaggtgtgagccaccgcgcctggccccatgtttcactttttgtatttaccatcatggtcaatctccctactcttccaccaggaacatcaagaaatgtaggtgtcatcctaaaccccagcatcagtcattttagatattcatagtcatc

SEQ ID NO: 134630 - DNA, 161 bp, Homo sapiens
ctggtgcattcttacgagaaaccaatttatttgggctacctaggcctctgtttcttcaacacagagacaaatggcgtgtggctcagtcatcacacagcccacccgtccaacccattgtctgatgaggaaatacagggctgttcctttctggaaatgtgtca

SEQ ID NO: 134631 - DNA, 471 bp, Homo sapiens
cgtcgtggctcacacctgtaatcccagcactttgggaggctgaggcaggtgggtcacctgaggccaagatttcaagactagcctgggcaacatgatgaaaccctgtctctacaaaaaatataaaaattagctaggtgtggtggcgtgtgcctgtagtcctagctactcggagactgagctgggaggatcacttgaccctgaggggcagaggttgcagtgaaccaagagtgcgccactatgttccagcctgcgtgacagagtgggatcctgtctcaaaaaagaaaaaaaaagaaagaaagaaaagaaaaaagaaaaagaaagaaaagaaaaaaagagaaaggcccctgagaaacaagggaaaagaattaatgaccaaaaaactgacagttttcttgctaaactttcacaaactttgacagtctatgtaatcttgccagataattgaagtaaaaagcttggatatcaagttga

SEQ ID NO: 134632 - DNA, 111 bp, Homo sapiens
gccccatcaggaggtggacactcggtttgccctgtgccccatcaggaggtggacactcggtttatcctgagccccatcaggaggtggacactcggtttgccctgtgcccca

SEQ ID NO: 134633 - DNA, 257 bp, Homo sapiens
cgcactcaggacactagggggcgctcagaaccatcagggggcaatcaggacaccagagggacttcagaaccaccagggggcgctgagaaccaccagggggtgctcaggacatgaccggccctcaggaccaccaggggattttcagaacaccaggaagcactcaggacaccagagagcgatcagaacaccagggggcactcagatcctccagggggcactcaggacaacagggagctctcaggacaccagggtgagct

SEQ ID NO: 134634 - DNA, 354 bp, Homo sapiens
cttttccttccaaatgcagtgttccattcatctgccaccagatggcagagaagagcagagaataaattcctaaatatcaaaagaaagactgacacctggagaagtccagccctcttgaaggaaggcaaacctaaatcttttaaaatagaaaagcatcttatttttaaaggcttccagagacatcaagttcacaattttcccctaacttactgttgggaaacctgttaaaaatatacttcactaaagcacagcctaatggagctcagaattgttaggcaaattcataaatccagaaagagctaagaatcactttagctcaaaaaggtacaaaaaatggttttaaaaagaacgact

SEQ ID NO: 134635 - DNA, 445 bp, Homo sapiens
tatttccaagggtttttttgaagagtcataaaggatgcacttgaaggctgtctgatcattccttgacatgggcagaattatggggagcatttgatgaactgagtacccagctaagtcaggcagctgtgggcagtggaaaagaatgatggatgtgagctgggctgggaggcagggaatgggaagcagtcagaggagggaggggctttcttatgctttatttcaccaaatcctcacaagaaacttgcaatggaaattgtattgttcccttttatatgtgaaaaaacggaggctcctggagactgagagatttgtttgcataggcgatgcatggaagaggcagggtctaaacccaggtagtttgaagcagtgctcttctttacatgctacaatacatagccttacccacagcagacttggaagtcactgtgcttgaattttctttggc

SEQ ID NO: 134636 - DNA, 499 bp, Homo sapiens
cccggggggcagaagttgcagtgagccaagatgatgccactgcactccagcctgggcgatagagcaagactcagtctcaaaaaaaaaggttacccagggtcaaggagaagagagccagttttttcctgcaaatgtgcacagaagttactttgtgtgctagatgatttccatttgcctctccagtccactctccattctcacccactcatgggctgtatcagtggctaccttgccctctgtcatctagtaggtttgacaaaagaggcatctacaggtacaggaggacaggcagagtggaaggtcaggatatcgattctgccagttcccttcctgctgtgttgctgtgagttggctgtgtccatctacctatgaccacaactcctgtcgaaaagtccctgctctctccagactcagacagatgctcctgtcccttgccctttcagctctagggtggtatcagctccccgctcttgctagacctgaggtgccccattattct

SEQ ID NO: 134637 - DNA, 1361 bp, Homo sapiens
tctctttcccatgagtctaatcctctagagaagggaacaggggaggaggttctgttccgttcagttccagcttgacggagggttcgtgcagactacacagtcttcagctcttggctttcatggttacccctgacatcaaatccagcccacagataagggggagagaggtggagtgtcacagtggctttggccaggtctggaaacagtgtacatcacttctgcccacttcctcttggccagaattcagtcacgtgcctcagccaattgctaggggctgggtagccacttcccagcagcaactctgcaggagggaaggggggcctgatcttggagggcagctggctgcctctgccacatggacaatctttgttttcgaattgttgcttgtcagtgtacacctaagttaccttctaagtatctcaggtgtctgctaaccaccttgttttgcagctactcctgagtcacagctgtttggcttctaaatctgtgacagctgctgtgagtctaaaatagcagagcaatcacagactcttgttgcctgccaaactgggatggtgcctgccccttgctcgagactttgcatggagatgtgtgaagtcacagacgtgctttgtgccattttataaaataccgggtttactccgagggtttgtttattggtccccaattctccccaccttccttcttctgtgaggctaacacattggtttgtgagacagtttggagtattttgttttagggggtgtcaggacattttgaaaggtagagaaagtcaggcttcccagatgccctgcaggaaacctgggaaattctccagattcctgctcctaaaaggtcatggctgctcattcagggtggaaatgtgacacttccccagaagcctcactgtgctctggtctaggagactcacaccagactcacacctcaccccaacacacacacacaccccaccccaccccccccacacactacatacaccatacaccacctacaccacaccacacacatgcacacgtatacaccacataccacacattcatacacaccacacagctgagggcctgctttgggggaaggtaatttatttttgcctgacagaagaacgtgcctcacaccatgtggctgtggaggtggggagggcaacgtagtcttgagagttcatcagagtcacagctgttagggaagtgcctgggcctggggccaaggtggacagtgaaacaggaaggctgcccccatttccacatgtgctcacatggggctcccccacctgaggcctccaactacaggtgcacccctcccctgacagcacccacctctggtgggagtcttctgtatgattaataaaaagcgtagtaataata

SEQ ID NO: 134638 - DNA, 252 bp, Homo sapiens
catccttcagatataaagaatgttgactgtataaaagctgaatttttttccgggggtcagcaacggacattaaagaaactgtgtgttgtgatactgtcatttttagtggagcaacaggatactaggctgggtggttctcaacaggatattaggcagggttgtggtttagcttatgcctatagtgaagccactggtttcttttttcttttcaccaaaacctccattattttttagaacaacattagtcttaaa

SEQ ID NO: 134639 - DNA, 492 bp, Homo sapiens
agtttttgagtcctgtgttgagtttctagatgctgggaggctagaggataggaatgtcaactttgataaattgcatgcagggaatttgcatttaaagatgatccaagggccaggtgcggtggctcatgcctgtcatcctcaactttgggaggttgaggtgggtgggtcacctgaggtcaggagttcgagaccagtctggccaacatggtgaaaccctgtgtctactaaaaatacaaaaattagctgtgcgtagtggcagatgcctgtaatcccagctacttgggaggctgaagcaggagatcccttgaactcaggagatgcaggttgcagtgagccaagattgcacaaacgcactcgagcctgggcgacagagcgagactccgtctcccaaaaaaaaattgcccccaaattacatctgaatggttcctctcttctccaagaggaacaccaaggttcctttcttctcccattcttgacgcagaaagcgcctaa

SEQ ID NO: 134640 - DNA, 504 bp, Homo sapiens
ctggggctgcagacctgccttcaccaccgcccttgcatcaccgctggccatctgtggttggagccctggccaggccgtgggccgccacaccacacagactgaccctgccggcctctgactcggaaggtcccctggggcaggtttcccgcctggccggtgctgggcctgtgctgaggagtcacagacctctgtttgaacacagcccaccctgggaggtgggtggtggcatcctaggctctcaggcggggaaactgaagccctgcattacagtcaatggcagagctgggatttgactgcccggcgttcccactcgccctgtccatcatctgcaccagggctgcctgcctgcccctgccaagcccttcgtggggagcactgggctttacccgttttgcagctccttcctgccaggaaaggctcagcatgtgcagcccaacctgcactcacggtcccagccctccagaggccaggcagagcccacagagcttgcgtggcagtggccgc

SEQ ID NO: 134641 - DNA, 1048 bp, Homo sapiens
  misc_feature (75)..(76): n is a, c, g, or t
gctcattttctcttgccaccgccatggaagaagagtctttcacttcccgccatgagtctgaggcctccccagccnngtgaaactctttggcttctcgattggttctgaactcccaggaaggtgaaaaagcagcgtcattacttagcaccggaagccccggcactcaacagggatactgtgcagtcctgcatgtgagcagctcaagagttcttttcaagtgagacctgctgctaggagagaagtaagctgacagcacccagcaaccacactgttgagaacccctgtggcatcatgttcctgctgaggccggccactttcttgccaaactacttgcagccagtgactgagcatgggaaagcgagaccctagagcccagctattcctgcccagtgcaggactcctccagacttccagactgcactgcagactgaggcacttcctagctgagcctccttcttttcttctctcctttcagctgctcctgctccattgcccatttctctcacctttatcctgcacttctgcttccatcttggcatcttcttccctcaagacccaacctgacaccatcagtattattacactcttcatttcccagtggaggaggtggggatccaggcaagaaagacaaagcgtaaatatgctccctttaaaattttgtactgctctatcgcttctgggtctttgggctaagatcaagtgtaaaagtttgtactactcttaggtttgaggttcacatgaaaagaacatctcatcaacatttcaaaagaaaatttgaatgaattgtatgttgtactagtgtgtaaaagagagaccgagtcatttattcataaaactgagtccagtgggacctgcccattcaatgcaaaaatgcaaaggtatgtaggatcttagaaaatgaaagacaatgctaaagacaggaaccatttccagcatctgttgttgaggtccgaatctggaaagactcagaatgtatttatcagaaaaacaatttccccagtaagacaatagctgcaaagctggtcatcacatgcaaatcttgaccttc

SEQ ID NO: 134642 - DNA, 459 bp, Homo sapiens
ctactcttcattgtcagtaggaaatattcctcctttgctccttgtgtagaggaggggtcacatctgtttctgtgcctttctgcacctctcctttcttacagtaagcctgggagaaggaaacagttccatcttgtgtctctctcagacccacctgcctacagagaaggcgtgttcctggtctgctcatcctataacaagctgatcagggcagtcttggtctaggaagctgaggacacctgcactcgcctgtgaggggacagtgattaaagctttcctatttagagctgaaattcagggttaggaagcctgtctaggagcagggcagccagatgctctggcctcatcatgttagtattcaagctaatgctttgatttccacctttctttcagctttggcttctcgattggttctgaactcccaggaaggtgaaaaagcagcgtcattacttagcaccggaa

SEQ ID NO: 134643 - DNA, 379 bp, Homo sapiens
  misc_feature (19)..(20): n is a, c, g, or t
gaccctagaggaaacccgnngcttatcgatgccactggtgtttatcgacgccactggtgtttatcgacgccagtgttgtttatagatgccactgcactccagcctgggcgacagagcaagactccatctcaaaaaaacaaaaaaacaagcatgtatgtatcttgcttgggattgtcttcttaaatctgtaaattggagatgtttttaaatgtgtttattcataatttattaaatgtgatttccattcgtgttatttatcttaatgtataaataattttttaaattatctacatagtaaatattctcttctggtcttttactcttctttcactttgtttcccacagcttccccaacagacatacattgccaaacttgtgg

SEQ ID NO: 134644 - DNA, 1370 bp, Homo sapiens
gagcggagccagctctcggctcgcagccgcagcgccccgcccccgcgctccggacctggcaggcggcggctgcagggcaggtccagggccacatggctgagggggacgcagggagcgaccagaggcagaatgaggaaattgaagcaatggcagccatttatggcgaggagtggtgtgtcattgatgactgtgccaaaatattttgtattagaattagcgacgatatagatgaccccaaatggacactttgcttgcaggtgatgctgccgaatgaatacccaggtacagctccacctatctaccagttgaatgctccttggcttaaagggcaagaacgtgcggatttatcaaatagccttgaggaaatatatattcagaatatcggtgaaagtattctttacctgtgggtggagaaaataagagatgttcttatacaaaaatctcagatgacagaaccaggcccagaagtaaagaagaaaactgaagaggaagatgttgaatgtgaagatgatctcattttagcatgtcagccggaaagttcggttaaagcattggattttgatatcagtgaaactcggacagaagtagaagtagaagaattacctccgattgatcatggcattcctattacagaccgaagaagtacttttcaggcacacttggctccagtggtttgtcccaaacaggtgaaaatggttctttccaaattgtatgagaataagaaaatagctagtgccacccacaacatctatgcctacagaatatattgtgaggataaacagaccttcttacaggattgtgaggatgatggggaaacagcagctggtgggcgtcttcttcatctcatggagattttgaatgtgaagaatgtcatggtggtagtatcacgctggtatggagggattctgctaggaccagatcgctttaaacatatcaacaactgtgccagaaacatactagtggaaaagaactacacaaattcacctgaggagtcatctaaggctttgggaaagaacaaaaaagtaagaaaagacaagaagaggaatgaacattaatacctgaaactataggaaaggttaatttgcctataattatatatacattccatagtcatcaaggaatatattgtgcagagagagtatccttgactgcttaagtcagccagttcagcatggataccaacattagcttttcttcttggttatatcatctgccaaaaatagagaacttatgatctattcatgtgtgtttcaggcttatttgggaaactaatttgacttaatcaccacttcatctaattttagcaaggtaacagttgcccagggcagtacctgaattaactgtccatttcagtacatgtcaagtgcctt

SEQ ID NO: 134645 - DNA, 486 bp, Homo sapiens
tacttggccaagaacctgaccatttaccaggtgcatccatacagtaaatatctgagtgtctcttacatgcctggcatgtcccacttcacccacaggaagaagtccattttataaatgaagaaactggggctcaaagaagtatgtgaacctaaggtttcagtcttcttaaatcctgcttcttgatctcctctaataccatagcacactcaagaaatgagcatctttaattgtgcttggattggcagaatctgcctttagctggaggagcagacgtaatggctttaatgagctacttaactactttctagagacaaccaagagacacttgaagagcccagtctgagacctggttccacctttccatcccttctgtgtccctgcctccagcccccacccccaggacacatctggcagtgaagggactccaattcctgttctagggagtggcccccacttgtgctcaaagtataattaagtggcttaaaa

SEQ ID NO: 134646 - DNA, 745 bp, Homo sapiens
aaaaatcactgctgtgatagaattctaactctggaccagattgcctagatccaaaacctttttcttgttatgcagtagctgtcctagcttcaggcaatttgcctaacctctctgtgcccagtttattcagtggggataatagttcttacttggattatgactttaagtcatgtaaggccccagaaacaatttgggtaagaatacaagtgaaagttgttactataatgagccattgatactgataggagaatatcataacttttaagtatgttaggaggcaaaaaaggctgagaaacactgggatcactttatttgtttccaaataattttgctttttaaattcattacaagtcattgggacaccttgtggcattgagcaattagagcaattaggtaattcagtttagggtaaggacttagtatgagtttcagtacttactttgtgattttgtatgcatttaatctcagcctcatccactgtttggaggtaataaaatctattattacctgataataatatcaggtgtatcagtgcttgtatccgttaaaagcactgaataagtgtttgttgaattaagtgaacaacttcaggttcttgtctttttaatggtgatggtggcaataataatagttaacattcattgagaactttccatgactgtgtgtcaactcatttaatcttcatgaggaaacaggcatggggaggctaagtaatctactcagattgcatggctagtgatagagc

SEQ ID NO: 134647 - DNA, 228 bp, Homo sapiens
ttggaaataagtgtctagctaagtgtcaggagataagtcaaaatggagattgtgattcgtcagcatgtaggtgatagttaaaaactggggaagtatgtaaaaataaaagaactgagactagatctctgagatactattatttcaggtttaccagtgaaaacacacagggattggaaagataggagaaccaggacaaagtagaagctatttcagagaaggcaaggtaag

SEQ ID NO: 134648 - DNA, 259 bp, Homo sapiens
ctcgaactcctgacctcaggtgatctgccctcctcagcctcccaaagtgctgggattacaggcgtgagccaccacacctggcctgaacctctggaccttttagttatgtaaggagtaggccaatacattttttccttattgtttaagcctggttgatttctgttttctgtcacttgcaatcaaagcctcagaaataatacacctctcaacactatcccacttaacgatatgccttagctacactcagcaactggaaatg

SEQ ID NO: 134649 - DNA, 257 bp, Homo sapiens
actccaaatctaccctttatttcctgctctatgataatgaagctggaccctgtaaaattctccctccactagctggcacaatgttaagctttctcagtagagggtggtggagagagagagagagagacagagagaggcaaatgagagagagatactctgatgaggccatgatttttctcctcctgatttcagcatgcccctctaggcaagctacagcagcacatgaagcttgcacatacctggcagccacctctcca

SEQ ID NO: 134650 - DNA, 777 bp, Homo sapiens
gtctgttttctaatgtatattcttgctctttccatttttctaaaactattaattaaacattaagccaacttatttaaaagagggaaaaatgggaaataacctaaaatcctaataattggatgtcacttaagaacctacaaaacatacactcaatgaacaatacacggccattaaaaagtgatagataggctgctctgtctatggagtagccattctttcatttgttcacttccttaaaaaaaaaaaaataatggctaagtattaaaataggaaaatgtccattattaaatacaaaagggcatggcacaatagttatatgaatatgttttattaatagctatgtaaaagaagtattcataaaaaaaatctgaactctaacacaagagaaattaacagcagtttcgggagtgcataatgagcttttgacagatgtcttggctgggcgcagtggctcatgcctgtaatcccaacactttgggaggcctgtaatcccagcactttaggaagctgaggcgggcggatcacaatgtcaggagttcgagaccagcctggccaacatggtgaaaccccgtctctactaaaaatacaaaaattagccgggagtagggtgcacacctataatcccagctacttgggaggctgaggcaggagaattgcttgaactcaggaggcagaggttgcagcgagccaagatcatgccactgcattccagcctgggcgacagagcaagactccatctcaaacaaaacaaaacaaaacaaaacagagagatgtctt

SEQ ID NO: 134651 - DNA, 299 bp, Homo sapiens
tgaataaaatgttacttgcatctcctcattgtcacagtgttcgtattacatactttctttaaggaaacagagctaaaaaaaaacaaaggacaataactgcatcaacaacatgttatacaccagaggaaatgcggcgacttaggttctgtgatgggaaacccggatttttttgttgtacttgaaatcttccgtagaacgtacgtgtttgcatgacccagaaaggaaaacacattggaggactttgtactagttccattctaattctgtaaaattctcacaaattcaggcatctgttaacc

SEQ ID NO: 134652 - DNA, 612 bp, Homo sapiens
tcatagtgagcaaagacaaagagaaaaattaagacatatctcttcactttccccatcctcccaaatacaaacacgtatttctgaatagtcttcagcaagttttgcttcttagacttggccaagatttttagcaagcacttacccactgggcctgcttgtatgcattgcctttgaggatcctggaattgagtgtggtgctgaactgtaaggtagccttaccctttaagtcagctgtctaataaaatcaccttgaaaatctaaatagaatttccaatcttccgtggtgtgtggctcaatattacagcctagtggttgtcagaaatcacagtgactcactagccagctctgggtgggactctgttctttcgtctgatattcacacttactgcaccactctctcttcatgtggttcccttagtgaattctgttgcttcctggaatctcattgagtttctgctctgctcttcttggaggttctttccagctttaaacatgaataaaggctaggaaagccaggccatgattcaaccaggccttgtcacacagtcatagttgcctcataccaggatttaaatatggtccccactttggactttcctgacccatgcaccc

SEQ ID NO: 134653 - DNA, 266 bp, Homo sapiens
ggtgacttagaggatccgatgggggcgtcgtcaatgaagggctgaggctctggtctgggaggccgggccacctaccaaggcagccggccctgtcaaggatccccggctcttggcctttaagagcagtgaatgctcctgccagcacactggcttcaagggccagctcctctgctccagagccttgctcctcttccctgcctcccctgtaacctcgggctgtgattgtcctgttccttgcacccttcagtttagatcccgattgccat

SEQ ID NO: 134654 - DNA, 541 bp, Homo sapiens
actcacttcacctcttagtcttccagagaggatctttcatcctgccatcctgaggcttctatttttgaccaatagctctaaagaccacgggttcccataacaacctgatatccctttctcatccctgccatccctgaataaggcttctaatttattatgctttaacaagttttcaaatagcaagcgagacacgctggaatagttgagagagccccaaacactaaataagccaaattttggggtaaaaaaaataaaaaaccaagaaaccagacatagaagcagaacctaaagcatatttatcaaaacatctttgtttaaaaaaaatgtcttcagtggtcgtcttggctggtgggattttaggtcattttaattatctttataaaactttattctctcgaattttaaaattaacatctatttctcttataattaaaaattaaatgttatattttttaaaaagtatagtttatttattccagtagtaaaacattgttgaaaaaccaagagaaaagcaagaagaacacgagagagagagaaaaat

SEQ ID NO: 134655 - DNA, 422 bp, Homo sapiens
acattcatatggctaaaaactattcagcaataaaataaatgacatatggcattaacttacactacattggccaggtgtggtggctcatgcctgtatcccagctacttgggaggctgaggcagaagaatcacttgaatccagcaggcagaagctgcagtgagccgagatcacaccactgcactgtagcctgggtggcagagcgagactctgtctcagagaaaaaaaaaatctttcatatttcaaaattgagactgtctcaaccaaaatcatcaccaccctcactctccctattcagaaactattgagtcaggatggaggaagaagggatcttttgtgtctgagcatgtattcttttattttgcttctttagaaagctctaaaaggattcagggctgggaggtatgcaaactgaagtgttcttg

SEQ ID NO: 134656 - DNA, 120 bp, Homo sapiens
tcatccccagggatttagtgccaactcttacctacagtaaacaaaaggccacgtagacacagcgccgcgaaaggtggggcaggggagtgcgtactgtctgctcactcaaaaattcacatt

SEQ ID NO: 134657 - DNA, 389 bp, Homo sapiens
accggggcagagcgggggtggggggggcgtgccacacacttttacacaactaggtctcctgtgaactcaaggacaagagctcggtcatcaccaggggatggcccaggccgttcatggggaagccgcacccatgacccaaacacctcccaccagacccacctccaacactcgggatcacatttccatgtgagatgtgggtagggcaaatatccaagctctatcagatgaattaaaagatgttctgatgggtacttggttgaatgagttaagttactatctgaaggcctggaatcaatagaaaggagtgtctgggttaagagaaggggctgtggagaccaaggtccttattatgtggatgaaatctcataggtgtccacccttagaggcaa

SEQ ID NO: 134658 - DNA, 705 bp, Homo sapiens
ggcaaaaacctgtttctacaaaaatttaaaaacattagcctggtctggtggctcactcctgtcatcccagctactcaggaggctgaagttagaggatcgcttgagccaaggacatagatgctgcaataagctgtaatcaccactgcactccagcctgagcgacagagtgagacccgatctcagctcatgttttagctcatgttgtgaaatagactctaaatcaaacacaacgcatggtatatttttttcatttggataggtatacataaaccatagattgtcttttcagaagtaataagtccagcaaaaaaatggtgagatcttattccctgctgtttatgacaatactcagactcttaggccaatttagcttctgttaagttttatgaaagttctttttggctttcttccttgagaactcgagaattattttaggatgcagataaagtaccacatatgtacataaagtcagcagtctgcttcagttaaaaaattctggacagttatgcttatgcagaccagaaatctattattactggaggaaaagggaagcaactcctgtcatgtggctaaaacacaatattttaaatatccaaggtcttttgtaaatttatttcacagtacattctgtggttcagaactacatatagttctggtgaatagacgcccatatttcaagagttgtataatattcttcaaataaaa

SEQ ID NO: 134659 - DNA, 603 bp, Homo sapiens
aggtataaattttaaaataataatcaacattttgacagaaaaatgacaaatcttaccaaggaggaaaatcagattcacattagtgtctctctgtaatagtaaccaatgccagaaacttctgtatccatgtttatacagttctgaaatatatatatttctttcagaactgtgtatatatacaaatatattttgtatatatttatacaaaactgtatatatatatacacacacatacagttctgaaagatcgtgtatatgtatatatacacactcacacacatatacagttctgaaagactacatatatgtatatatgtatatatgtgtgtatatgtatatgtatgtgtgtgtgtgtgtgtatttacatatatactcctcttaagaatgatataaccatttagcaattaagttgagccagataatgaatgagtaataatagaaaattgaaagaaagaatctaggggagaaaatgactgattgtgagcacggatttacatgatctccatatgtatataaatttaatatttttgtcacttatggttatatgagtatgccataaacaatgtcagtacaaaataatgacttaactaacaaattaagatg

SEQ ID NO: 134660 - DNA, 405 bp, Homo sapiens
cctagttctcctggacgtaggtaaaataaagtacaaactttaagctttatttaatatctataactaaataattctatttgttacataaattgacattaaatatgtagattctaaatctgagaatgcactagatactgtcaatccaaaaatccattcatcttacctccaccactgatagttcatctctttcctgtactgccatgcacaatttctcgggagcttgctcctgtattggggctttaatctttttcaatgatactactacatgagctgattttaagcccctcctagactcgtagtagaaatgtctccattgagatgaataactcacatgttttccaggaacgatactcacaggtatgcagtctgaaacagccacaaacatgttctcacatttgtttcaac

SEQ ID NO: 134661 - DNA, 409 bp, Homo sapiens
ccccagctcagcctaggcaacagtcgtgggctctgtgtctttctgcctccctggtgatatactccaggttaaccagggtggcctgtcctcatcttataacttgaccttgttcaggccatctctgcccatttgtctcatgctcatcctcttggctctgttgcccaagatggaagatagtgcttaacaggaagcctgaaactcagcaaacactcataaaacaggaagagctgtggccactgtccttgtaactgttgctattctgtggaggccctagaggagcaggtccctccctcccagggagctgggcctcttccgctttcccttagcccctgaccacctgcttggttcatcttggcctcagtcatactcagtggctccctcccaaggctaccttctgctgccagtgcag

SEQ ID NO: 134662 - DNA, 399 bp, Homo sapiens
attcttggtaaattctaaacttcaacttctgttttaaggaaacacaaattcatccagtgttacaaattctgcagcaggtgttgaagatcttaacatcgttcaagtgactgttccagataatgagaaggaaagattatcaagcattgaaaagattaaacagctaagagaacaagttaatgacctctttagccgaaaatttggtaagtttttatatctttttatatccagaattcatatacctaaaatacttctttttaaaagaatacttggccaggtgcattggctcatacctgtaatcctagcactttaggaggctaaggctagagaatcacttgagcccaggagtttgagaccagcctgggcagcaaagtgacaccccaggtctacaaaaggaaaaaa

SEQ ID NO: 134663 - DNA, 1750 bp, Homo sapiens
attcttggtaaattctaaacttcaacttctgttttaaggaaacacaaattcatccagtgttacaaattctgcagcaggtgttgaagatcttaacatcgttcaagtgactgttccagataatgagaaggaaagattatcaagcattgaaaagattaaacagctaagagaacaagttaatgacctctttagccgaaaatttggtgaagcaattggcgtggatttccctgtgaaagttccctacaggaagatcacattcaaccctggctgtgtggtgattgatggcatgcccccgggggtggtattcaaggcccccggctatctggaaatcagttccatgaggaggatcttggaggcagctgagtttatcaaattcacagtcatcaggccgcttccagggcttgagctcagtaatggtgagtattctacagtgggaaaacgcaagatagaccaggagggccgtgtgtttcaagaaaagtgggagagagcgtatttcttcgtggaagtacagaatattccaacatgtctcatatgcaaacaaagcatgtctgtgtccaaagaatataacctaagacgccactatcaaaccaatcacagcaagcattatgaccagtatatggaaagaatgcgtgacgagaagcttcacgagctgaaaaaagggctcaggaagtatctcttaggcttgtcagacaccgagtgtcccgagcaaaaacaagtgtttgcaaacccaagtccaacccagaaatcccccgtgcagcctgtagaggacctagctgggaacttatgggagaagttacgtgaaaaaatcaggtcttttgtggcatattctatcgcaatcgatgagatcacggatataaataataccacccagttggccatattcatccgtggtgtcgatgagaatttcgatgtgtccgaagaacttctggacacggtgcccatgacgggtacaaaatctggcaacgagatcttttcgcgtgttgagaagagcctgaaaaagttctgtatcaactggtcgagattagtaagcgtggcctccactggcaccccagcgatggtggatgccaataacgggcttgtcacaaaactgaagtccagggtggcgacgttctgcaagggtgcggaactgaagtccatctgttgtataattcatccggaatcactctgtgctcagaagttgaagatggaccacgtcatggacgtggtagtgaagtccgtgaactggatatgctcccggggactgaaccacagcgagttcacaaccttgctctatgagctggacagccagtatggtagcctcctgtactacacggagattaagtggctcagtcgcgggctcgtgctaaagagatttttcgaatccttggaagaaatcgactccttcatgtcatccagagggaaacccctgcctcaactgagctccatagattggatccgagacctggccttcttggttgacatgacgatgcatctgaacgctttgaacatctctctccaaggacactcccaaatcgtcacgcagatgtatgacctgatccgggcgttcctagcaaaactgtgcctctgggagactcatttgacgaggaataatctggcccactttcccaccctgaaattggcttccagaaatgaaagcgatggcctgaactacattcccaaaatcgcggaactcaagaccgaattccagaaaaggctgtctgatttcaaactctacgaaagcgaactgactctgttcagctccccgttctccacg

SEQ ID NO: 134664 - DNA, 527 bp, Homo sapiens
attcttggtaaattctaaacttcaacttctgttttaaggaaacacaaattcatccagtgttacaaattctgcagcaggtgttgaagatcttaacatcgttcaagtgactgttccagataatgagaaggaaagattatcaagcattgaaaagattaaacagctaagagaacaagttaatgacctctttagccgaaaatttggtgaagcaattggcgtggatttccctgtgaaagttccctacaggaagatcacattcaaccctggctgtgtggtgattgatggcatgcccccgggggtggtattcaaggcccccggctatctggaaatcagttccatgaggaggatcttggaggcagctgagtttatcaaattcacagtcatcaggccgcttccagggcttgagctcagtaatggtgagtattctacaggtgagaagaacgttccggcaatgttgggccatgggaagtgtcttggtgggcgctcaccacggggtttttgcttccgtgagcctgggacccaagtatgca

SEQ ID NO: 134665 - DNA, 130 bp, Homo sapiens
gtatcagagtggtagttgccctaccacttacctgatttattaacataacattttctttatctgcacatttcctaacaagctcggtgacaaaagtcaatcttttgtcaatcctttatgcctggataatcaa

SEQ ID NO: 134666 - DNA, 538 bp, Homo sapiens
agacacatttcagtcgctctagagtaacagcctggaaaatgtcagagaaaactgttccacgttatgtttctaatgtttcaaggcctttcttgaaaacatttcattttgaccacagggacttcttttctttagttgttgagaccaaataaagtcagtaaatagctttgtttttagaggtgcaaatattctaagaactgtattgaaaagttcaattcacattaattaaacatcctttcttaaaatagtttcacaagtactggagatacaaaggaggttatgacaatttcccctagagccttcacttattcaacataattttaaatgaatatttattgactgcccctcatgtcacccacttttataagcatcagagataaggcaatgaatgaagtagtcaaaacttctgttatcagaagctcatacacttacggtaggaaagtaggtattatttactgtggcagtgttctcagtactttatatgcttttattcatttaattatcacagcaattctatgagaaaataatattatttttagga

SEQ ID NO: 134667 - DNA, 1043 bp, Homo sapiens
agaggtcaaatagtcctagaatcaaatctcagatccacctgtcactagccatatgacaccaggaaagttttacaccactctaagcttctgtcttttcatcggcaaaatggaaataatgtctacctcacagggttattgtgtggattaaatgagatacagggaaagtatttagcacagggcctggcacataggaagtgcccctcaacagtaccttcctttttccatatatatatatatggaaaaagaggtaacacataaaacactaggacatggttactgactacttgtgggagagaaagaaaaaaagctaagtgcaaagaatcaagcctggtatgttagtttttactgactgagatgcatccaagatgggattagacatacaagataacttatcagggaagacacctgtgagggaatgtggggcaggcatgaaggtagtacgggagaacccacagaccactatgcagagctgattcctgtgaaaaagaaagagaaagaagttttaggtaccaattcaattataagagtttttgcaaggctgatggggaatcctccaaccagtcacccattagagttaaagagagcctcagagaactagacttgctttcacgcccttgctgggagcctgtaggaaagaagctttctgtgcaaaggaggtggtgaatttgaaatgcactgacctgggccttctgtcaatcaagtctctgccatggagacctggcagggtctcattcatgactgccacaacagagacactgagaaaaagatgcaaccatgaaaaggtgcaaaggtggcaagttctaatgacatagaaaatagcaatcagcctttctcacatctgaaagccttccaaatatctgagcacagtagagaattgacagaggactgatcaccaactgagaaacagggtgagagggaaaaaaaaactgcaagaatataatcatctcctatcaattttccaacagaaataacgtagtccttgaagaaacaattatagagtacctcatgttacatgcttgttcctgaggctcccccatgtaaaa

SEQ ID NO: 134668 - DNA, 230 bp, Homo sapiens
cactgggattacaggagtgagccaccgcgcctggccgtgtgtgcgtgtgtgtgtgtgtgttttaatcctatctaatttttccaacagttttttgcatcctaagagagtttaggagtagaattatcaataaggaatttcatacatagacctggagttgcaaaaatatatttggagaagagagctttcccattgcccttcaagtcatacctcatatcttttaaaattttttt

SEQ ID NO: 134669 - DNA, 147 bp, Homo sapiens
atgaaccactccgatctctgcctccctcttcatgtcacctctactctgtatgtcatcttcttttctgtctcttatgaggacacaccattggatttagggcccactctaattcagggtgatctcatatttctaaataaggttacactc

SEQ ID NO: 134670 - DNA, 379 bp, Homo sapiens
gtacaaagtgttctgataaagtaccaatgaaaatataaacctggagatggagagtgggagataaaaggtacaatagatgtgaatgtgctttgaacattagtatagaaagtgcccgccaggcgcagtggctcacacctgtaatcccagtacttcgggaggccaaggcgggcggatcacgaggtcaggagttcgagaccagcctggccaatatggtgaaaccccgtctctactaaaaacacaaaaactagctaggcgtggtggcgggtgcctgtagtcccagctgctcaggagactgaggcagaagaatcattcgaacccaggaggtggaggttgcagtgagccaagatcatgccactgtactccagcctggacaacagag

SEQ ID NO: 134671 - DNA, 415 bp, Homo sapiens
cagcaggacttcttggagcctttgatatcctaatgcaaactgtgaaactctaagagctggccatattgtgcaacattctccaaagttctctgatggatccttggcatatcatgagactaaggagaaacattgctgcaatcaataaaaaggggagcacttgatccttacaacatcatttgtctagtaactggaggaagagaaaaagatttttctgcaagttggggatttcaaattaagggagaaccatattgcaggccctgaagctctgcccagaaaacagaccaatttatgcaggataacagttggtcaagtgattgacccaataaaattattaagatggccaaagacaccatcctgaaaatgcacagtggggttattctggtcttcttaacgactaggttggccatttggtatc

SEQ ID NO: 134672 - DNA, 682 bp, Homo sapiens
taatttttttgtatttgtagtagagacggggtttcaccatcttggccaggatagttttgaactcctgacctcatgatccatctgcctcggcttcccaaagtgttgggattacaggtgggagccactgcgcctggcctaaccaccaccaagattcctaaaaggcgaataggaagcagctgtggcttattggaaggaaagaatggcagcaagtcctgggggagctgtgcccgcaccagatctcccgttagggcagccaaggccatagagagtggaacagaatggaatctgtctctccttaagctgttgaggatgacgccaggtcctgggaaaatgatactgtcttggtccagcctccacctctgcatctccaggactgatgttccccctgttaaaggagctggatctccctttgtcacccaggctggagtgcagtggcgtgatcatgactcactgcaggcctcaacctctcaggctcaagtgatcctcctgaatagttgggaccatagaaacacaaacagcagaatggctccatctctgttgaagacttccatcaactagaaccacgagggctgatggacagaccacaaggccagtttgttccagttcaatgattaaaagaaccacagacgtgagccaccgcgcccggccaaaaccctgcttttaataaagtgtgaaatggtaa

SEQ ID NO: 134673 - DNA, 817 bp, Homo sapiens
tcgacccacgcgtccgcggacgcgtgggtcgcccacgcgtccggacccacgcgtccgcaaagtgtagccaggcgtggtggccctgtagtcccagctactcaggaggctgaggcaggatgtcttgagcctgggaggcagaggttgcagtgagctgagatcaccccactgtactcaataataaataaataataaataatataaaatgcatcaaagtgaagaggggtacttggggatttccaggtctaatccctttattttacagaaagaaacagagactcaaagcaaagtaattcataagtggtgaagctggggctaaatccaagtctcctgccactgcgcacttcagggttagagcagtgctaggagtcccaccagggcctgggtgagagattcattcttaaaactgggcgtgaagtctcagtcactgagaatgcttggtgccagctcccatctctaaggactgctttgagggaaggagttgaatccggccccttccccaaaccagggtaatgtatcatagagcagagagcatacataatcttgggaagagggatagaagtgacaaagatgggccaggcgcagtggctcacgcctgtaatcccaacactttgagaggtcgagatatgcagatcgcttgagcccaggagttcgagaccagcctgggcaacatggtaaaaccccgtctccacaaaaaataaaagataaaaattagctaggcatgatggcacatgtaggtagtcccaactactcaggggctgaggcaggaggatcccttgagcccgggaggttgaggctgtagaaagccaagatcatatca

SEQ ID NO: 134674 - DNA, 420 bp, Homo sapiens
cagattgcgccattgcactccagcctgggcaacaagagaaaaactccatctcaaaaataaataaatatattaataaataaataagaagtataggcattctcatacataacctcagtaaataccattaagaaaataattttagacatggtgcagttgctcatgcctataatcccagcactttgggaggctgaggtgggaggatggcttgagcctaggagtttgagaccagcctgggcaatatagtggcaactcttctctacaaaaacctttaaaaattagccaagtgtggtagcatgcacctgttgttgcagcaactcgggagcctgagatgagaagattgcttgagccagggaggcagaggttgcagtgagcccagatagttccactgcactctgggggacagagtaagaccctgtctca

SEQ ID NO: 134675 - DNA, 309 bp, Homo sapiens
atattttaacccttaggaatatctgaacatgagtgtgtttgtacacataatttaaaaattaaatatgtttcttttcatggcataattttctaaaggaaggagggacaggacttaccctcgctagagtctttcgaacattctggcttctttgctttgctctttttgtagggtggagagaggccttttggctctaacccctctggaatcacgaagatttaatattctcatttaaatatttaccagtagggttcaaaattatgtgaaatttaaaaatgttttcttcttagtaaacctacacacacgctgaat

SEQ ID NO: 134676 - DNA, 337 bp, Homo sapiens
cagagtactcactgcaggttgttcgtgggggccggtgcatggcatagggaaaggaagacaaaacaggagaagttagcagaggtagggaatggggtagagactggatcatagaaggagttgtttgccatgcttacccttaaaggctttctgagcagtcatcctgggatggacagggcagggagtggagagaccagcgagcaggtttttgttacggttcgagtgagggttgaacacaggcagtggtggtggagatgggttgcagggataatcttgagagagatttaggagacaagattcacaggttggaatggatgtgggagaaaggaggagcttaacg

SEQ ID NO: 134677 - DNA, 569 bp, Homo sapiens
gtgggagacatggagagtactggcctttggccacgttgtgagagaacaattcctttgtgcagggttcacaggaaatggaacctgacccattaggcatcagcccccggtcaggcaacatcaccccttccctgggtaggtgtgtgggtggaggggctgtgggttccttagcctctctcctaagccaaacccagcaaacgtctgccttggcaacccctcagggatgacagcactgccatgctctctggcaggcataatgttgccactgtgcctgaggccaacaccctgcgtcaggctgcaaacatccgttcccttccctgtggggaggcaggctctgggggccttagtgggagactctggacagggccaagagactgttgtatgcacactgcctccagcctgtcaagaaggcggcgtgcctggcatcccttctactggtgattggtgcagatcccttagctttttaaagcttccttgttttgtctgatcacacacagcagagctgccctgtatttggcagttggcagacagacccatcactccccaccatgtccacagtcacttgtgcatcc

SEQ ID NO: 134678 - DNA, 496 bp, Homo sapiens
ggcatcctaatgggtgtgagatagtatctcattatagttttgatttgaatttctccagtgattagtgatgttcagcatctttccatatactttttggccatttgtagatctttggagaaatgctattcaagtcctttgctcacttttgaatcaggttgtcagtttcttttgttgttgttgatgagttttaggaattctctatatagtttgaatattaattccttatcagatatatgatttgaaaataaaaagttctgtctgtgggttgtgtttttactctgttgatgttgtcttttcaagcagaaaatttttaaaattttcatgaagtccagttgtctattgttttttggttattgtcgcctgtgcctttggtatcatatccaagaaattatttcccaatctagtgttgtgaagggttactgttatcttttcttcttctttttttttttttgattatactttaagttttagggtacatgtgcgcaacgtgcaggtt

SEQ ID NO: 134679 - DNA, 364 bp, Homo sapiens
aaagattccatctctttaactttagttaggatggaatttgaactcctggctcttttgagtatagaaacccctagtaacaatttaagttccttccatttttcttttaaactccttattcccagcagcagtattctacattctaaccaggttctcccagctttgagacgtctcagacttaccagttctccaaaacgctattttctttaagggtgacaccttttaaaaattaggcacctcaaatatctactgcttttgagcttttgagttttgcactgtaaaaagaaaaatacacagtgggattttaagtcaaattagtttatctaatttttagggaataatttgaagcatgctttgtttgcataga

SEQ ID NO: 134680 - DNA, 392 bp, Homo sapiens
tataaagaatagggatttgctttatgtattcaaaattctctgagtgccccctttctctgttaaaattcaggttctgatcatttttctaagccagttttcctaagtccaaaaggaatacttttagctgaatttaaaaaataagtgcaccttgtcaaatgcttgtgtttttacacttgtgtttgtgtgtatttaataatcatatatacgtgtaatactaaagagattttcagctattaaattttaaaactgcttacatgtttaaagaaactgaagagtgagaaactacacaaccaagcagttatttggtctctgagatctatacttaaccctcttcagctattaatgttacctgcacactagggtatgaatcctcttttttttttttttcaccc

SEQ ID NO: 134681 - DNA, 724 bp, Homo sapiens
gggtgggaggagggagaaatcaggaaaaataactaatgggtactaggtttaatacctgagtgacaaaataatctgtataacaaacccccatgatacaagtttacctatatgacaaacctgcatatgtacccctgaacttcaatgttaaagaaaaaagtaaaataaaaaagaaatgtacttcacctagtgcctacatattatcagctctctataaactgtagctgtattagacctcactttttaacatctgggacatgctatggggtggaggtgggaggatgacatgaaatgtaattaaactaaatggtcaaacttcaaagaggtcaaatgcttacagtagcctgcaacaatgttccataaagtgaccgtgaggactcttgtgacagcacctgagcatttctttgaatctaaccaggtgtgttggtttttactttatgctaaaaggatctcatgccatgagtattttgtgaccttccagctaatttaaatattgcttactgatttggtgttatacatctgttgtccaatacttctatccatcatccactgattccacattctgcttcctggcactgagctttttactcatggactctcagctttaaactgtttccacttgctaaacttcaacagaactgtcctttaacacctttctaattttttaaatgttcagctttagccactttgcacattttcaaatgtaataaagcaaagatccttgaga

SEQ ID NO: 134682 - DNA, 407 bp, Homo sapiens
caggttgatccaaagcgctgtcctggggagaggtctgtatctgggacagctgaggatggtggccctacattgcctgccattttatttggtttccaaatgggccaattgagcaaaagaaatactttctatctacgctgtcagctttcatcagttgacattgcctagcaatgtgtctttaaactatatttgctagggaagcaatgggatttggcatctggaaatagaaccaaaatcatcctgtttgcccgcagcagtggaagatgtgcaggggagagggactggctgttttgatcactggagagttcaaggggcaggagactgaagactgctgaggccaaggctacagctcttggggaagaaggaacctggggcagggctgagctgcatgggatcgactctgacgcacc

SEQ ID NO: 134683 - DNA, 387 bp, Homo sapiens
accagcgtcagggaaagacggaagatcggtcagggttggtttctccacagaaagtgcacatgtgtgggaggggccaactgagtctattttcaacctcacaactctgccctggccagcactaatgaacttagtgattgagctgggattttcaagcaaagggctgaaggtgccatctggcttttttgtgctgcttatagtaaactgtaagagtgataaattgaaggaagaattgttaaacatgaaggaaccaagacctgataattttgaaaagtctcaatctctctggacagcaaaatatgctagaattaagaaatggcttttgagtactttcaggaaaacatggtatagacatatagccacaggtaagactacataactactggttag

SEQ ID NO: 134684 - DNA, 368 bp, Homo sapiens
gaagggcagtcagggaaggtgctgccacagggaggtgcacatgtgtgggaggggccaactgagtctattttcaacctcacaactctgccctggccagcactaatgaacttagtgattgagctgggattttcaagcaaagggctgaaggtgccatctggcttttttgtgctgcttatagtaaactgtaagagtgataaattgaaggaagaattgttaaacatgaaggaaccaagacctgataattttgaaaagtctcaatctctctggacagcaaaatatgctagaattaagaaatggcttttgagtactttcaggaaaacatggtatagacatatagccacaggtaagactacataactactggttag

SEQ ID NO: 134685 - DNA, 1203 bp, Homo sapiens
tataggcatgagccactgcacctggccttgtgttgcttttgacagtgctggagacttacagtttattgaccttcatataacagttgtttgagtaccctctgtgttccagtcaccatgcagaggtgacaagcaggagctgttttctgcatcatagagagttatgtgataatcagttaagtgcagaatccttcactttctaggaaaggaaatactgcagttgtgaatgcagttgagaatggtttgaagccaattagtaaattggaatagttactgatgatgaaatacttacctccaggaattttttaaaaaactttaaaaccttggtaaaggcatttggtgattattttgctggattagaaaaccttagaagtttttacagctttgatataaagtacacctgtagaaagactgtcacctggtacttccctaaaagacagcagtaaaattttgcactcttttttaaaagaaagaagttaagtttcatcttaatgtctagtcagcagagagagggaagtatgtaacgttttaaacctttgctaccgaacagaactttctgtgattatggaaacattctgtatctgtgatgtccagtatcatagctgaaagctggcccttggccatgtgaagtgtgactagtgtgactgaggaaccggtttttaattttatttaactctaatttaaatttaaatagctacatggggctgatggctatgataatggaaagagcagatgtagaacaacataggcccaagagctcacagaccatgtctgttttggacaccaatttcttgccctacttgtattccaaacacattgacatgttcatgtgtaaaataaatatgaatgaatatatagatgaacgagtttgagaagttttcatcctttgaaagataagctgtttcagttgtctttcatgttattccctgtaataacttacaattgttacatagcacatataatgtgttttccttataatgaattttttttcgtttcttgcgatatgcttggtcatattattcatttgtttagtttttggcatttctttaaaatgtgagaatgactttagggtatctcatcaaactcaaaagctactgtttagattttagtttttcaatctacgggagagaagttgagactgagaattgagattcatcataatggactcttgacatttgacatcaatagaacagttgttactgttct

SEQ ID NO: 134686 - DNA, 296 bp, Homo sapiens
gcaagctcatggaattccaccacagccatggattattcattacacaaaccagagagacatctgtaattacactgtcactgtaaccattgcagagttatctgctgtattctgaaacagggagactctcctgaaaaatcctgacctacactaaccagctctcagtttgcagagatttgatggagcccagagagacctgggctccgggaggttgaccacgagctggtttgtctcctggagggaggcgatgctcctacagggtggtctggcctctttaagagaaaaaaaaagttacacag

SEQ ID NO: 134687 - DNA, 402 bp, Homo sapiens
tttgttgaaaatagtagtttcaaatgaaaccattttttcctgggtatttagttaaaggcttctgtgcattgggagtgttctgggtagtggaggtgacatggatttagccagctaataaggtagctggtccagcatctgctcctgatctttgaccttcatagcatcagcgttagcgttcagtggaatggcgggctcgctttggagaatgccttaccgtgtgtgatcctttgtgtcaggctgacctcatctggataaggaacaggactgggtagaatggatcactggcagttctgtgagcacttaggtggaggcagagcccactcaactgggactcctgaaaggttgggcattgccctttagtcctgcctttcccaggtcacttgctcaggtagtttgatgcct

SEQ ID NO: 134688 - DNA, 485 bp, Homo sapiens
ttgtgctagctgacctccacctcggctctctaaacctcacccactgtggaagaaaggggaggtcccacggtacttgccttggcctttcttcccagagggaagctgtgttgactttgaaagaaaacagttaatctgttccagcccttaaggatgctctattgcaattgtttgtattgcctgtgtacttaactatccccacctgtttaggatccctttggcccagttccattttcttctgccaagtctaccagagtcaccattagcattagttgtcttaaaaggctttttgtaaaagcaagatgtatttgatgtttaatcatttgggaagtaaaaaagagatatgatttaaaatttacatatttaaacacaggagaagcaaccacactgtcttttggctgtgagaggcacatgtggttgtggaggcttttatcagaggataactatgtcttctccaccaaagagggcagtggtgtgccctcctccct

SEQ ID NO: 134689 - DNA, 426 bp, Homo sapiens
ttattgatgcctttaataatatatcattttctagaataaaaatagtctgagtacttttacaacgatcttttaaaaactagcccttttcattagagacgctctagtttttaacattaacaaaaaaagccaaaataattaagtgaagtgactgagaaaacacagcacatttaataaatttcaagcacctcaaaatttctcttgccctcatctgaaaaattaattgcaactattaccaacattttccctctctctacaaagttcaataaataagtaaaaacacctgctaagcttttaaagttaactacttttttaccctgctctaacatttggctgaaaacaacttgcaaagagagaaaacccttagacaaacttcttatatttcaaaggacttgtaaaagagaatctgctgacatattagatcctttt

SEQ ID NO: 134690 - DNA, 672 bp, Homo sapiens
tttttttctaaaatattataaatttagaaaaattttgcaaacagaaaacactgtagggacaatatatgataagtaaattgtacttcagcaactcattgctttttagataccactgaattatttgcactaatggaggaacattgttataccaacctatttatatttgatccacattttaagattcctgttcagcttatttactttcttacttatgtcttatctggattcttattaacgttagttctcccttacttgcttggaggagaaatcattagaaacatgctgagaactgggagatggccacttcaagtttaaatttgctatgaagaagctaccaataaccttctttcagtctaaattaaggtggcctgtagttttacaacccaaagcatgattgtgggatgctaatttagggaactattctgcagaaaccatgacacaatcagcttgctggtccgtatttagaaccatacttggaaattgtgctcaggtctgcaatttgtaattcatgggtaggggttgaatctagaggtggctgagagttcagccacaaaggtgataaaaggattgggaaagaactatgaaggaatttaaagaaactgggattagcttggaaagagaggaagataaagagcaatttaatcgcaatctttatgtacatagagaagctta

SEQ ID NO: 134691 - DNA, 691 bp, Homo sapiens
cagttaggatctttctcatcttaatattacagaagcttctttatccctctgctttcctttctttgtccctttcttcttctttgccttcatcaacaaacatttcttcagcacctgttatgtttcaggaagtgtgccaggttcagggaatataaagatgattaagcacagtattgcgccttgagaacttttcctctcatctatcagtcttactgaattcctatgctagtttcattccttctttgctccattcttttgcctctttcctagccaaggattcaacctactccccatttccattgaagatagtgcctttcctcactttgttcttgatgattaaggcaacaacttggttacagctggaggggtaaacattagagccaggtttaagcctgcttagcttctctgtgtttgaagtcgtaatattcctactggaatctggttgcttttagaggagatttttcttcacagtcatctggctcctggatctttgatgtgagtcaaaacttaggactaggagggtcacagagaaagctatgaccctgactttatttaaaaacatacgtgaattttttttttttttttgagacggagttttgctcttgttgaccaggctggagtgcaatggcacgatctgggctcactgcaacctgcacctcctgggttcaagtgattctcctgcctcagcctcccg

SEQ ID NO: 134692 - DNA, 161 bp, Homo sapiens
cctaatatgctctgctttgatttttaaagtaaactttaaattttgaaaaaatctcaaacttacagaaaaatgtcaaacagtacaaaaaattctattatcctgagttatctgagagtaagttgccaacaaattaacattgatacattactaccacttaatct

SEQ ID NO: 134693 - DNA, 800 bp, Homo sapiens
aggatatgtaatgatccaaatgatatatctgtatgtgtataacttcacataaggaaaataacttaaaaactttaaacagacagcaaattataacaaaggcctgtattctctgatagagtgactgggtatttataacataagtgttaagtaatcttcaagcagaaaagataatacatggaaaaatctcacactagtaactatcagtactaaagtaagctatcttagcaaaacttagaagtgacagctgagccagaggagtagagtgagtgaaagcattctaaatttcacaaccctagtgacaacaaatgtttgccttcatggaagaacaacatttgttcttgcaactaatcagaacttacatatttttaacaagtagctttctaaaagccactaaagccctttggaatattttttaaaacaacttcttttgaggttatggagatttttaaataggtcaggaaattatttctaagttgttatattgtgaagataaaaaagttttggtaggtaatatgtttgcagccacaaaagcacaaaatacaatgtttttaatattcaagatgtttcaaaatgttctttacgtggcacaaacttttttctaaaagtattcacagacttctggtcatctgattttataatttttgtccttgtaatttggcaaagagctaatacaggtttaggggaagggttaactctgccatttccttgttcccatatgcttgcattattactgttatcttttaatctattgattttttttttcctagaaatctttttgtgccactttccattttgtgtgg

SEQ ID NO: 134694 - DNA, 578 bp, Homo sapiens
tatggaacacacagggagggggtttgaattctagacttggggatacaagttttgtgtgagtagcacatggctgggggtgagtaggtgtgcggagagaataggcgacaagaggaaggacagaataattaccaggctggataatccagccttgcacaacggagcgctgctgataaaaaggggtcgtgcagtgggttttgtatctgttgtggccactttaataacacgtctccttgaggatagagaggcatcaccaccacgctcctcccatgaccctgcatgatggttcttcagtgccccgtccctgcccgacatcacattacacattcacaggcttattacctgtcgctcccactaacgagtaagctcacaaggatgaggactttgtttcatcctcattttcccctagaggatggaacagcttaaatgaacagaaaataatgaacagaagtatccctaaaacagaagccttgctatttacacaagaaacactgaaaagagacatatttggaaagcttgagaggaaaatggcagtcccgagtcaataaaaggcacacatttaaaactgccttcctctcatc

SEQ ID NO: 134695 - DNA, 361 bp, Homo sapiens
tagtccgttcgactgagcacagaataaggatcaggaatcaggcctgcagccttacatagatcatcccatttagtcctcacagcactcctgcaagaaaggaattgttgttcctattgttcagctgaagaaatgggatggagactaaggtgaagtgacctgcccagggttatacagcccctccgaggcagggcttgtatttgatcccgagcctggctcctccttcgccatgccagcaccaggagggtgctatactgggtctcccctactatttcccaaaccttggatctttggttttaacaaagctacagaaccttttattgtagttttcaaactgggttcctctgaggtaccctgggggctg

SEQ ID NO: 134696 - DNA, 753 bp, Homo sapiens
ggaatataaaacagttatgctaaatatgtttaaagtaataagggtagagagcaaagagcaagagactatcaaaaatgacctggtagatttgaaaaataactaaacagaatacatagaaatgaaaaatacagtaattgacattaaaaacctcaatgaagctttatacatcagttgaaaataaattagtaaactggaaaataggtctgaaaaaaattacacaaaatacagcacagaggtacaaagagatgaaaaaagtaagaatggttaaaagacatggaggacagaaaaagaagattcaacatttatctccttagaattctagaaagaaaaaatacacagaatggctattattaaaaagccaaaaattaacagatggtggtgaggttgcagagaaaaagaaatgcttatacactgttggtggaagtataaattagttcaaccattgtggtagacagtgtggcgattcctcaaagacctgaagacagaaataccattcaacccagcaatcccattactgggtatatacccaaaggaatgtaaatcattctaggacacatgtacgtgtatattcactgcaacattattcacaatagcaaagacatggaatcaacctaaatgcccagcaatgacagactggataaataaaatgtggtacatggaatactatgcagctataaaaaagaagagatcatgccctttgcagggacatggatggagctggaagccattatccttagcaaactaatgcagaaa

SEQ ID NO: 134697 - DNA, 735 bp, Homo sapiens
ggatagcgccactgcattccagcctagatgacagagcaaaaccccgtcttaaaaaaggaaagaaaagaaaagaaaattgtccctattttcccataagatttttctcaaggaaattgcagacagcaattccttcatgtgctgaaatagacacaaactcttaaaaacagtatctcactcagatggaaaatggcattcactcaacaaatgttcactgagtatccttctatgccaggcaataccacaggtcctggagagagagagtagtaaacaaaactaagcaaaaatctttgccttcctagaatttacattccagttgggggaggagggacacaaaacaaaataagtaaaacatacagtatattatatttaattaagtgagaagaaagaaaaacaggtaaatggcactaaaggtatggcaggcaggtgtacttctatagagagagacaggacaggcagcactgaggtgacactctgaataaagacctaagcacgtcttgtcggagggaaagcattctccatagaggtaatggcaagtgcaaacactcagaggcagaaacatgctggcagtgctcagggaacagagctgaggccaatgtggccgggatgatgcgtgcaaagcattaagaaataagaccaggaaggtgagcaagggctaggtcacatggcatcttataagcctatggcctttactctgagtgacatgggaagtcactgggggattctacgcagaggcgt

SEQ ID NO: 134698 - DNA, 116 bp, Homo sapiens
caaacaaactcactgaagtttgagaatcaagtgtctggtcatcagcagtgaaccagaagacagaatatggaagcaagtgggggtgttgagctagttcgtttgtgcctcagagaaca

SEQ ID NO: 134699 - DNA, 543 bp, Homo sapiens
taaatatttttagtagagacagggtttcaccacgttgaccaagctggtctcaaactcctgacctcaggtgatcctcccgcctcggcgggatccaggcgtgagccgcggtgcccggccagttcagtgttctttagatgtctgttagatcaactggtagagcttgtgactatgcatatcttctgtgtccttactgattttttactaatgctacagtgtattgatagttatgttaaaatctccagcggtaattctagatctgtctacttgagcagtttttgcttaaagtattttgaagccgtcatgtgtacacatttaggattgttaagtcttccttataaattcagtctttcattttcataacattttaaccttatttctgttaaatgtcttgatgcctagtcaaattatttgaccacccttttgctcctgtcaagcctgggcctttgttagtttgtgcttatttattagggttttgctcgtagacttagacagtgactcttagtctaggaaaggttcatcctcatgggcctcagccacatgttc

SEQ ID NO: 134700 - DNA, 855 bp, Homo sapiens
tgatttcatccacaaaatacattggggtcattaaaatctgctgccctatccctttcttgtgccctactccaaacccagtccagaactgtccctgagaagtctgcttattccagagctccctgtataaccggcctctgcacattaggaggtcaagagtcacttcctcctccactgaaccaacaagaaccactgggtagaacctccaagtcagaccagccaagtacctcccctgtggacaacctcaacctgcattcacatagggaaagccctctgccttatctgaaactctatgtggctcctctaaatctgacacttggagcaggttgttacacttgtgtgcctcaccaccatgcctgcacacttcacgcttcacgaccccactcatacacacacccccaacaattccagcagattcttctgctgttggccaggacaccccctcccacagactgctcagccacagccctgctgcacatgcttatcttgccctgctaattagcaactctaagagcaatggttcctaccatgaaaatctctttgccatgatttttatttggtattggctcacttttttgtccctaggaaacacctaagggatctggaagtggagaggcagctgatagatcagccactgcacatcttcagaagggtaccctaggctaaaaatcaacaccactgcctaatgtgacggcctttaagagtagcccaggggccgggggcagtggctcacacctgtaatcccaacattttgggaggccgaggggagggggtggatcacctgaggtcaggagttcgagaccagtctggctaacatggtgaaaccctgtctttagtaaacatgcaaaaattagctgg

SEQ ID NO: 134701 - DNA, 777 bp, Homo sapiens
tccctcctgccttcagacatcagactccagcttctttggcctttggactcttagacttacactagtggtttgctgggggctttccggcctttggccacagactgaaggctgcatcgtcagcttccctacctttgaagattttggactttgactgagtcactattggcttctttcttcctcagcttgcagacggcctatcatgggacttcaccttgtgatcaatttcattcctgcagaaaccacaataaagggacgtgccctcagttgccctgtctccctctgcctcatgactgaccgcggtgcatgacctgagtggccttgtgtggcctgctgctttctccccagtgaactgtgaatcgtcgtcatggggtgagatgaacattctaaattggtgaaactttgagcaggacaaccttcgcccgcacacagtatcctcattttccacctggactccagtcttttacttcccttatctacctttctactttacacaagtgatccaccgttcaaggttccactaatcggcatcgtctttgcctgtatgggagctggtgccaaaacaaactcacttgtactcttgcccctaatttcatttcaactttgtctttctgaattttcactcccacattctccttggagtcataacctccgataattctttggtcccaggcactcgctcccaaacgtaatacctattttcgctcccgactttcctcgattacttcgcgcacgacaccgggcatagaccggtggtgcgacagactggatcatggtaac

SEQ ID NO: 134702 - DNA, 170 bp, Homo sapiens
ccccttatccagagtgcaagcactctctgggttccagaaacaccattttcacttcttcaggactcttcctgctgttaatagtgtctgtgcttcaaattgattgattcccttaacctatgtgaataaccccctttctacaatctcttgaaccatgggaggtggactgtgtt

SEQ ID NO: 134703 - DNA, 290 bp, Homo sapiens
ataggatttcgtcatgttgtcctggctggtctcaaactcctgacctcaagtgatccgcctcccaatgtgctgggatcctgttgaatatttttaatgcagcttaaatttgtataagccttcaattttgatttgtaatgaagacaggagcagaaatatattttgtggtgccaccaagagagttcagcaaatccactgtaagttgtgtgagtacatggctcacctatcaacaatagctctttctaaacttgaaggtgagaactttagtaattttgctttgtcatggttgaacg

SEQ ID NO: 134704 - DNA, 336 bp, Homo sapiens
ggccaggctgccttcatatattttaatccaaataatttactgcaacagtctgaatgcaaaagcaaattttagaatattcttaagacattaaaaagatttgtaaaaatgtaaaacaatgcctctcatctcactgtttttgaaactaatttttcataagcatatttttggttaatgtgtaatagttttattctttctttttgagtcggagtctcactctgttgcccaggctggagtgcagtggcacaatctcggctcactgcaacctccgcctcctaggtcaagcagttttccctgcctcagccacccgagtagctgggattacaggcagctgccacc

SEQ ID NO: 134705 - DNA, 163 bp, Homo sapiens
ctggggtcagacagaggcacatgtggcagtttcgtttaactgctctggaacaggtggatgactgcaggcctgagaagttagggaggcttcttgaagaggctagatctgaacaaggccaacccacaactccctcccagatctagggaggaggaaaacacatttg

SEQ ID NO: 134706 - DNA, 299 bp, Homo sapiens
ggttaatgtaccaaagtgtagcttcattgggagttatgagcacatttcataaacataattccaggggttcgcctgtgatgacatcattccttttcacaaggtttatggatatccaccaagttgcccctcacgttatcccatggagacttttcccagctgagaaacagatgccgaaacagagacacaaccacttgggggaaacatgcaacagctgtacaaaggtgtcaaggggagggaaaaatgaaagtgtcaagggatgttgtcaccaactcagacagaatgggtcactagaaaaagtg

SEQ ID NO: 134707 - DNA, 313 bp, Homo sapiens
gaagaatggagaagaattgtagggcccaagatcagagagatgagtagggccagatcatgtgggcaagcttttatgtattagcacgcttagaattaatattctgcttgagaactaacctgatatttgaaacagagtgaaaaagaaaatacctcccacagtatacttcatagcttcttatttagcccaagctgtcagggaaataaagtccagctatggctaagtttcacataatgcactgctttggagtttttgtctcatctgttagagtaagataagtaccacatactattataaggctatatagcataaaatg

SEQ ID NO: 134708 - DNA, 741 bp, Homo sapiens
gaaagaatgtagattattggttgtcagggcctaggaagaggagagaatgagaagtggctgctaataggtacaaagtttattttgagggtgatgaaaatattctaaaattagatagatgtgatatttgcacaagtctgtgactatactagaaacctctgaattgtgtactttcaaagggggataagggtggattttacaatatatgaattatatctcaataaagctattttattaaaaaagaaaaaaaaaaaaaaaaaaaaaaaaaaaaaaaaaaaaaaaaaaaaaaaaaaaaaaaaaggaagggggggaaaaaaaaaaaaagaggaaaaaaaaacataaaagggctgcccacaaactagaggagggtcgaaaaacaacactcaaacacagcgccgcggacaccccggacaacaaacaacacacagcaactgaagcgacgaacaaaaacaaacacacagcaacaacccggatgcacacccctgcagcgtgagcgaacgaccccaaccacacattgaccccgaggggagcggacaacaccaaccaactgtgcagaagaacacaacaaacactgaggcaaggaagaaagacaaaaaagccacccaccagggcggccaccctaacacagacaaccacaaacaagagggatacacaggtacgtcgcagaaacacacagaccacaacttggacctgagacgcgacaacagaaacattgtgcccaccaacaggcaccagctaaaaaca

SEQ ID NO: 134709 - DNA, 1281 bp, Homo sapiens
atcatttaatcctcacaacaaccccatcagataaagtgatactgtcattcccattttaaagatgataaaactgagtcacagttaagttgcttgcccacgttcagagccagtaagcagcagaggtgtagagccaggcactctgactccagagtctgtaggctaaatcactgcacaatccagcatcccctcagtggaaaaagagctctgatgggcacgtccacatgaatgggcaggtcgttgccgcatttcatagacctgtctcaatacttgaatggttgcaacagtgcttaagaatttgccattggttgggcgcagtggcctcccagcactttgggaggccaaggcggatggatcacttgaggtcaggagtttgagaccagcctggccaacatgatgaaactccgtctctactaaaaatacaaaatttagctgggcatggtggtgcacatctgtaatcccagctactccagaggctgagacaggagaatatcttgaaccctggaggtggaggttgcagtgagctgagatcacaccaccgcactccagcccaggtgacagagcgagactaactaaaaaaaaaaaaaaaagccatcactattttagattatctaatcatctcaccagatttagcaaataaaatacaggatgcccagttaaatgtgaatttcagattaacaacagacaattttgttatatcccaaagattgcatgggacatacttagattaaaattgtacattgtttatctgaaattcaaatttaattaggcatcttggattttatctgacattcctattcctgaaagacaatagaatggcaacttatttcactttatatttacctcaaacaaacatccgtcttttttacaaaactctctttttcccaaacagtctgtggctttttctttaaatcaagttacagcaaactgtcatcgaaatccagcctgctgcctgtttctgtatgggctgcaagctaagattttttttttttttttacatttttaatggttgaaacaatcaaaagaaaaatgctatattctatgacacattaaaataatatgaaatttgactttctgtgcccataattaaaatttcattgaatcataaccaagctcatttgttacatatgatctatggctacttgcacattacaacagcagagttgaacagtttcagtaaagaccgtgtgacccacaaagtctaatttactctcaggccttttacagaaaaagttggccaacccttttcttggacaatttctcattcatgatgggtaataaaca

SEQ ID NO: 134710 - DNA, 335 bp, Homo sapiens
acctcagttgagaaccactaggctagtgagcactacagtctagtgtgggaaacggacaaccacacagaaaaatgacatccatacacgcattgtgaaacagtagactacttatgagcgacatggggttcagtgatggagaacagcaagaggtggcttctaggacactctcaaattcactttctttttcttaggctgacacttaaacaccatgtagtgcctcttgaatagccacacaagtttgtttatattatgtcagcattgtgagtttgcaaacatttgacaaaatttatttactaaaggtaatatctaaaattagttgtcctttattttaaaag

SEQ ID NO: 134711 - DNA, 664 bp, Homo sapiens
catccaagatctttcctcttgaaggaggaattctgaaagtgtttgctctcagcccagctctaacgtgtcattatagaggaggtctccaatttgaaatttctgagtgactttcataacattgtaatgtagagatgaactttttacctgattactattggcagaatctcctgctgccagtggggatcacgccactctgcctgttctcttccacggagcttagcacagactctttggtaaaataatcatttgcatacacaactcatcatctaagaccgtgtttgatatttgctcattctttatgtgtgtgtttcctggagccctcactttagaggtcagaagacttggacctgaatcctggctttactacttctggtagccatgaaaactttgacaagttattttatctcccttagcattagttgcaaaataagaataacagtttctacctccttgggttgatttgaggatcaagtgagatagcgtgtgtcaaatcctgagcatgaggcctggcccaccgtgacagcggataaataaagtctaacattatcaggaatgatgctcttgagtgggacagagatttgatcctacgtttttcctcgtagggagaaattctgcaatgctgccttgtcgctgttccatgttgtggagccagtgtgacttgctg

SEQ ID NO: 134712 - DNA, 518 bp, Homo sapiens
gtaaataaaataaaatataacatggacatttcaacagaagctatatggtaggcaaaggaggcagcatgaaatttacatgattaaaatacagctgcctttagacaacaaaaatgctgaaatgtgccataagcttagagtagttctcaaataattctcaaatggcacagggaaaacacttttagtaactgatcagagaagaagcaaaaacattcaccttcaaaatacagggcttcgggccgggcatgatggctcacgcctgcaatcccagcactttgggaggccaaggcaggcagatcacgaggtcaggagttcgagaccagcctggccaatatggtgaaaccccgtctccactaaaaaatacgaaaaatcagccaggcgtggtggcacgcgcctgtagtctcagctactcaggaggctgaggcaggagaatcgcttgaacccgggaggcagaggttgcagtgagcagagatcgcgccactgcactccagcctgggcgacccactgagactccgtctcaa

SEQ ID NO: 134713 - DNA, 787 bp, Homo sapiens
ctatataaatcagttgaaactgagcagtagtttcttaattcccagatctttagtatttctcaatcctaatccttgtgtttttgacattgttgagcctttgagcttcccttggtttctcttgctgaaccttcccgtttatccgcctgcttcttttctttccttcattgtgtcctcacatggcttctctaaagttttgtttctattaatttcatccattctggtcttggactgtatgtgcttccctagtcaacctttttaacctcaagctagcatctgacctctagagccagatttatctccgccttttagaatgctgcatcaggatatgccggtgtgttggatagtcttcatgcctaccctcaggctcagtaatttgctaagagcattcataagactcagcatgtagtcatactcatggctatgatgtattttagtgaaaggatacaaagcaaaatcagcaaagagaaaagacacatggggccaagtccaggagaaaccaggcacaagcttccaagggtcctcttccagtggagtcacacaggatgtacttaattcccccagcaacaggtagtgacaatatgtgtaaaatgttgctaaccagagtagctcgttagagatttggcacccagggtttttattatgggttggtaatgtaggcatctctgcctagaacataccaaaattctagactccctgaaggaagataagtgttctgcataaaccctgtagtttgtataaacattttaagcacagtgaaccacctttttcagttctgggaatggtagga

SEQ ID NO: 134714 - DNA, 1421 bp, Homo sapiens
gtagacacttctcaggttataattcagactcaataacaaagccagaaagttcaggaagggtagggtagtgctgtggtctgaatgttgaaatcctaactatcaaggcattaggaaatggaacctctaaaaggtgattagatcatgagggcagaaccctaatgaattagtacccttataaaagagaccccagagaactggtttgccccttctgccttgtgaggttacagcaaaaagaccatcatataggaagcaggacctcaccagacaccaaatctgccaacgccttaatcttcgacttcccagactccagaactgagagatataaatttattaagtttataagctacccagtctttggtattttgttataacagcccaaactaaggtaacaagaagcaatcctcacagtgcttgcttaatgtcatgcacctgtcattctagtggtgctcatttgccagtcttttttttttatgaaagaaattagcagtcctgctttctcttgttttgagtgacaggtctcaggtaaggatttattttccagaaagaaagtgactaaatagattccctccagaaagattttcagatcagtagatctgccttaaactaatgtagtctttggacccagttcagaagtggccaaggccaatcctcaatgcatgaaagtaaaagttagactgtatttaagggagacaaattactagttaggaaccatcgaatgaggtcagaggcaagaccttactaacagatgggcaagttaaatgctatcttctgaaaattttagttgcttcatgatggactcatttggagcatatctggaaagttttttggacatgtctaaaacacggggttgaattttccttacaagccagggttaggacaggaggtcgacctgctgtctagatagtctcagcactaccagaagctatttgtaagctgtactactagtctggtgactcaagtaggaagtgtccaggaacctttcttctagacactgcgagaaaccaaagattagtaataagaaattgtttgatagacaagatgaacatcttaaagcatagattcaagacagaggacctttgtacctgacaagtactcaggaagacttgaaaagggcccccgcaggtgagtttcaggctctgtcttccactcatgaacctgcaaaatccaatccttgctgctgaagatttcttaagaaaaatgaacagtgtacctggccacttcagtgtctttagaatcccatcttggtgttatactttgcctattgattctagatggagaggtatcaaatgctttacaaaatctcaaggagttataaactacttttacaatctgtgttataaagtgtattccctggttattataaataggcaaaatgctattccaaatctaacaataaagacttttgccaataaaaattgttt

SEQ ID NO: 134715 - DNA, 313 bp, Homo sapiens
tggcagaggccaccttctctcagggccctcactcagcctcctccctgttcacacatccctggtgtctcttcttataaggacatcagttgtattggattagggcccacccgaatggccttatttaactttatttatttatttttattttattttattttaagacagagtctcgctctgttgccaggctggagtgcagtggcacgatctcggctcactgtaacctttgcctcccgggttcaagctattctcctgcctcagcctgggcaaccaagcgagaccccatctctacagaaataaaagtttttaaaaaatt

SEQ ID NO: 134716 - DNA, 141 bp, Homo sapiens
ccagaccctctgctccctgttcatcttcctcacctaaacattaagagaagcaaattccacgatcttgtaatcccttttggatacaaatatgtatgaagctaaatttgtggacttttcagaagtgtcagccaagtggcgaca

SEQ ID NO: 134717 - DNA, 439 bp, Homo sapiens
gaggcagccgggtgagtatgcatatagtgcagtggggatagctataatggatttggtaatgataggaagcaattttggaggtaggtggaagctacaatgattttgggaattagcaacaatcagtcttcaaattttggacccatgaagggaggaaattttggaggtagaagctctggcccctatggcggtggaggccaatactttgcaaaaccacgaaaccaaggtggctatagcggttccagcagcagcagtagctatagcagtggcagaagattttaattaggaaacaaagcttagcaggagaggagagccaaagaagtttaggcactaattcaacacagcaagcaaaataaaataagcctgctgcagtaacagagagataaaagggcagctggaaacccagcatttgggtacaagtacccaacaaagaaatcctgcc

SEQ ID NO: 134718 - DNA, 491 bp, Homo sapiens
gaatcaatgaaaacatgaataaatgaaagaaatagtgacatatgcccttatttcttctatgtttaggtaatgctacacctgagatttggaagtatctatagagtgttttgggatcatttctggagttatttctttctcaagttcaggcagcaatcattttgcataaaaatcatggctgggctgagtgtggtggctcatacttgtaatcccagcaatttgggaggccgaggtgggcggatcacctggggattgtgagaccagcctgaccaacatggagaaaacccgtctctactaaaaatacaaaattagaaattagccgggtgtggtggcacatgcctataatcccagctacttgggaggctgaggcaggtgaggcaggaaaattgcttgaacccaggaggtggaggttgcagtgaacccagatagcgccattgcactccagcctgggggacaagagcaaaactccgtctcaaaaaaaaaaaaaaaaaaaa

SEQ ID NO: 134719 - DNA, 144 bp, Homo sapiens
gcacacttatgcatgtgtatatgtaagggatctattgaaattttagatgggatgtcaacgaaaggcctcacagggaagatgcatttgaacaaaggcctgaaagaagtgaagagttagccatgctgatacctgaggaggaatgtt

SEQ ID NO: 134720 - DNA, 783 bp, Homo sapiens
tgcagcttgaatcagctttgagaaaagaaagcaacccgagtcccagctccaggactgaaattcacctctccaaacccctacccgacctccaggcttttctggctgaatgtagaaagagaaaacacccaaacagccctccagagaagaaagttgtgcaaagatttgcatatttaccctccaagtgcccaggcccacaatgggcatcttggcttttgtactgagctccacaaacgtggccatggttggtgcggaaatgattctgagtgagcaggtagaagtctcacgtcctgctgtgtccagagttggttccttccagagggttcgtggtctcgctggcttcaagaatgaagccgtggaccttcacagtgtgtgttacagctgttaaagatgttgtgtctggagtttgttccttcagatgtgtctggagtttctcccttctggtgggtttgtggtgtcgctgacttcaagaatgaagccgcagactgtcgtggtgatcgttgtagctcttaaaggtggtgtggacccaaagagtgagcagcagcaagatttttcgtcaagagggtggagtctcgctctgtcacccaggctggagtgcagttgcccaatctcagctcactacaacctctgcctcccgggttcaagcaattctcctgcctcagcctcccaagtagctaggactacaggtgcacaccaccacacccagctaattattgtgtttttgttagagacgaggttacaccatggtggccaggatggtctcaatctcctgaccttgggatctgc

SEQ ID NO: 134721 - DNA, 710 bp, Homo sapiens
tgtcataaataaataaataaataaataaagtttaaaatccataggtgtttggtatactcacaatgtcgtgcagccatcaccacgatctagttccaaaacgtttccaacaccccgacaagaaactcccatacctgtcagcagttaccatttgtcctccctcctgtacccccggcaccccgtaaccattcatctattctctgcatctattctctgcctccatgcgtctcgggaatcatggattacgtgaccttcgtgctgtggcttctctcacgtagcacagtgtttgcggggctcacccacattgactcatgcacctgtctgggccgcattcttttttatggctgaataatattccctggtatgggcataccaggttttgtgtatcctttcatcagctagtaaacattcgagctgtttccacttttttggccattgtgaataacgctgctgtgaacattcgtgtacaaatgtttgtatgaatgcagttttccattttcttaggtgcaattgccaggtcatatgtagtcactctgggctttgctttttgagtctgttgtattttatttatttatttttttatttttgtgggtgcgtatatttatggggtacatgagatgttttgatacaggcatgcaattcataataatcacattgtggagaatggggtatccatccatcacagatttattctttgtgttgccaacagtcca

SEQ ID NO: 134722 - DNA, 283 bp, Homo sapiens
cagcctgggcaacaagagcaaaactatgtctcaaaaaaaaaaaattaatcttgtgtagatagtgaccacgttttactttccttgggacagtcctggtttatacctgctatcctagcgtaattagtaatagcacccgtttcactctcaaaaatgtctcaatttggatcataaattatacgcttaccataattgtagaggattgtgagacttttagtcgctacctagcaacctagtttttcttgatagagctcttcttattctggagtctcctgtgctgcgattt

SEQ ID NO: 134723 - DNA, 484 bp, Homo sapiens
agccaggcccagggggggtccccacagagtcactccccaggcagcccctcctgcctggaccaggccgcccagtggctgataagccacaggactgcatgacacaatcccgctctgatcttctgcccagccgagcctctgcccccaccccacccctggaccctgtttccatctcctccctttctgggtgggaccaacgccccggcctggtgtcattcatggtgggctgtccagagagccagcttctctgtgaacctctcagctgttgaggtctccccaaagtccaccctagccagagggctggcagcaggagacccctgcagagggaggacagtggcctgtgccacccccacctgccgggtgggggtgggggacttagggcccatcttggcccctgctggcctcagcatccccacttggtaaaggaaaagctcggagaagagatgaggctgcgccgtggaggggaggaggctaagtgggctctgga

SEQ ID NO: 134724 - DNA, 297 bp, Homo sapiens
ttatctggggtgcagagatcgttatttctgcactatcaaatcttaaagatgtgaaatagctttcatcacagctccaaaaatagagcaccaaaaatggaactaatgagcccgtaggcattttgaaattaggaggaaaaaaaatgaaatggcttgttttgttaaaatcagaaggactattttaaaatgtttcctagagatttggggggggctcttcaggttttaaaaaaaagctttatccctttgcttatttttgtgtacagtttataaatcaataaaatttttgttattattttcgca

SEQ ID NO: 134725 - DNA, 158 bp, Homo sapiens
tttttttggacataattgggtagtagtcaaatggtgagctgtggaattagattatttggatttaaattctgtttttacctcttataagctgtaagtttgggtaaactactcaccttctccagatctcagctttcccatcagtaaaatggaaataatta

SEQ ID NO: 134726 - DNA, 263 bp, Homo sapiens
tcagagaggttaaataaagccatcatctcctcttccctctctctcaccccatacatctcatcaagcgcagagaataactggttaaacgatggatgaatgctgattcctcctttctaccctcactgccaccatcctctttcaggcccctgtatcctgagatccttgtttgcatgtctagagtcatgatgctagactctccaagttattctgcacactgaagctgttttcctggaactaaaattagacgatatcatccctcttct

SEQ ID NO: 134727 - DNA, 115 bp, Homo sapiens
ttaagtcagactgcaaacatttgtgtattcattcattcattcaatgcttttgcactaaatggcggattttgccagccatgttagttacattaagcagactattaacccaagtgaa

SEQ ID NO: 134728 - DNA, 605 bp, Homo sapiens
tgaggtggaggcaaggcccaagctgattccacgtagggcacctgggtaggggtgtgtacttatgaaactgaaataatactggatccaggagaaaaatgtagtatatttgaaaagatttggaaatggcaagtgtgctcttcagtgattagaaccggaggaaatgcacccatgtccacagcagccttatcatagcagctgaaaaatggaagcaacccaagtgcctatcaatggatgatggataaacaaaatgtggtccatccatgcaacggaactggattcagccttaacaaggaaggaaattctgacacatgcttcaacatgcttcacatgcctcaacatgcttcacatgccttgaggacgtcatgctaagtggaagaagccagtcacaaaaagacaaatactgcatgattccactcatacgaggtccccagagtcatcaaatccatacagacagaaagcagaatcgtgcgcgcccagggctggtgggaggggagagggtgacatgtttaacagggacagggtttcagttttgcaggtgacaaagctcacgagctggatgctggtggtggttgcacaatcgtgtgaatggacttaacactactcaa

SEQ ID NO: 134729 - DNA, 1029 bp, Homo sapiens
aaagtcatgattagtttcacatattacctcttaaatcatttacttttaaaatactttatctgatttttcagtcactttttcttttcaaatacattctcctgcttatagtcttcttaaaataactactgcctacatacagaagagatgatccaataattgtatcacataatttattgttaattcaattttgaggttgcccctgaactcattgtttaagtgtgactgggttttggggaagtttgtgatttttattgggtttcgcaggagccctcctagaaactatctcctagatagaattttctcattgaaccatcttcagagatagaatttttttcttcccatccttggtaaggtcatggcagtaggattgggaaagaattatacacttatttatatttgggacatctttgttgtccttttagtatcagcacacagaattaaaatacagacatttaatagatatgatttgcagattccagaattgtgttttaatatcatgcttttcacagtaagtcatattaacacctccttcttaatattacacagttgtgacacctagtctcttggctaattgctgggttctgaaattttcaatagataaattttatatatttgtacctatgagtgtattatattgcctattctgttattctgaatcactaaactaatgtatatgggatattcagcaatacttaaacagaagacgacaaaatgaaataatggccaaaatccaagcagctattatacagattcctaaacctgcatcaaatcgtactttgaaagcactcgaggcccaaaaaatgatgaaaaagaaaaaagaggcagaagatgtggctgatgaaattaagaagttcgaagcattaataaaaaaggatctccaagcaaaagaaagtgcatccaagacttctttagatacagcaggccagacaaccaccgatttgttaaatacttactcagatgatgagtacattaaaaaaatccagaagcgccttgaagaagatgcttttgcacgagagcaaagggagaaaa

SEQ ID NO: 134730 - DNA, 1084 bp, Homo sapiens
agcgtcccctcttctctaaggcctttcgcctagttccagcctggatacgcttccatagcaaagggttgcccttggctacaggaggacgcgggctggcaggcttggttcctggcgagtttctaagcccccgcctgcggtctgaggcaccggctgaaccatgtcggagatcctgtgccagtggctcaacaaggagttgaaggtgtcccggaccgtgagtcccaagtcatttgcaaaggcattttccagtggctatctacttggagaagttctacacaagtttgaacttcaggatgatttttcagaatttttggacagcagggtttcaagtgccaaacttaataatttttctcgcttggagccaacacttaaccttctgggtgtgcagtttgatcagaatgtggcccatggcatcatcacagaaaagcctggggtggcaacaaagctgttatatcaattgtacattgctcttcagaaaaagaagaaaagtggactgactggagtggagatgcaaaccatgcaacgtctgacaaatttaagacttcaaaacatgaaaagtgatacttttcaagagagacttagacacatgataccacgtcaaactgatttcaatctgatgcggattacatacaggtttcaagaaaaatataaacacgtgaaagaagatcttgcccatttgcattttgagaaacttgaaagatttcaaaaactcaaggaagagcaaagatgtttgatattgaaaagcaatacttaaacagaagacgacaaaatgaaataatggccaaaatccaagcagctattatacagattcctaaacctgcatcaaatcgtactttgaaagcactcgaggcccaaaaaatgatgaaaaagaaaaaagaggcagaagatgtggctgatgaaattaagaagttcgaagcattaataaaaaaggatctccaagcaaaagaaagtgcatccaagacttctttagatacagcaggccagacaaccaccgatttgttaaatacttactcagatgatgagtacattaaaaaaatccagaagcgccttgaagaagatgcttttgcacgagagcaaagggagaaaa

SEQ ID NO: 134731 - DNA, 534 bp, Homo sapiens
gtcccaagtcatttgcaaaggcattttccagtggctatctacttggagaagttctacacaagtttgaacttcaggatgatttttcagaatttttggacagcaggttagtgagattattcctttttgttgttgttgttgtttatttgttttgagacaaggtcttgttctgttactgagactggagtgcagtagcgtgatcatagctcacagcaacctcaaactcctgggataaagcaatcctcttgcctcggcttcccaaataggtgggactacaggtgcatgccaccacgcctggctaatttttgtatttttggtgtagacggggtttttccctgttgcccaggctggtcttgaactcctgggctcaagagatcctcctgcctcagccttccaaagtgttgagattacatgtgtgcacccccgcttctggactactctttacttttaagaaaagttcatttctttggcattttccaaagttaacttcaaagaatcatgaatcataagatcccttccaaaccttgaacacccaag

SEQ ID NO: 134732 - DNA, 950 bp, Homo sapiens
gtgtccactgtggtccccgactctgcccacaagctgttcatcgggggcttacccaactacctgaacgatgaccaggtcaaagagctgctgacatcctttgggcccctcaaggccttcaacctggtcaaggacagtgccacggggctctccaagggctacgccttctgtgagtacgtggacatcaacgtcacggatcaggccattgcggggctgaacggcatgcagctgggggataagaagctgctggtccagagggcgagtgtgggagccaagaatgccacgctgagcaccatcaatcagacgcctgtgaccctgcaagtgccgggcttgatgagctcccaggtgcagatgggcggccacccgactgaggtcctgtgcctcatgaacatggtgctgcctgaggagctgctggacgacgaggagtatgaggagatcgtggaggatgtgcgggacgagtgcagcaagtacgggcttgtcaagtccatcgagatcccccggcctgtggacggcgtcgaggtgcccggctgcggaaagatctttgtggagttcacctctgtgtttgactgccagaaagccatgcagggcctgacgggccgcaagttcgccaacagagtggttgtcacaaaaatactgtgaccccgatcttatcaccgcggacttctggtaaggcggtggggaaggtggggccggctggctgcgggctctcccccatccccgcccccttatccctctgaagacgagggcagagagtgcagcgaaacaacgaaagcgcagcacttggatgcgcatagtggggccggattgaaggtaggagcgggacgggatgcgcaagccacaaaacgccacacaagcagccgagagcgcacacgggtagaccccccaacctcacaaatcaccaaaaggtatgcaaaggcgacgccaaaaatacaccgaaaacacccccaataacg

SEQ ID NO: 134733 - DNA, 678 bp, Homo sapiens
taattctttgttctggagaggctgtcctatgcattataggatgtttgccctggggagggggaagaggatggcaaaaatcatctctgttgagaaattgagttgattttccagtacactttaggacagccctggaagtccattatttggctgaatatttaataggtgccacactctagcctttatttaaaagactggagtgctgggaggaaaacatgacaaatgaatggcttttattaattagattttagataattcaatttttcatgtctttcaattggtctttggtttgaaaataaaaattgttaagtttgtcatgtatgatgtcaaacagtgcttaaattcctaaaaagatagccataaatgtttatctgattttgaagagaatttttaatcccagtcttaagaatgcttaatgttttgatgtatactatgtttgatgtaacccgctttcaagttagactcaaaacagattcacttataagttaccactattatttttcgtcctatcaaagaagaaattcccttttgcttctctgaattgcttgttgcctagttagcacttttaaaaagctggtctaatcgaatatgaaccttcaaaagatatacttgaagggccatctgctgaccccagctcttgtccatgtgagcaacttgtaatggtggctctgatggccatgt

SEQ ID NO: 134734 - DNA, 712 bp, Homo sapiens
taatttaaaataacttttaaaagaagacaccaaaatgtaatgcttttagtggttttcagttttctgcctaatttaaagggatgggtggggagcgtcggttaaatgtaagtaagaaatatgtgttcatagatttgttttcatagtcacagagaagtaatagtgttttaaaattcagcctcaagtaattcgagcttcagtgtgggagtggggtgtcaggaacccggtgtttcagtttttgtttctagtgacttttacttagggagtttcaggttggaaacttacgcatgttatttattacagaattggtgtcgtgtaagcttgtttcgttctattagaatgtgtgatttctttgaaagactgttttgctgactctccagtttaaggggttagtattagtgaatacaaaagtgtctttaatatttattgaaaaaccaaaatctaagccaaaaagtaagtgccttttggtgtattcataactttgacaggcaacatcaggaacctgagagaatgtatctaaaaattgctgggggaggggagttcgatataaaaagagcaacaaagtagcagtgttagtcggagtctttaaggtgtttactgtgtaatcagacagataatacttatgtccaaaagatattcagatagtatgtagatgtatgcaaaactataacctagatataaaacttttcaaagtgtttttgcattcattttcatt

SEQ ID NO: 134735 - DNA, 165 bp, Homo sapiens
aacaatcttaaatgaaatttttatttttatgatagccatttacatgtataataagagccaatgattcttgggagcagtgtgacagaaacagagtgtggcgagaactcatgtaagacatactatttaaatgagctggtgttagctattcatatttgttaatgaact

SEQ ID NO: 134736 - DNA, 245 bp, Homo sapiens
aggtatctctggggccaatgtactgggtactttacatgttcattaatccttagcataatagtgtacagataaagaactatgacccagagagacaggagaatttgcccaagatgatggaaccagaatttgatcctaattctgtctctctatgaagctcatactccttctgctaccctacatcagaaaagactgacagaagaagttacagtctaataaagctaataaaaccccacaaaactcagttt

SEQ ID NO: 134737 - DNA, 568 bp, Homo sapiens
tttttttttaatgtttttgtttattatactggccatgaacactccaccacagtaactctccttcttatttgcttcctaagtcagaaattctggaatctagacaggaatctatatttaactccacttgtaaccttcagtaagttgtttaaccacaccaaacctcagctttgtcaattataaaagtgaaagaggttagttaccatgaattatatgacataatttactttgaatttattcacatctggaactgtgaacactaccttgtcactgagaaggccccccctcacttccatcctcttcacttctttccacactgctctctacaatactattcttcataggtcatttttcatcaaaaaccttcaatggctctccaccaccttggtagcaatcaaaaacttttcacaacattcccgcattttgtttaagaaagttttcacatttggccaggtgcagtggctcacaagtataatctcagcagtttgggaggctgaggcgggcagatcgatttgagctcaggagttcgagaccagcctgagcaacatggcaaaaccccgtttctacaaaa

SEQ ID NO: 134738 - DNA, 151 bp, Homo sapiens
gaggtggcacccccaagacacagcgagaaatccaggctgcaggagccagtttcttcaacaaattgcacaaggaaaaagagaggaagggaagctcctagacatcatcggacatttaaaagacaggcggtggctcaagcctgtaatcccagca

SEQ ID NO: 134739 - DNA, 418 bp, Homo sapiens
taggatgtgaggagacaaatgcataattttctgtaatattgtgcatactccttaggacttcacgagagacgttgtgctggaggaactggagagggctctgtggagaagatgaggctttagctggtcctggaggtgtcagggcttggagaagaggggagaagagaaggcataaagcttctgcagcaagaatgagttttccaggcatagggaactgaggggagaggggtcttccatgacagagggtacataacattttacagatgagttgaaaatcaaattgctcaaaagatggagagtaggttctggggggacttggaagttacgcagcatttactgttggtgtggttggcaaaagtgaaagctgtagatacttaaataagagtatggcaggttgcaagtagtattttagggcaatttg

SEQ ID NO: 134740 - DNA, 343 bp, Homo sapiens
gagccaccacatgtggcccgttctccatgattctaaaatgaacactggaatagcactggacattatatcatgagatggctgtgcatatgtggtgcctcccaacagtccgtgagtactgtgggcatgtctcatttattttttataaccatagtgtctagcacacagcagacgctcaataaatattgactgaatttggtttggccaaatctctccagctggcagcactgcctcccagtcatgatgaagtaagacaacagaatcattcactgagcatctaccaccttctgggtgacttaaatgctacttcctggatctcccaatagcaattttaagtccagagatt

SEQ ID NO: 134741 - DNA, 393 bp, Homo sapiens
actttattgggactgctgttactaaattattacatagaatattcataagccctttgatttatagttttataaaatgcatttgtaaattgggtcgtatccgagaagaagataaatattactctggcgtacttttcatatctgctattttccttaaatattatttaatattaatagtaaaaccacatcaagataactagtaagctgctgtatagcagtgctaagcctaaaagtgttactgcaacatggcaacattatcagaatctttttttactcatgaaaagcgatttatggaataaaatatattatctctgagctttgttataaaagacagtttcatattatttcagccaccatagatacatttaatatcttgattataaaatctcattttgc

SEQ ID NO: 134742 - DNA, 513 bp, Homo sapiens
aaataagaaacaaattatttttgacatgtcaccattattttccaaatatgcttttatcgttttattcaccaagtaggtgggaagagaaaaaaggagagtggggccgggtgtgagggaatgtactgttgcttcaatgttaagttgttgctgaagcatttttattgttctaaaagggctttacatttgccaatatgttaaatactaaatggaccagttataggcttatattataaatcgaccaaatttttttccccatagtaagttcagtgacttgtacatagtaatgctattctaatagcgctgcttagtaatatatgtaggggtaagtcttcagtgtttcaacatttactaaatgtcttacggaaaattaacgcttcttagtttcttcattacggacacctttttgctatacctattttcatttccatgattcaccaacaaatgttcaaaacacttttatttcctcgccggaggagtttggcaattggtttttcttctacactctgagctcat

SEQ ID NO: 134743 - DNA, 651 bp, Homo sapiens
aaaaattattgaacttacagattaatccaaattaaccaaacaaaaaaagtctaaaacaaaatgaacagaacttccagtttgtgggacaatatcaggtgttccaacaaatgtgtaaatagggtctcaaataatgaagagaaattgaaagggtcagaaaaaaaatttatacaaaaaactggctgaaaacttggcaaattattttaaaaatattggctttcagatctaagaatttcaatgaacctgtagtaggataaacacaaaaacacttcactcaggcatgttgtcgtcaatctgttgaaagattaagagagaatctttaaagtaaaaagagaaaaacaaaacctcatatgtaagagatttcctaatacaattaaggtgaacttctaatagaaataatgacaaccaaaagacactgaaataagatatgtgaagtgctggggggaaaaagatgtgacaaccaacagtactgtatctagcataactatcactcaaaaatgaaggcaaaataaggatgtttccaaataaatacatggaaataatggattcctatcgtacctgctgtacaagaaatgataaaggaagttcttcaggctgacacgaaagataccagatggtaactggaaactacaggaaggaataaaaatcagggaa

SEQ ID NO: 134744 - DNA, 417 bp, Homo sapiens
tcactgcaacctccacctcccgagttcaggcgattctcctgcctcagcctcccgagtagctgggactacaggcatccaccagaccacctggccaatttttgtatttttaatagagacagggtttcaccatgttggtcaggctggtcatgaactccttacgtcaagtgatctgcccacctcggcctcccaaagtgctgggattacaggtgtgagccaccatgcccggcccaatttactgattttcttctcataacctgctctttttgaagtctttctgcctcagtagctattccattctagtactcggtgaggccaggagtcatcctttataccccatattcaatacatcaggaagtcctgttggctgctgtacctttgaaatccgtgtataatctgtccatttctcactgtcttcac

SEQ ID NO: 134745 - DNA, 407 bp, Homo sapiens
cgccttaacctcagtgagtctttgagcgttatgtgctgcggctctcacatatccagaacaatgagagcggctgtaaagggccctccgatcaacatgtactggagtcaagagaagaaaggggcactgggaggaatttgggtggaggaggcaggaactccagggagcacagagatcatcagcagagtggtctccatccttgtttacactggcagccaaagactaggcagtatttatttacaaaggtaaaaggagatcaaacatccggtggctcggccagctgtggtggaggttttcacagaggcggacatcaaacccccaccctgtcatggctgcagctgtcctccttcccggctcctgccctcctcttggcctcccatcttctcccaggtcctaggcaggccatggca

SEQ ID NO: 134746 - DNA, 734 bp, Homo sapiens
ctgatgccctgataatttaaatattaggaaccgagccaacaccagaaattaggtctcctagttttaatctattgttctttatctgtatacctattccattataaaccagggcacactttttttttaaggaaaaaaaaggagaatatatatatatggagcgtcttgcattaagccaagctttcaggagttgttgtttgagcaatttctgctcaagtatggagtttcagttttgttacttcacatgccagcttccctttctgatctccaggccagtgtcacttccagctctcccagtttacatgttgttagaacttggaacacccaatggtcaaatatattttgaaaatataaaaaaggaccaatatgaaagaaagaaatggtgctatgttttttctttcagatctcacgcattttctacaaagatgttttgaggatgtttattttagcacattttgacagttggctaagtaccctaagacaatactactccaattgaaatatcagagaagttcataataaaagcttgccagataaagtgctttccctatattaagttgttggagggaaattagatcaaggtctgtaaacttttcttaatggatgtgatagtaaatattttaggcttttgggccagacattctctgtcacaactacttatttctgccagtatagtgaaaaagcacccataggcaatgtaaactagtaagtgtggccatgttcaagtaaaattgttt

SEQ ID NO: 134747 - DNA, 237 bp, Homo sapiens
ttaggccatcagccacctcccctccgctctcttcccttctcctgcctctccaagtgctttgatttgtagtcggaagttcctcttgtccacttgcctcttccccctcatttcccaagttcccacaggaacctgggaataggttgtgcccagaggttagaacggaaactgcagcaagataactctgaggggacaatgcccagttgacgtcatttcaactactttgcttcagctagaggt

SEQ ID NO: 134748 - DNA, 580 bp, Homo sapiens
catgtctggtttttgttggaagtctgtacctttcctccgtggtagtcccagaccaagggtgatacttggcggtgcccagggtgtcacctgtcttctcaagtggaagaggagaatgaagagcactccagtacgccaggagcatcacaccgtaattagcaggaagatgttgcaccgcagtgcctcatctcagagccagagtcctgggttagggagtaaactcttttacctaggcctgactgtattctggcattgtaggcactcctcaggtttctgtggccctctcatctcactgagggtatcccttcttcatgtgtctctcagctcttctcttagatttctgcccctggctctggccccttcagattccttctccttctctttcccttccctcctctctcctcctttcaccaacagttttgtttgcacccatagttgcccatcagtggatccatgcctgtaagccagtgtaatacaagctgctgtctgtggagcatttattgcatttattgcagtgagccgtgatcgtgccactgcactccagcctgagtgacagagcgagactctgtctcaaaaaaaaaaa

SEQ ID NO: 134749 - DNA, 248 bp, Homo sapiens
ctgaaaccatccctctccaagtgttggcgtttccctcccaggctggaatcaactccaggcttaaaattaatttctcttccgctcacaacaatggtacagcctctccccaagtacatcctgtctttgtgcagaacacactgccttgccgcgctgcagcccagagccccagagctgggatgatttacccagccagagcccacagcagtactgtgatcctctgggacctgttcactcccctagtcaagaga

SEQ ID NO: 134750 - DNA, 357 bp, Homo sapiens
tatttgctgattaatcttacagaaggttattcttctgtaatccccagacaattttaggtatctagtacatatgcaataatttttagacagtttcaggaggtttagagaccatcaaaccccagcatggagcctgggtgatgaggtgtcctgttttgcatggaagaagagctgtagctgagccttcatagtccttttattgttcttattttgcaagtaaattgcaaaataagttcccaacccaaagataacacaggctatccttcaacaaagaaaaacctcagcttttaaacttctaggccatttggcaaagaggcatgataaagggcttgaaagcccacagacacgcccagtaccact

SEQ ID NO: 134751 - DNA, 272 bp, Homo sapiens
ccatgggagccagcctgggctagcctgcaggaggatgagagacacgtggccccaacaccacctgccatgtgaatgagacgcagctcaggctgagctgccagcggacccaagaagcatgaggagtacattgctagctggtttgcaaatcctctgtgttttgcggtagtttgttaggcggcactattggtgataatagataacaggcagtaaggcttagccccctttgactgaggagagagctgcattgcagagaggttaagtggccctgaggt

SEQ ID NO: 134752 - DNA, 525 bp, Homo sapiens
aacccaggggatcccccattcaggaaaaagaagaaagacaagtaaagaagcaagaaaggagacaataaagaaggcataaggagagccaggaacaggagtatatctaaagccaagagttgaggatttcagtgtcagagtccaacagcatcaattgctgcaaagaggccagaaagaagaaacaggtcaaagcctttggattttatgacctagaaatcaccgggtgacttttttaccttaagagaagactgctgtgaaaatgttgacccatctctggccttaacattaaaagcagcattttaccaggcacttgtacttgaatttttaagtatccaagtacttatccatgtttctccccagcctcttctgtcagagctttctccagagccatgacaagagggataagaactcccaagcttattccaacatgaaacgtttcattttcatccaagcagtgcacatccaagagaacaagctccattcctgaattttaatggccaggagaaggaagagtgatattaactcagg

SEQ ID NO: 134753 - DNA, 178 bp, Homo sapiens
gattacaggtgtaagctaccatgcccactcttagaaggttttaaataggggatggtgtgaccagctgttgtggcaggagtggaagggagtggcatgcaatggagacacagtaggaagctcctgtatccacaggcaagagatcctggaggctgaatctaggatgtagtcatggaggtgg

SEQ ID NO: 134754 - DNA, 514 bp, Homo sapiens
gctagaatttccactctgcaccaccaggtcttgacctagtaattttcaccctcttttgtcctttttggcacaaaagtttggttttcttccccagatcacatcatctgatgagaggttggagcagatccacccagggaatgaaaggccaaagaggtgggcaggtcggggcagcattttccaaagaggaggacgcagaccaccagtgttcacggtcaaaggttcaaggtcaaagcctgaaccttgaatcccacagtgagaaagtgactgtctcctcgggtctcaatccgtccttctggtgacctcctggggaaagtctctgagggtgctgatttgcctctggcctcctaagccttgccaatctccctctttagcagtagactcaggtctgaaactcagagtccacagcacatcactgtatctggccagaattgaatatgcatgactttgtttgtattttctctctttttttcccccttgagacagggtctcactctgttgcccaggctggagtgca

SEQ ID NO: 134755 - DNA, 526 bp, Homo sapiens
tcatttccacaaggttcaatgtgactatgttttggaataaagttttcccaagtgagctgtgtggaattcagtccgcggccagagctaacagtctcaccaaatgaaagagaagatactgtgtctattacctcatacccataggtccaaactctcccaaagcaactacctcctgtgtcttctgggtcttacctagggaatatacccaacggggaatcaaaatagcccaaagcacataaaagagatgggcctgcacattcttcctggggtgcagcatgatgacattttggagccaacaaggcatggagagccagacaagccaagcaaacagcaacaccgcaggggggctggagataatggaccacagaaggcgcctccaacaagctgaccacatccatctgaagctgcagaggccctcgcagctctccctgctctttgaactgctaaagcaagaagtacaaaacggaccttccatgccaggtgcaagccttcacaccatcaaatagcagggcctagactgcaaattgag

SEQ ID NO: 134756 - DNA, 793 bp, Homo sapiens
gcatggccgacctggagaactcctaaggtacataaaagactattttcaaatgggagactggagctgttggtagctgaaccacctactttacaatggattcaccttctgtgaaatggagagtgagtggtacaattatctgaattatttatttaaaatgtccatttgttatacaagcacgatataaattatctggataattgcttcttttctctcttttggccatggccacttgaccaactgtggattattgtcttggcatgttagaagcccccagataatactgggggacaatttttctcctcctacaacgtcacagtagatgatttgcactgcagcttgtggtgccttgatgcttcttttggacttagagaccttctttcttggcagcctttgctgagaccacgaggtgcttgagtcaaagataacaagctccagggggcctattaataatacttgagttagactgggataagaagtatctcaaaggttagaccaactctgatgaaagccttggaaactgatgcagactaaatttcagtgactaaattaagatttggtgtgtatgcatgtgttgtcctagagtccttaacaaggtattaatctgattatagaacccttgaaagcacttgtttgctcacaaaggaatttctgtttcatttgcgtatacacattgtaaggccaggaatatttgttaataattctatgtggaatagtactttaaattttttcttttatttatttattaagtttgactgttagcacctatcttgatatccttagcattataatctta

SEQ ID NO: 134757 - DNA, 268 bp, Homo sapiens
tttggacatgagccctttattgaatatagttattacaaatatcttagttgcttgctttttactttattacagggtgtttttttttttttttagtgagcagacattcttaattttattatagacctatttatagttgttttcctttatagttagtggttttatatgtgtgtgtattatgtagttatgtttaagaaatctttgctcatgaggttttatttcatttttgtatttttttctggactcagtattagatatgttacttgattct

SEQ ID NO: 134758 - DNA, 520 bp, Homo sapiens
cttgctgttctcgtggtagtgactgacttctcatgagatttgatggtttaaaagtctgtggcacgtcccccatcgctctcattctctcttgctgccatgtgaagaaggtgcctgcttccctttcacctcccaccatgactgtaagtttcctgaggcctcctggtcatgcttcctggtaagcctgcataactgtgagtcagttaaacctcttttcttcataaattacccagtctcaggtagttctttacagcaatgtgagcatggactaatacaatgtgcatactactgtgggaagtataggatcaaaggacattctaaagataacagaagaatcatgtctaacatatgactcttttttattactataagataaaggaagctggggcacctgctcctagtgccaacggtcctctttgctcagtgctcctttgtcttgctgccagccctgaaaagtgtgatcgctcctagatccagcaggaagttcatcactgtctagattgggtgcccttggaaataatga

SEQ ID NO: 134759 - DNA, 380 bp, Homo sapiens
aagcggataggggctccagaccaagggaacagtctgtggtaaggcctggagggaagggagaccacggcctttgtgagggaatcagcagaggcctgtcaggtgggagcagtagttctcagtgccatcagactcagcaccccttagtcatcatagacattttacattgtcaccattcctctccttaaatgcaattggtgggctgtgtaacctacctacacatagcattccaaaaatactcagatgctttcactgcatggaggagacataaaagggagagaatacaagtgtatgtatcaatgttataaacgtctgggcacgcctgcccgctcaccccagaagacatgaagttgccaggtgtttgctgcagggcaaagtcactg

SEQ ID NO: 134760 - DNA, 682 bp, Homo sapiens
tgcatggtgaaatttgtcataaactttttttctgcatctaccaagataataattttctttttttctccctctgtctacttatgtggtgaatatacattgatagattttctggcatttattcaaccttctatttctaagataaaccatttagttagttctgaggggtttttgctctgattttatttagaacattttcatccatgtttataactgaaattggcccataattttcctttctggtactatccttgcctgttttttatttcaaagctaaaaggtgatactggctttataaaatgagttggagagattacccttttcctctgtcttctagaacaatttgtgtcatgtaaggagtatctttctttgaaggtttggcagaaggtaaaaccatctgttctggtaatttttatgtaagtgtgagtggctgtgcatggctttaaaaagaactacaaatccaatttatttaatgttttaagtctactcaggcatttaatttcttactgagttacagtaggcaatattatttttctagaaaattgttcttgctttttggtttcacatttatcagtacaatactcacagtagtttcttacattcatttagaatttttacaacttcactgctatctgccagtctttatttgtgacttcactcctgttttttcttgatcagtttgcca

SEQ ID NO: 134761 - DNA, 528 bp, Homo sapiens
ggaaataaattatgtttaaatgcagttatcaaaaatactaaaggcaattttgttatatagcaggagctttacgtgtgtgtgtatagttacaggtgtacttcttttgcattaaataacaggagctagggccaaggctaataaactaccataacttcaaaatagtgaagaatataattatttggagatagcggtgaaaactgcactacgatgaactgatttttattggtgacataacagcataactaccctggtttttgcctacattcatacttgatgtgaaaaaaattaagaggtttgtatcttttttctacggaagtttttgaaccccttggattctgtctatggacaccaagttaagaatacctggtataaaggaaagccttatgcatgcggtttccaacccacagaatttcagagatcctccattaagtctcaaaaattattcttatggctgtgcaatggtttcagctgattccttgatcatttattcagtccataagtcttacacaagcatgttctctttagtgc

SEQ ID NO: 134762 - DNA, 698 bp, Homo sapiens
tggattttatttttgctttataatcttatctaatatcttcatatggttttttaaattaagacaaattagaactttgtgtatctttggatattaagaatgatatctagaaaaagttgcctcttataagctgtaattttacacccttattccatatttacttttatgcagtagatatcttttgtttctgactggcagaatcctataattctttcaaggttcacctctaatggtacccgccaccctacatggaaggaatttcttccttaggtttctaatactacactttgtacacacatatattttaatacttattagctagttgtgtatgcattagactttgtgacagcctggctcattgagaaaacactgactatggagctagaacaacctggcttcaagtcctgattctgtcctttactagttttatgatcataagcatattatttaatctttttgagcctcaatcctcatcttgttattgtggccaatactacctgtcttataagattgcaatgaagtttaaagcatcatgtgtaaagaggccagccctctctggtagtgtctaataactacttctttaattaaaaagacttggattctgccactcctttgacattgtaccttcttttcctggaatgttagctggctgaatcaggaagacttgatcaagctgattactaaaaatgtcattaattttt

SEQ ID NO: 134763 - DNA, 175 bp, Homo sapiens
agtttctgttctaaaggctttcctaaaaatagatgttagatttccccaaaatacaacagatttagaaataaaatagttatactgcttttgtatgctaagagttgacaattttttcagtaaatattttagggtttgcaggccctccttctcgtttttattactcacctatgctgat

SEQ ID NO: 134764 - DNA, 157 bp, Homo sapiens
agctgtacctcggccccttttagccatggctggagctgagtgatcacgatgcagggtgccaggtttcaaggcttcacacagcagcagggccttcagcccaggcctccaggcctgtgatgggaggggctgccacgaaggtctctgaagtgccttggag

SEQ ID NO: 134765 - DNA, 445 bp, Homo sapiens
ctatcagtttggagactctggtattaaccatgctctttatttattattagtcatgtattttccccaccctttgtctttggctttgcacccccacctagcaaccacaatgacttctttttgacctggatggctcgtctttttacataacagtgtttcctgggaagcttaagaacagcagagtcacagtgagggcttagtccagggcagccttcttaacgtggggtacatggatgtccttctttgggtctgtaaatgggcaggcacatgtttgcatacaggtgtgggaaaaggattcatggcttccatcataatctcaaagggatctagcaccctggaaaggttaacaacgcaaactcccaggcattcagacacagcacagcacagcacagcacagcacagcacagcacagcacagcacagcacactgaataaacagccccagcttg

SEQ ID NO: 134766 - DNA, 312 bp, Homo sapiens
tttcaaaaaagtccattgtattcctatatatcagtgacaattagatatggaaatttaaaaaaattattaatgatagaatctcaatgtattaagtacataagcatacatcagacaaaaatacgaaaggcctatgtattgaaaactaaaaaaaaaattgctgagagaaatgaagacctaaataaatggagagttatattttgttcatagatttggaagattcaatattgtaaggtgtcagttctcaaattgacctatatagatgcagtgctatcccagacaaaatcccaacaggtgtttttgtaaaaattgaca

SEQ ID NO: 134767 - DNA, 376 bp, Homo sapiens
ctcaattacagtccgagttgggatttgaaccctgatggcctgctggccaccacggggtaacatacctggattccaatcaggccttcgtaggccaagttctccatgtggacgctcacaatccagatccatagctgaccactggttgtgtgtgtgtgtgtgtgtgtgcacaagcatgcactacccatatcctagccttccttctcacccttatttttccttcatgtcaagtctgtgcttatgaaagccacctcatccttctctagaactaagcatagtgtaaatgataaatagcatgaccccaaaatctggggcattcttccactctgtcatgctacacctcctccccacattctgtcttcaactttaggatttcctt

SEQ ID NO: 134768 - DNA, 840 bp, Homo sapiens
gaataagcaagggagctcgctggggtattttatagggtgccacaggcactacctccagatattctcacattggggattaggttgcaacataaacttgggtgcacttcaacatatagaccataccaaccagaattatggaggacaggttagtgtcttttactttaaaaggttaaaacaaatcaatatcatcaaagagcacaaacaatactcacatacacagagagaattcatgatagtggctgacaatattgcagtgttttccatgagccaggcattattcaaaaggttttacggatatgaatacatctatgtataggttaccactagaagctccacttcgtagatgagaaaacaggggtgggatgttatgtaattggtcgacagtcacacggttggtaaggaacaggttgagattcgagcccgcagtgggctgcctctagactctgtccctgacctctatgccaatagtgattcagtttcccaaatgtcaaaacagcgcacatctattctgacatatgctaacccagcagacacttctacagacatgtacagatacagcaaaaataaaagagtacattaagacatctaaatcagcatcctcagggagatttgagaatcatagccatttaaaagaagacacttctatgcaaagaacagagttcttggaatttgaagatatgagatccataatttaaaaaaaaatcaatcaaagcctgggcgcggtggctcacgcctgtaatcccagcactttgggaggccaaggtgggcagatcacttgaggtcaggagtttgagaccagcctggccaacgtggtagaaccccgtctttactaaaaacgca

SEQ ID NO: 134769 - DNA, 494 bp, Homo sapiens
ccaaaatctgggatgtgaaacttgcatcccttatacagtgttttgtgttcccattctttctcattagaagagtcgcctaagggcagattatcttgctattagttttgctttggcccagagtctttcatctgcaaaacaggtgtgttggtcacaaggtagtatctgaataaaaattttcagggggagaaatatatcttacataccaacaagtttaaaaaatccaaaggcatttataaggatggtcatttcagcacattttttaagtaaataaaatactgtaactgcttatcaactggtcaggttggttaaattacagtagtatactcggacactactataaagataatgagaaaagctgagcttcatgagcgcccccagaacgttattcacctaaaggttatcaccagatgatggcatctggcgtggggttttttgtttgtttgttttagcatttcttgatttataacgaacatgtaccattttaacaaaagcaa

SEQ ID NO: 134770 - DNA, 566 bp, Homo sapiens
tggtactcagaagactggaagctatttttctgcttatctgcacaacctctgtttttgcagcttttctccaattctctgcccataaacactagcttttttggctttcttgaaatgtaatctctacttcccaacttcagagagactgtcatgctctgtttcccttgccttccctttgctgtggcctgaaaattgtctcccagtggtaatctgagacaattgttaagctcattttcttgtttctctcaaagatcacagacctgtgttttctgttatccaattattgtccaattattcattcctgttgttctaaaattatttcgtgtattttgttcaattttctagttgtttaaaatggaaaagtaagtctgaccctattccatcattgttagaagtcacactcattattaaaaattgagttataagttacataccataaaataatcactttaacatgtacagtttaggggtttttactatattcacaagattgcatcttgtgaatacaatatctaattatactataatattatctaatgccagaatattttcattacccaaaaaagaaa

SEQ ID NO: 134771 - DNA, 430 bp, Homo sapiens
gctacttaaggaacaatcagaactcccaccttagagggactatttatgtatttattctttggagtcaggaaaacagagagtgtgaggatgacacaaagcccagatgaaagcaggctacaggccgggcgcggcggctcccgcctgcgatgccaacactttgggaggcttaaacaggcggatcacctgaagtcaggtgttagagaccagcctggtgaaaccctgtctctacgaaaaatacaaaaattagccgggcgtggtggcatgtgcctatagtccctgctactcaggaggctgaggcaggggaatcacttgaacccaggaggcagaggttgcagtgaggcaagataacaccactgcactccagcctgtgtgacagagcaagactctgtctcaagaagagagaaaaagaaagaagaaagagagacaaaga

SEQ ID NO: 134772 - DNA, 747 bp, Homo sapiens
cgactgccttccaaaatgtttcttccaagtattcttcctgacctattgggaagtgacactggtagtgttatttccatagttggctgtgacaaacaagaatgatatgtgacctaaaatgaactccaaaatataggtagagtcttctggtagccacttcttctattcataagctacagtttcgtttttacatgtagcttccagaagacgtttgattttataaatatgccactcaaacttcaactgttgaatttcaggttagttggccggtcaggtcaggtactgctttgggaccgttcttctgataaactctgacaaccggtttgactttattgtcgttatttccgattttcactgaggttgtcttcacaaggctttcagaagttgctttggctgcctctttctccctcctaagacaagtggtttccaatgccaactttcacctgatggtgatttccataccttctttgtttggttattaataggcctccaacattggaataaaatttctatttctcctagtgtttagattcatttaatttaactatttaatttacatgaaggactcgaagcccaatatgtttgagacatttgcccaagaataatttggcctagtctagcattcttttctctacttggaaccatgatttttgtactttaagtacgatagtaaaatctaaaattggcctgggtaccagaactactcattttcttcagctgaacaaggattccccaaggctcagtatcatt

SEQ ID NO: 134773 - DNA, 328 bp, Homo sapiens
ccagccactcgggaggctgaggcaggagaattgcttgaacccaggaggcagaggttgcagtgagatcgcgccattgccattgctctccagcctgggcaacaagagcgaaactccgtctaaaaaaaaaaaaaaaaagacagtagggaggagaagaggaaccatttggcacagcttagagtctggggtcacttgtaccacgcagacccctgcccccttggttgcaacacactgtgcccattcttgtccaggatgatcacccatcactgaaaagaggcataagaacgttctgaggcccctattttctgagcagagaagatttctgcccaaa

SEQ ID NO: 134774 - DNA, 1068 bp, Homo sapiens
cacctgtggacaggcgtggggatgctcctctggggcctgggcagttttgacaggtggctggctaaggctcaggctcctgtgggggtggtgaggatgacaagaaaggaatgaaggccagagacattgtggagaaaaagtcaacaggaaagggtgactccatgtgagaggaaaggagggtcgtgtctacacaatcactgtcatagatcagcctcctccttgggcgtggccttggccagggggccgcaggatggcagccttgggtgcccaccccctggagtgtgggtcctgctctgggtggtgacgctgctgggggcctcggcaccccctgggctgccctcccagcgaggatctgtgttcccagacggcaggcatgcctcatcctgggctcccagaacaagctgccactgtgggctgtgggctggggccgctgccaggcaggcggggtggggggcaggaggggatgagagggcttttgtttccttctgtttgtgtcaagatgggaatggacttcctcccaccaggcggcctcgaggtgtaaaggaaagggcagccccagtgggcgggttttgggtcacccgtttttttgggtgcatttctctgggctcccgcctcagccccgccctctcctcccagccctcctgcctcaaagctcacccttccccaccagacctgttgtggcccagccctggttaaatatttgccaaccgagaagagttttcaaggcagccttgtgaaaaaccccagctgactcctggctctgttgggcctgacctgcctctgtgatgagacccagacggcctgtgccctcagactgagtccctgcccaccatggcctccctggtgacctgtttggcgcctgaggctgggtgacctaacacttgttcggcacttgtttatcaagcacccccctgggcctggcgggagctgggtgctggggagacagcggagagcagtctcagtccggggagcgtctcagatgaggcattaactgtggttgaggggagtgccggggagcaggccaggggctgtgggagtggaggccagggaggctgtggagacctgggaggc

SEQ ID NO: 134775 - DNA, 259 bp, Homo sapiens
gctactgagtgtgaccaggatccctaggaggcctcaaagctatggggagggtaaccgtaaactgcaacattgacaagatatagcctgggctccccactcctgcctcaatggtggtgcagctctgcttgaagctctctggtctttgaggaaagggttctgcaactttaaaaaacttgaaaaacattactgatgttgtagaaaattaagtaacttagtattacacttaaaaattggttacagctgggcacggtggctcatg

SEQ ID NO: 134776 - DNA, 2063 bp, Homo sapiens
gtcaggagatcgagaccatcttggccaacatggtgaaaccccgtctctactaaaaatacaaaaattagctgggtgtggtggtgcacacctgtaatcccagctactcaggagactgaggcaggagaatcgcttgaacccaggaggcggagactctagtgagccgagatagcgccactgcactccagcctggcaacagagcgagactctctctcaaaaaaaaaataaataaagtaaaagaatgcaagaagaccaggtgcaatggctcacacctgtaatcccagcactctgggtggccaaggcaggagactcacttgagctcaggagtatgagaccagcctggacaacatagtgagaccccatatataaaaaaataaagtagccgggtatggtggtgcacaactgtggtctccactattgggaggctgaggtacatcacttgagcctagcaggtcaaggctgcagtaaggtatgatcacaccactgcactctagcttgggtgacagagcaagaccccatcttggcaggtgggggatgcaagaaaaatgcaaggaacagatagagataaatagaaaacatataagaagacaatcatattaaatgtacatggtctaaatacccccaattaaaaagcagaggttttaggccatatacatttaatgtgattgtcttcttacatgtttttatcagagaaataaaactatcgccttcaagaaacacaagttaaatacaaagatgcaaacaggttaaaataaaagaatggaataatatataccatgcttacgctagtcaagagaaagctagagtagaaatactaatatcaggcaaagcatatttcagagttaaacacaacatttttccactatttgcagtcaaaagtatcgttaacactctctttactctgctcaaagttacagagttcttttgtataaacattagaacacttatcacagcctgcctataatggagaataattccatgttgtatactatacaacactcttactaaagtccattagacagaaatatgtagcatttgagacaccttccaattataaaactctatgcaaacaaaaattaacaacgcagatctgagactattatattatcctgtgaaggagggtctgtctgtctgcacagttggtcctaggctggcttctgaggacttgaatttcaagagggttccctaactggtaatcatggtttactgtatctagactatggaaataatgtggcttatcctgctattctttttgtgagtctggaaatttcacacatgctaggcagagtacacatatgtgaccagccaagataaaaactgtgtttcttgggaagtcacataggttgttgtattttcattaagggggaaagaaggtagtctgtgtgatcctcatggaaggcacagcacataaggaagccggtacatggatttttccagactctgtcagtgtcttttgccattgagatctttctactatatatccatactatgttacagtaataaatcttagccattacaaccctaagctgatcccatgagtccttctagcaaatctccaaacatggaggcagtcttgtggatccctgacacaaatatagtgttgtgatctcttaaggtttatccttcctcttaaactataaagagctggctgggcacagtggctcacgcttgtaatgccagcactttgggaggccgaggcgggtggatcacgaggtcaaaagattgagaccatcctagccaacatggcgaaaccccgtctctactaaaactacaaaaattagctgggcgtggtggcacacatctgtagtcccagctactcgggaggctgaggcaggagagtcgcttgaaccagggaggcagaggttgcagtaagccgagatcgcaccactgcactccagcctggtgacagagggaaacttcatctcaaaaaaaagaaaaaaactataaagggctgggtgcagtggctcacgcctataatactagcaccttggcaggcccaggtgggagaattgcttgggcccaggaattgagaccaacctggacaacagagcaagaccctgtctctt

SEQ ID NO: 134777 - DNA, 597 bp, Homo sapiens
gtcaggagatcgagaccatcttggccaacatggtgaaaccccgtctctactaaaaatacaaaaattagctgggtgtggtggtgcacacctgtaatcccagctactcaggagactgaggcaggagaatcgcttgaacccaggaggcggagactctagtgagccgagatagcgccactgcactccagcctggcaacagagcgagactctctctcaaaaaaaaaataaataaagtaaaagaatgcaagaagaccaggtgcaatggctcacacctgtaatcccagcactctgggtggccaaggcaggagactcacttgagctcaggagtatgagaccagcctggacaacatagtgagaccccatatataaaaaaataaagtagccgggtatggtggtgcacaactgtggtctccactattgggaggctgaggtacatcacttgagcctagcaggtcaaggctgcagtaaggtatgatcacaccactgcactctagcttgggtgacagagcaagaccccatcttggcaggtgggggatgcaagaaaaatgcaaggaacagatagttgtaaatggcggtggaccctctagaatcagctatgac

SEQ ID NO: 134778 - DNA, 370 bp, Homo sapiens
  misc_feature (29)..(29): n is a, c, g, or t
  misc_feature (102)..(102): n is a, c, g, or t
  misc_feature (106)..(106): n is a, c, g, or t
ccaggattctatagaaattaaaccagtanttaaattaccattattttataaaatagatactagcaaatttaccttacgtaaagattcaagtcagtaacttanaggntcttacataaaagtactttccgttggttgcaggagagtcgcttgaaccagggaggcagaggttgcagtaagccgagatcgcaccactgcactccagcctggtgacagagggaaacttcatctcaaaaaaaagaaaaaaactataaagggctgggtgcagtggctcacgcctataatactagcaccttggcaggcccaggtgggagaattgcttgggcccaggaattgagaccaacctggacaacagagcaagaccctgtctctt

SEQ ID NO: 134779 - DNA, 241 bp, Homo sapiens
ccacgcgtccgaaaagcatgtattccataatttcatcttgttgtgctagaatgcaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 134780 - DNA, 13509 bp, Homo sapiens
ggggcatttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 134781 - DNA, 2763 bp, Homo sapiens
gaacaggactcatgatatacaaaagaacaaagacaaggaatatttattgttagaaataagtgagaagacagtggaaaatctttaaagtactgaaaaaaaattgtcaacctaaaattctattcctagagaaaatctctttcaaaaacaaaggggtgaattgaaaattaaaaagctagtgttccattatgtcagcataaagtcttatgaattttgtacatacctttggtctcctctttgtttgttttcaaattacaaatattttgaaaatcctactgtctttttaagagacaatggcagccgggtgcagtggatcacttgaggccaggagttcaagaccagcctggccaacgtggtgaaaccccaactctactaagaatacaaaaaaattagctgggcgtggtggcccatgcctgtagtcccagctactcaggaggctggggcaggagaattgcttgaacccaggaggcagaggttgcagtgagccgatatccactactgcacaccagcctgggtgacagagcgagactccatcttaaaaaaaaaaaaagagagagacaatggcctctctaagcaacatgacctacatttaaatggagtcaagtggtcctctgtttccatttgtttaatttctactttgatattttgcttgcagcttcaatattactggctcgtgtggcctgcttcatgctcctggaataaattcaataaccaccaattgccccttatgttcccagcccaggattcaaactgtgcttcatgcagaatgggcactctaatggaaggatttggctccaggatagatacaaaactgtacctggtgtttgttggtgtaaagtggtagttaagaagagaacaatgacactacaaaatacaagccaaaaagggaaagtgttagcatttaacatcatagtttatggatattgggatacattgaccattgctttcttctttggtgtccttgatagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagaggttggtgtctttattctacttggcggtaaggaactttacagaacttaaagatacgcttatttatattcaaacgcgttagtgtgtgcagtgcatgtattatagcttttcccagccagctgtgaattctgctacattctgaggacataggtaatttaaagctgcaaaaacgagttttcgcatttacccattttcctctgtgggtgttgataaaaacactgtgtctgaacaaggatccagagagatggagacggggtgtgtgggatggtaacgggatcttgtgtgggaaacttgttgcccctgcagatgaggctgtggccagtcacatttgctgtgcccagtgctcacctgtcatttagcccaaagggagtgagcaaggttcagcttgcatcccacctcccaggagcacagcatctgccagcagcacggtgtccagaggggtctgggagcatgagtgaggggtcagcgtatggacatgggaggaacccgcacccttccatgtgacctgccccttggccccaccaagggctgcactgccagctgcactcctgtcctttgggctctgtctgtgtgcaggagggttccactgacttcatttgcaaagtgtagggcctctgaaaggcttcgtagttgacatttatagacgtgtaactggaagatagggccaagctttgagttgaaaatgtaatagttcaaaaagggttacatggttcgttctctattagctttgcatggtgagtttttaaataatgttgatctctgggctgcggggacccagtttgacttttagggccctaaccactccttccacctttttctgcattctgaatagtagactttctcagtaggtattaaacaggttaaggtaaattcagaagtgcaacatgtatgtgtttttcttcaagataagtgagcaaataacttcattatgattttatttttttccaatataatatttatacatgataaaaacagcatttgaatttgtgaggacatgaagtattcactccacgttgtcaaaacacccagtagacacgtgcagtgaagccagtagcctctctcgtgagcttacatgagctgtgtggactgatccttcctcacacgccatgctgtcctcagctcacacgtgcactcaggaagcttgcccatactcaagcctcactctagcattgcagacacatcaggttttatcttcagaaagacaccttaaaagtatcagaggaaaatgtgaacacatttttttaaatggtcttggaatgaagagacaaaaaccagaatccatgaaggaaaatagtttgacttctatacagaaaaagaaaataccgtatacaaagttaaaaaaataaaaagccaggtgcagtggctcacgcctgtaatctcaccactttgggaggccaaggtgggcagatcacgaggtcagcagttcgagaccagcctggccaacacggtgaaaccctactaaagaaacaaaaattagccgggcgtggtggcgagcacctgtaaacccagctactcgggaggctgaggcaggaaaatcacttgaacccaggaggtggaggttgcagtgagccgaggtggcgccactgcactctagcctagacgacagagcaagactctgtctcaaaaaaaacaacaacaac

SEQ ID NO: 134782 - DNA, 412 bp, Homo sapiens
attcaatgcaaagcacttttatgtatcttccagttgtagattggaatagcaaaagtgaatgctattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 134783 - DNA, 633 bp, Homo sapiens
caccatgcctggctaatttttgtatttttagtagagacaaggtttgaccatgttggccagactggtctcgaactcctgagctcaagtgatctacctgccccatccttccaaagtgctgggattacaggcgtaagccactgcttccgccctgggtttcttaatatattatgtctccagtgtttgaacaacagttctatttaagatatcataaactcaaagagtaagctgtgtgtgagtatccactataaaatatgtgtagcattagcttactactgtagaaagtttgcatgttggctgttgctgcttgctaaagatatccacattcataagcaagtatttataatcaggaatacaacatttctgcgggcacagcagtcaggcacaagcaggtagcagaaattcgttgctggcctgggcgctctgctctttggcactgtcttcagagggcggccccacggaggaatgctcacagccactctggcttttccctctgagtttgacacgtggctagcctgtgccctgagatgacattctgatttttgaaggtgacagtcatggcgtctctgcgaaggcccaagcgcatcatcatccgtggccatgacgatcgagacatagagggatcctctagatacc

SEQ ID NO: 134784 - DNA, 723 bp, Homo sapiens
cccgctattttaaaaaacaaagagcgccgtctaatattattttatacaataatacttacgttgcgtagctactgtgttttttgtttccgcgtcctctcagtctatttatgcttttttttctacctcctcttctcttctgtcgtacttctatacttatttattgtattcatcctcccccgcagtacggtaatcatattctatattcattttttgaggtggattcggtctcgcctctcttattctttgttctcctctccccctcaagataaataggtgtgtctcgtctttcattatatagctatctaacttagcagcgcatgtctcctcccacaccacttagtgttaaagagacagcgccgctgcgcctctgatataataagaaatacatatccactaatataatagagccctcctcctttctataaaaagaagagtcgggtgtatataagtcgcggccccccgggaaagaatgatcatttgcgccgcgccccctgctccttcttttttttttttttttttttttttttttttttttttttttttttttttttttttttttttttttttttttttttttttttttttttttttttttttttttttttttttttttttttctttttgttgtttttttttttccttctaacacttgtatttggaggctcttctgtgattttgagaagtatactcttgagtgtttaataaagtttttttccaaaagta

SEQ ID NO: 134785 - DNA, 388 bp, Homo sapiens
actatctcgccatttacaactatcccgccatttacaactatctcgccatttacaactatctcgccatttacaactatctcgccatttacaactatctcgccatttacaactatctcctggaatcctttctgaaacaggtttctaatatggtggcgaaaaatgcagaaatgcataaaaataaactgcagtactttatggagcagttttatggaatcatcagaaatgtggattcgaacaactatctcgccatttacaactatctgccagggggcttctaggaagtaggtttcatctatcaaatgtctcctctgacttccttccgcaacttactgctcatctgtatatattttgtgttgtacttctgggagttcgacggttttcttggaac

SEQ ID NO: 134786 - DNA, 14169 bp, Homo sapiens
ggggcatttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagtaaaaaaaaaaaaaaaaaaaaaaaaaaaaaaaaaaaaaaaaaaaaaaaaaaaaaaaaaaaaaaaaaaaaagagaaaaccaaaaaccacacagaaccaaaacaagaagaatagagaagaaaaaggaagtaccatcaaatataagtagaagctagactaaaccaaagacagaccagagacagacagccagtcaacaaaagcaataccaatcgcggacaactcagcttcatcattaacagagatgtccatacagaagacaaagatataaaggaagtgacgaacaacaaagcgacgcgcactcctcgacaggtagagtaaccgtaacacgacggcaggtaacaacaacattaaagaggacaataagtcggtatatatcactcgatcatatcgtagcgcggaccaactaacatcggtacgacgcatgatcaataacgaacaagctactacccaagggaatggtataaaaaaccgagtacaaatagataacagcacagaggcgtctaaagataagcgacaatcaaaacaacacgaacagctcagacagagaacgctaggagcagaaagagcaggaggggcgcggacggaagcgagcaggaggatgaggagaggagcaaagacggcagagaagcgacaagagagacgagcggcagaggaataacaggag

SEQ ID NO: 134787 - DNA, 13835 bp, Homo sapiens
ggggcatttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagtagataacacctgtgcacaggcaatttgatgtggacattcttatcttgggacacacacacatatttgaagcatttgcccttgagggcgctcttgccacataacctttatctgccactggcttattatcggcccgaaaacaaacgtcattgcatcaatttgccttatgggaatccaaactaatacaatggccccttatttaaaccaagtgttggggacccgggggtcaccatattaatgccttgaaccaaacccctttccgccatgggtgatattgggaaagtgccctcccctttcgctttccacaaattagccctctctaggccgtgg

SEQ ID NO: 134788 - DNA, 13546 bp, Homo sapiens
ggggcatttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagaaccacaaatatcgctatttgtggtggaagaagtggtctagacttctccttccccctaggcaccgcctgctcttttcacagactcaaggcttctcacacagcgctggcgagcacgtcccaacaggcttctatgttttttgccctcagcatgccttcagagatcacggtcagccgaggtt

SEQ ID NO: 134789 - DNA, 10947 bp, Homo sapiens
gacagcccggagcttacatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 134790 - DNA, 10811 bp, Homo sapiens
tcgagctcggtccagatcacctttccatccggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 134791 - DNA, 13675 bp, Homo sapiens
  misc_feature (13242)..(13242): n is a, c, g, or t
  misc_feature (13248)..(13248): n is a, c, g, or t
  misc_feature (13256)..(13256): n is a, c, g, or t
  misc_feature (13277)..(13277): n is a, c, g, or t
  misc_feature (13295)..(13295): n is a, c, g, or t
  misc_feature (13298)..(13298): n is a, c, g, or t
ggggcatttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaacgatatttgtggttctgtcgagggatgcacaaaaacccagcatgggccaggtgtggaggctcatgcctgtaatcccggcactttgggaggtcaaggcgggcngatcangaggtcangagatcgagaccatcctggcnaacatggtgaaaccccgnctntactaaaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 134792 - DNA, 5249 bp, Homo sapiens
ggctaataaaatattggagatacttaacccttagccaaacagtatgtgtctgtgtggtgtgtgtgagtatgtacatgtatgatagactgtgtgtgtgtgtgtgtgtgtgtgtgtgtgatcttcatattttgataggtgcttttcttgctttaaattgatccctggaatggaagcgtaaaattaaaaggtcatttcctcctttgagcaaattgaatattgttggaaaatgtgttaatagcattacacagagaaacttctggtgatatcactacccacatgggtaccttttatgtttagtaaagtatgttactccttgtgaagacatggtccaagtaccacaagctaaacagctggttgtatgtgtggtttcacaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 134793 - DNA, 6154 bp, Homo sapiens
  misc_feature (14)..(14): n is a, c, g, or t
  misc_feature (18)..(18): n is a, c, g, or t
  misc_feature (40)..(40): n is a, c, g, or t
  misc_feature (57)..(57): n is a, c, g, or t
  misc_feature (65)..(65): n is a, c, g, or t
  misc_feature (70)..(70): n is a, c, g, or t
  misc_feature (78)..(78): n is a, c, g, or t
  misc_feature (94)..(94): n is a, c, g, or t
  misc_feature (102)..(102): n is a, c, g, or t
  misc_feature (104)..(104): n is a, c, g, or t
  misc_feature (120)..(120): n is a, c, g, or t
  misc_feature (136)..(136): n is a, c, g, or t
  misc_feature (166)..(166): n is a, c, g, or t
  misc_feature (170)..(170): n is a, c, g, or t
  misc_feature (190)..(190): n is a, c, g, or t
  misc_feature (192)..(192): n is a, c, g, or t
  misc_feature (195)..(195): n is a, c, g, or t
  misc_feature (208)..(208): n is a, c, g, or t
aaaggttttccccngctngaaaaaggggcaaagttaagcncaaccccaattaaatgngaaggtangctcnccttcatnaagcccccccccaggnttttaacncntttaaggttccggggnttggtattgttggtgnggaaatttgtaacgggaataccaattttcnaccnaaggaaaacaagcttatggncnatnatttacgaatttngaggctcgggaccccaccttcggtttaagtgctcccttggacttcaaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 134794 - DNA, 12975 bp, Homo sapiens
ggggcatttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctatatggcggtatctcgggaactcagaacacaa

SEQ ID NO: 134795 - DNA, 4120 bp, Homo sapiens
gaacaggactcatgatatacaaaagaacaaagacaaggaatatttattgttagaaataagtgagaagacagtggaaaatctttaaagtactgaaaaaaaattgtcaacctaaaattctattcctagagaaaatctctttcaaaaacaaaggggtgaattgaaaattaaaaagctagtgttccattatgtcagcataaagtcttatgaattttgtacatacctttggtctcctctttgtttgttttcaaattacaaatattttgaaaatcctactgtctttttaagagacaatggcagccgggtgcagtggatcacttgaggccaggagttcaagaccagcctggccaacgtggtgaaaccccaactctactaagaatacaaaaaaattagctgggcgtggtggcccatgcctgtagtcccagctactcaggaggctggggcaggagaattgcttgaacccaggaggcagaggttgcagtgagccgatatccactactgcacaccagcctgggtgacagagcgagactccatcttaaaaaaaaaaaaagagagagacaatggcctctctaagcaacatgacctacatttaaatggagtcaagtggtcctctgtttccatttgtttaatttctactttgatattttgcttgcagcttcaatattactggctcgtgtggcctgcttcatgctcctggaataaattcaataaccaccaattgccccttatgttcccagcccaggattcaaactgtgcttcatgcagaatgggcactctaatggaaggatttggctccaggatagatacaaaactgtacctggtgtttgttggtgtaaagtggtagttaagaagagaacaatgacactacaaaatacaagccaaaaagggaaagtgttagcatttaacatcatagtttatggatattgggatacattgaccattgctttcttctttggtgtccttgatagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 134796 - DNA, 3269 bp, Homo sapiens
gaagtagaagatttttctatacatctgtctaagaacaaccagcagcagctgtctcgtgtgattccattcttgcaacaaaagactgttctcctgcacagaaagtgcctgggagagtccagtggttgccgcagcagaagagagctaggggatggaagacttgttttgtacttgcgtttttatacttctgagttttctttattttggacatatgttacttttataacagatgatgtgagatgttttactcagcattaagtttcagctctctgttttagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 134797 - DNA, 11972 bp, Homo sapiens
ggggcatttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 134798 - DNA, 2673 bp, Homo sapiens
gttctagatcgcgatctagaactagtcaaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 134799 - DNA, 2395 bp, Homo sapiens
atctgagtatcccaattcatagaggccacggaggaatgctcacagccactctggcttttccctctgagtttgacacgtggctagcctgtgccctgagatgacattctgatttttgaaggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 134800 - DNA, 1861 bp, Homo sapiens
cccttctgccctcacccttagtgggatcacagcagccgcacagctgtgtctcttttgtaggcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 134801 - DNA, 796 bp, Homo sapiens
  misc_feature (8)..(8): n is a, c, g, or t
ctcgtgcnaattcggcagagaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 134802 - DNA, 718 bp, Homo sapiens
cgtcgctcggcaccccgatatttgtggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 134803 - DNA, 707 bp, Homo sapiens
ccggatcgtcggggtaccgggactcgggtctacacgcagccggatgtcatacaccagagaattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 134804 - DNA, 10698 bp, Homo sapiens
ggggcatttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcagggaacggaagagatctcttttgtcatgaggctcaaagtctcctctggataccgtctataa

SEQ ID NO: 134805 - DNA, 12965 bp, Homo sapiens
ggggcatttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcaggtgaattgaaaattaaaaagctagtgttccattatgtcagcataaagtcttatgaattttgtacatacctttggtctcctctttgtttgttttcaaattacaaatattttgaaaatcctactgtctttttaagagacaatggcagccgggtgcagtggatcacttgaggccaggagttcaagaccagcctggccaacgtggtgaaaccccaactctactaagaatacaaaaaaattagctgggcgtggtggcccatgcctgtagtcccagctactcaggaggctggggcaggagaattgcttgaacccaggaggcagaggttgcagtgagccgatatccactactgcacaccagcctgggtgacagagcgagactccatcttaaaaaaaaaaaaagagagagacaatggcctctctaagcaacatgacctacatttaaatggagtcaagtggtcctctgtttccatttgtttaatttctactttgatattttgcttgcagcttcaatattactggctcgtgtggcctgcttcatgctcctggaataaattcaataaccaccaattgccccttatgttcccagcccaggattcaaactgtgcttcatgcagaatgggcactctaatggaaggatttggctccaggatagatacaaaactgtacctggtgtttgttggtgtaaagtggtagttaagaagagaacaatgacactacaaaatacaagccaaaaagggaaagtgttagcatttaacatcatagtttatggatattgggatacattgaccattgctttcttctttggtgtccttgatagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagaggttggtgtctttattctacttggcggtaaggaactttacagaacttaaagatacgcttatttatattcaaacgcgttagtgtgtgcagtgcatgtattatagcttttcccagccagctgtgaattctgctacattctgaggacataggtaatttaaagctgcaaaaacgagttttcgcatttacccattttcctctgtgggtgttgataaaaacactgtgtctgaacaaggatccagagagatggagacggggtgtgtgggatggtaacgggatcttgtgtgggaaacttgttgcccctgcagatgaggctgtggccagtcacatttgctgtgcccagtgctcacctgtcatttagcccaaagggagtgagcaaggttcagcttgcatcccacctcccaggagcacagcatctgccagcagcacggtgtccagaggggtctgggagcatgagtgaggggtcagcgtatggacatgggaggaacccgcacccttccatgtgacctgccccttggccccaccaagggctgcactgccagctgcactcctgtcctttgggctctgtctgtgtgcaggagggttccactgacttcatttgcaaagtgtagggcctctgaaaggcttcgtagttgacatttatagacgtgtaactggaagatagggccaagctttgagttgaaaatgtaatagttcaaaaagggttacatggttcgttctctattagctttgcatggtgagtttttaaataatgttgatctctgggctgcggggacccagtttgacttttagggccctaaccactccttccacctttttctgcattctgaatagtagactttctcagtaggtattaaacaggttaaggtaaattcagaagtgcaacatgtatgtgtttttcttcaagataagtgagcaaataacttcattatgattttatttttttccaatataatatttatacatgataaaaacagcatttgaatttgtgaggacatgaagtattcactccacgttgtcaaaacacccagtagacacgtgcagtgaagccagtagcctctctcgtgagcttacatgagctgtgtggactgatccttcctcacacgccatgctgtcctcagctcacacgtgcactcaggaagcttgcccatactcaagcctcactctagcattgcagacacatcaggttttatcttcagaaagacaccttaaaagtatcagaggaaaatgtgaacacatttttttaaatggtcttggaatgaagagacaaaaaccagaatccatgaaggaaaatagtttgacttctatacagaaaaagaaaataccgtatacaaagttaaaaaaataaaaagccaggtgcagtggctcacgcctgtaatctcaccactttgggaggccaaggtgggcagatcacgaggtcagcagttcgagaccagcctggccaacacggtgaaaccctactaaagaaacaaaaattagccgggcgtggtggcgagcacctgtaaacccagctactcgggaggctgaggcaggaaaatcacttgaacccaggaggtggaggttgcagtgagccgaggtggcgccactgcactctagcctagacgacagagcaagactctgtctcaaaaaaaacaacaacaac

SEQ ID NO: 134806 - DNA, 8872 bp, Homo sapiens
  misc_feature (8709)..(8709): n is a, c, g, or t
  misc_feature (8742)..(8742): n is a, c, g, or t
ggggcatttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacacgaagcaaatgatgagtagcttcatgctgtccatctctgccgtggtgatgtcctatctgcagaatcctcangcccatgacgcccccatggtgataccagcctangaagggtcacattttggaccctgtctatccactaggcctgggctttggctgctaaacctgctgccttcagctgccatcctggacttccctgaaatgaggccgtctcggtgcccccagctggatagaggga

SEQ ID NO: 134807 - DNA, 3417 bp, Homo sapiens
ggggcatttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 134808 - DNA, 352 bp, Homo sapiens
gattccattgctattaaatatttccaaaaaaataaatattatgtatttgcaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggagtatgtctcattaacttactctattttgtcttggtttcacgtgattgtttaaaggaatctaattcattgcattttgaatagtgtctaatacttgtaacaatacagtagacccttgaataacatgggcgtgaactgcacaggctcacttacatg

SEQ ID NO: 134809 - DNA, 379 bp, Homo sapiens
gtagagacggggtttcaccatgttggccaggctgatctgaactcctgacctcaggtgagccgccacgcccgtcccagattccactttaaatgcacatctgaataatttctggcttatgtatgattaaagttataaaacctaagggcaacttcatagtttcttaaattttatatttttagcaaaattaaagtaacactttatgtctcttgttaatataatgtgtggcaacttgatttactatcatttcattagaataaatacttttaaaatactggagtgttcattgatttggcctttttgatttgttttgtaggctgtatagatcaattggagaatacgacgtcctccgtgggatttttaccagtgagataggaacaaa

SEQ ID NO: 134810 - DNA, 521 bp, Homo sapiens
acattgaagtccacaggctctggcctggtatgtgggttttgtaatacctgcaaagtctcttccatctcaggtccattaggagaggctgtgctttgggtggccgtggtgttggtggtacagtttctagttaggtatggcattgctctgagtgtgtgcatgtgtttgtgcgtgcacgcaccatgctatcctgcagtcttaaataggggttttgtgttcatttttgaatatgcagtgtgaatcatttatctaattttattattcttagggatgaaaacatattaaatctatagtaaaattaccttttcagttaaaaattaggccaacacatttataatacaaatttaataataatcagctatatatgccttctttggaaatatgtctctgtacttgagaacaggtacaattcaacagtgttgtgatgccattgatcacctatgccgcatcattgaaaagaagcatgtttctttaaataaagcaaagaaacgacgtttgccgcggtaggtgatcttgcttccttt

SEQ ID NO: 134811 - DNA, 316 bp, Homo sapiens
cagtgtatcttgataatttaacgagatcagagctcacctaatttactgttttgtcacatggccagcattgaggagctttgtgccgtcaacttgtatggccctgacgcgcaagtggacaggagcaggctggctgctgttgtgtctgcctgtaaacagcttcacagagctgggcttctgcataatatattaccgtctcaggtaactataacttattgtttttacatttattttagctttagtatgataattagtgtatttatttatattatttcttaaaagtcctttatgtattgagcatgctgaaatgggaattata

SEQ ID NO: 134812 - DNA, 461 bp, Homo sapiens
tttgtgctcggtactttgagagttctggcttacatattctgctccttgccttttttcttgtttagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaagtaggttttgtttcatgtgcacttttcacttttgtgacagtgtccccgtgatcaagctggtatctctcgtgtatgatggaagtgcattgagtcatgttgatgaaaatatttacattattttgtacagcatttctcaaagttagtatttaggattgtctgcttgaaaaccagttaagaggctgggcccagtggctcacacctataatc

SEQ ID NO: 134813 - DNA, 524 bp, Homo sapiens
tccaaatgctccccttgtcaatgcctgctaagtctttccaaatagaattgagaggtataatagatgtgtttgcaacagtttgtattttccaagctctgatagtattggtgatttatagcatttttgcttcagatcctaatttgtctttgttttgaattttttacagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggtaaagtctgcacacacttcatcaaatatacattgtttgctgtggcttcacatggcctttccatcatcactatgtttcccgtgttgagactcttgataacctggtgtttaacagagtaagatgtactatttgggttaccacttcccaaatgagtagatgtaatttattttttcccccc

SEQ ID NO: 134814 - DNA, 336 bp, Homo sapiens
gtctcaaactccttggctcaagtaatcctactatcttggactcccaaagtgctgggattacaggcatgagccaccatgcccaaccaaaactatacatcttaaaagcagagaagaaacatataccattgagcactccattcattacacttataagcttagagccttttccaaagtccaaactaaacatcagtctttatagtaaattcttactaatttcagacttttggaaaagaatttgataaacattttgggaaaggaggttctaaactactgagaatgaagctcagtgacttcaacgacattaccaacatgctacttttaaaaatgaacaaagac

SEQ ID NO: 134815 - DNA, 577 bp, Homo sapiens
cattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtgagttaacctccaggggtgacaaaactgtactgtcaggagcacagcactgtaataagaactcgtggtttctggaatagtgatactgggatattgacagttatttctttttttaaagaattttaaaattcaccgaatttttcatcattaggaaaatccataattatgaatgagcacacattactaaatgtttaatgagattatagttcttatatttctgattctgacaaaagttcagattttcatttggtaataatggtaaacagcaatcatagatttcctctgaatgtattcatgctatgctcctgaataacttttcttcagaaatatacaggtatagaggcagattacttcctgggatgtgtacacagttccatttaaagtgacaagttttta

SEQ ID NO: 134816 - DNA, 13416 bp, Homo sapiens
ggggcatttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 134817 - DNA, 13673 bp, Homo sapiens
ggggcatttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagtagcagcagggccagaggaaaggcacaggtggcgatttgcccccacacccaactccgagggcccacgctggggaaagcgggaagcgctcgctccctttcccccattagtgctctctctgcctggatccccccagaagctatgaaagggaataaagtgattgaaagt

SEQ ID NO: 134818 - DNA, 12739 bp, Homo sapiens
cagacttatgtgtatccttggtctcttagtcccttctctaggaaaaatgtatcacatagccttatttaagacacttttctgaacctgatagagactaagcaaaatggaagcaaagggtctttatgattaaaagcaattgcgtgtaactataacagtacattagtagcatctaaacagttctagtttttccatgtttgtatagattccattgctattaaatatttccaaaaaaataaatattatgtatttgcaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 134819 - DNA, 11006 bp, Homo sapiens
ggtctgagcaatgcagaaagtttcttacaatttctttggattgaaacaagaaatagctccctcgctcctcttcataaatttctcagagaaaatctaagttaccaggaagtagccaaagaccaggagattgtggaatcaaaaagaaaaaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 134820 - DNA, 13466 bp, Homo sapiens
  misc_feature (13242)..(13242): n is a, c, g, or t
  misc_feature (13248)..(13248): n is a, c, g, or t
  misc_feature (13256)..(13256): n is a, c, g, or t
  misc_feature (13277)..(13277): n is a, c, g, or t
  misc_feature (13295)..(13295): n is a, c, g, or t
  misc_feature (13298)..(13298): n is a, c, g, or t
ggggcatttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaacgatatttgtggttctgtcgagggatgcacaaaaacccagcatgggccaggtgtggaggctcatgcctgtaatcccggcactttgggaggtcaaggcgggcngatcangaggtcangagatcgagaccatcctggcnaacatggtgaaaccccgnctntactaaaaatacaaaaaattagccaagtgtggtggcgggcctctgtaataccagctacttgggaggctgaggcaagggaatcacttgaacccgggatgtggaggttgcagtgagccaaggttgcaccattgcactccagcctgggcaacaagagcaaaactacatctc

SEQ ID NO: 134821 - DNA, 13455 bp, Homo sapiens
ggggcatttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaatgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 134822 - DNA, 2941 bp, Homo sapiens
gatacttctactggtcataagaagggataaacaatagtctgtggaagaaatcactgataactacccgcaggctattgtttatcccttcatcataagcagcgaaagctattccttcaaggatacttctactggtcataagaataaggagtttgtggcaaggattaaaagtaagttggatcaaggaggagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 134823 - DNA, 2776 bp, Homo sapiens
acgcgtccgcccacgcgtccgagtgattcaagattttattaatgccttagatcagctctctaatcctgaactgctctttaaggattggagcaatgatgtaagagctgaactagcaaaaacccctgtaaataaaaaaaacattgaaaaaatgtatgaaagaatgtatgcagccttgggtgacccaaaggctccaggcctgggggcctttagaaggaagtttattcagacttttggaaaagaatttgataaacattttgggaaaggaggttctaaactactgagaatgaagctcagtgacttcaacgacattaccaacatgctacttttaaaaatgaacaaagactcaaagccccctgggaatctgaaagaatgttcaccctggatgagcgacttcaaagtggagttcctgagaaatgagctggagattcccggtcagtatgacggtaggggaaagccattgccagagtaccacgtgcgaatcgccgggtttgatgagcgggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 134824 - DNA, 2822 bp, Homo sapiens
caccatgcctggctaatttttgtatttttagtagagacaaggtttgaccatgttggccagactggtctcgaactcctgagctcaagtgatctacctgccccatccttccaaagtgctgggattacaggcgtaagccactgcttccgccctgggtttcttaatatattatgtctccagtgtttgaacaacagttctatttaagatatcataaactcaaagagtaagctgtgtgtgagtatccactataaaatatgtgtagcattagcttactactgtagaaagtttgcatgttggctgttgctgcttgctaaagatatccacattcataagcaagtatttataatcaggaatacaacatttctgcgggcacagcagtcaggcacaagcaggtagcagaaattcgttgctggcctgggcgctctgctctttggcactgtcttcagagggcggccccacggaggaatgctcacagccactctggcttttccctctgagtttgacacgtggctagcctgtgccctgagatgacattctgatttttgaaggtgacagtcatggcgtctctgcgaaggcccaagcgcatcatcatccgtggccatgacgagagggaacaccctttcctggtgaagggtggcgaggacctgcggcaggaccagcgcgtggagcagctcttccaggtcatgaatgggatcctggcccaagactccgcctgcagccagagggccctgcagctgaggacctatagcgttgtgcccatgacctccaggttaggattaattgagtggcttgaaaatactgttaccttgaaggaccttcttttgaacaccatgtcccaagaggagaaggcggcttacctgagtgatcccagggcaccgccgtgtgaatataaagattggctgacaaaaatgtcaggaaaacatgatgttggagcttacatgctaatgtataagggcgctaatcgtactgaaacagtcacgtcttttagaaaacgagaaagtaaagtgcctgctgatctcttaaagcgggccttcgtgaggatgagtacaagccctgaggctttcctggcgctccgctcccacttcgccagctctcacgctctgatatgcatcagccactggatcctcgggattggagacagacatctgaacaactttatggtggccatggagactggcggcgtgatcgggatcgactttgggcatgcgtttggatccgctacacagtttctgccagtccctgagttgatgccttttcggctaactcgccagtttatcaatctgatgttaccaatgaaagaaacgggccttatgtacagcatcatggtacacgcactccgggccttccgctcagaccctggcctgctcaccaacaccatggatgtgtttgtcaaggagccctcctttgattggaaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 134825 - DNA, 1480 bp, Homo sapiens
agttctagaggatccctatatatccccaacaccatggatgtgttgtcaggagccctcctttgattgccaaaattttgaacagaaaatgctgaaaaaaggagggtcatggattcaagaaataaatgttgctgaaaaaaattggtacccccgacagaaaatatgttacgctaagagaaagttagcaggtgccaatccagcagtcattacttgtgatgagctactcctgggtcatgagaaggcccctgccttcagagactatgtggctgtggcacgaggaagcaaagatcacaacattcgtgcccaagaaccagagagtgggctttcagaagagactcaagtgaagtgcctgatggaccaggcaacagaccccaacatccttggcagaacctgggaaggatgggagccctggatgtgaggtctgtgggagtctgcagatagaaagcattacattgtttaaagaatctactatactttggttggcagcattccatgagctgattttcctgaaacactaaagagaaatgtcttttgtgctacagtttcgtagcatgagtttaaatcaagattatgatgagtaaatgtgtatgggttaaatcaaagataaggttatagtaacatcaaagattaggtgaggtttatagaaagatagatatccaggcttaccaaagtattaagtcaagaatataatatgtgatcagctttcaaagcatttacaagtgctgcaagttagtgaaacagctgtctccgtaaatggaggaaatgtggggaagccttggaatgcccttctggttctggcacattggaaagcacactcagaaggcttcatcaccaagattttgggagagtaaagctaagtatagttgatgtaacattgtagaagcagcataggaacaataagaacaataggtaaagctataattatggcttatatttagaaatgactgcatttgatattttaggatatttttctaggttttttcctttcattttattctcttctagttttgacattttatgatagatttgctctctagaaggaaacgtctttatttaggagggcaaaaattttggtcatagcattcacttttgctattccaatctacaactggaagatacataaaagtgctttgcattgaatttgggataacttcaaaaatcccatggttgttgttagggatagtactaagcatttcagttccaggagaataaaagaaattcctatttgaaatgaattcctcatttggaggaaaaaaagcatgcattctagcacaacaagatgaaattatggaatacaaaagtggctccttcccatgtgcagtccctgtccccccccgccagtcctccacacccaaactgtttctgattggcttttagctttttgttgtttttttttttccttctaacacttgtatttggaggctcttctgtgattttgagaagtatactcttgagtgtttaataaagtttttttccaaaagta

SEQ ID NO: 134826 - DNA, 12152 bp, Homo sapiens
ggggcatttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaatgctctcagcagtgagccagcctgccttgctgaaatcgaggaggacaaggctagaagaatcttagagctttctggatccagttcagaggattcagagaaggtgatcgcgggtctgtaccagagagcattccagcacctctctgaggctgtgcaggcggctgaggaggaggcccagcctccctcctggagctgtgggcctgcagctggggtgattgatgcttacatgacgctggcagatttctgtgaccaacagctgcgcaaggaggaagagaatgcatcagttattgattctgcagaactgcaggcgtatccagcacttgtggtggagaaaatgttgaaagctttaaaattaaattccaatgaagccagattgaagtttcctagattacttcagattatagaacggtatccagaggagactttgagcctcatgacaaaagaggttggtgtctttattctacttggcggtaaggaactttacagaacttaaagatacgcttatttatattcaaacgcgttagtgtgtgcagtgcatgtattatagcttttcccagccagctgtgaattctgctacattctgaggacataggtaatttaaagctgcaaaaacgagttttcgcatttacccattttcctctgtgggtgttgataaaaacactgtgtctgaacaaggatccagagagatggagacggggtgtgtgggatggtaacgggatcttgtgtgggaaacttgttgcccctgcagatgaggctgtggccagtcacatttgctgtgcccagtgctcacctgtcatttagcccaaagggagtgagcaaggttcagcttgcatcccacctcccaggagcacagcatctgccagcagcacggtgtccagaggggtctgggagcatgagtgaggggtcagcgtatggacatgggaggaacccgcacccttccatgtgacctgccccttggccccaccaagggctgcactgccagctgcactcctgtcctttgggctctgtctgtgtgcaggagggttccactgacttcatttgcaaagtgtagggcctctgaaaggcttcgtagttgacatttatagacgtgtaactggaagatagggccaagctttgagttgaaaatgtaatagttcaaaaagggttacatggttcgttctctattagctttgcatggtgagtttttaaataatgttgatctctgggctgcggggacccagtttgacttttagggccctaaccactccttccacctttttctgcattctgaatagtagactttctcagtaggtattaaacaggttaaggtaaattcagaagtgcaacatgtatgtgtttttcttcaagataagtgagcaaataacttcattatgattttatttttttccaatataatatttatacatgataaaaacagcatttgaatttgtgaggacatgaagtattcactccacgttgtcaaaacacccagtagacacgtgcagtgaagccagtagcctctctcgtgagcttacatgagctgtgtggactgatccttcctcacacgccatgctgtcctcagctcacacgtgcactcaggaagcttgcccatactcaagcctcactctagcattgcagacacatcaggttttatcttcagaaagacaccttaaaagtatcagaggaaaatgtgaacacatttttttaaatggtcttggaatgaagagacaaaaaccagaatccatgaaggaaaatagtttgacttctatacagaaaaagaaaataccgtatacaaagttaaaaaaataaaaagccaggtgcagtggctcacgcctgtaatctcaccactttgggaggccaaggtgggcagatcacgaggtcagcagttcgagaccagcctggccaacacggtgaaaccctactaaagaaacaaaaattagccgggcgtggtggcgagcacctgtaaacccagctactcgggaggctgaggcaggaaaatcacttgaacccaggaggtggaggttgcagtgagccgaggtggcgccactgcactctagcctagacgacagagcaagactctgtctcaaaaaaaacaacaacaac

SEQ ID NO: 134827 - DNA, 10120 bp, Homo sapiens
ggggcatttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagagcattgaggagctttgtgccgtcaacttgtatggccctgacgcgcaagtggacaggagcaggctggctgctgttgtgtctgcctgtaaacagcttcacagagctgggcttctgcataatatattaccgtctcagtccacagatttgcatcattctgttggcacagaacttctttccctggtttataaaggcattgcccctggagatgagagacagtgtctgccttctctagacctcagttgtaagcagctggccagcggacttctggagttagcctttgcttttggaggactgtgtgagcgccttgtgagtcttctcctgaacccagcggtgctgtccacggcgtccttgggcagctcacagggcagcgtcatccacttctcccatggggagtatttctatagcttgttctcagaaacgatcaacacggaattattgaaaaatctggatcttgctgtattggagctcatgcagtcttcagtggataataccaaaatggtgagtgccgttttgaacggcatgttagaccagagcttcagggagcgagcaaaccagaaacaccaaggactgaaacttgcgactacaattctgcaacactggaagaagtgtgattcatggtgggccaaagattcccctctcgaaactaaaatggcagtgctggccttactggcaaaaattttacagattgattcatctgtatcttttaatacaagtcatggttcattccctgaagtctttacaacatatattagtctacttgctgacacaaagctggatctacatttaaagggccaagctgtcactcttcttccattcttcaccagcctcactggaggcagtctggaggaacttagacgtgttctggagcagctcatcgttgctcacttccccatgcagtccagggaatttcctccaggaactccgcggttcaataattatgtggactgcatgaaaaagtttctagatgcattggaattatctcaaagccctatgttgttggaattgatgacagaagttctttgtcgggaacagcagcatgtcatggaagaattatttcaatccagtttcaggaggattgccagaaggggttcatgtgtcacacaagtaggccttctggaaagcgtgtatgaaatgttcaggaaggatgacccccgcctaagtttcacacgccagtcctttgtggaccgctccctcctcactctgctgtggcactgtagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagttgaggttcctatggaaagaaagaaaaagtacattgaaattaggaaagaagccagagaagcagcaaatggggattcagatggtccttcctatatgtcttccctgtcatatttggcagacagtaccctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacccttgtcgagtgctggaaggattgtttatccatcccttataggttaatatttgaaaagttttccggtaaagatcctaattctaaagacaactcagtagggattcaattgctaggcatcgtgatggccaatgacctgcctccctatgacccacagtgtggcatccagagtagcgaatacttccaggctttggtgaataatatgtcctttgtaagatataaagaagtgtatgccgctgcagcagaagttctaggacttatacttcgatatgttatggagagaaaaaacatactggaggagtctctgtgtgaactggttgcgaaacaattgaagcaacatcagaatactatggaggacaagtttattgtgtgcttgaacaaagtgaccaagagcttccctcctcttgcagacaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacagagatccagaaagtgagacagataatgactcccaggaaatatttaagttggcaaaagatgtgctgattcaaggattgatcgatgagaaccctggacttcaattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataattgcaaaacagctctttagcagcttgttttctggaattttgaaagagatggataaatttaagacactgtctgaaaaaaacaacatcactcaaaagttgcttcaagacttcaatcgttttcttaataccaccttctctttctttccaccctttgtctcttgtattcaggacattagctgtcagcacgcagccctgctgagcctcgacccagcggctgttagcgctggttgcctggccagcctacagcagcccgtgggcatccgcctgctagaggaggctctgctccgcctgctgcctgctgagctgcctgccaagcgagtccgtgggaaggcccgcctccctcctgatgtcctcagatgggtggagcttgctaagctgtatagatcaattggagaatacgacgtcctccgtgggatttttaccagtgagataggaacaaagcaaatcactcagagtgcattattagcagaagccagaagtgattattctgaagctgctaagcagtatgatgaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggaaacatatctaccttacatgatccgcagcaagctgaagctgctgctccagggagaggctgaccagtccctgctgacatttattgacaaagctatgcacggggagctccagaaggcgattctagagcttcattacagtcaagagctgagtctgctttacctcctgcaagatgatgttgacagagccaaatattacattcaaaatggcattcagagttttatgcagaattattctagtattgatgtcctcttacaccaaagtagactcaccaaattgcagtctgtacaggctttaacagaaattcaggagttcatcagctttataagcaaacaaggcaatttatcatctcaagttccccttaagagacttctgaacacctggacaaacagatatccagatgctaaaatggacccaatgaacatctgggatgacatcatcacaaatcgatgtttctttctcagcaaaatagaggagaagcttacccctcttccagaagataatagtatgaatgtggatcaagatggagaccccagtgacaggatggaagtgcaagagcaggaagaagatatcagctccctgatcaggagttgcaagttttccatgaaaatgaagatgatagacagtgcccggaagcagaacaatttctcacttgctatgaaactactgaaggagctgcataaagagtcaaaaaccagagacgattggctggtgagctgggtgcagagctactgccgcctgagccactgccggagccggtcccagggctgctctgagcaggtgctcactgtgctgaaaacagtctctttgttggatgagaacaacgtgtcaagctacttaagcaaaaatattctggctttccgtgaccagaacattctcttgggtacaacttacaggatcatagcgaggtgccgatgaatagcgaagtgccgtatgaatagcggggatctctaaa

SEQ ID NO: 134828 - DNA, 4615 bp, Homo sapiens
ggggcatttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcagatgagaccaagaataactgggaagtgtcagctctttctcgggctgcccagaaaggatttaataaagtggtgttaaagcatctgaagaagacaaagaacctttcatcaaacgaagcaatatccttagaagaaataagaattagagtagtacaaatgcttggatctctaggaggacaaataaacaaaaatcttctgacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagttgcagcctgtgaacttttacatagcatggttatgtttatgttgggcaaagccacgcagatgccagaagggggacagggagccccacccatgtaccagctctataagcggacgtttcctgtgctgcttcgacttgcgtgtgatgttgatcaggtgacaaggcaactgtatgagccactagttatgcagctgattcactggttcactaacaacaagaaatttgaaagtcaggatactgttgccttactagaagctatattggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcagggaagaagagtctctggtggaacagtttgtgtttgaagccttggtgatatacatggagagtctggccttagcacatgcagatgagaagtccttaggtacaattcaacagtgttgtgatgccattgatcacctatgccgcatcattgaaaagaagcatgtttctttaaataaagcaaagaaacgacgtttgccgcgaggatttccaccttccgcatcattgtgtttattggatctggtcaagtggcttttagctcattgtgggaggccccagacagaatgtcgacacaaatccattgaactcttttataaattcgttcctttattgccaggcaacagatcccctaatttgtggctgaaagatgttctcaaggaagaaggtgtctcttttctcatcaacacctttgaggggggtggctgtggccagccctcgggcatcctggcccagcccaccctcttgtaccttcgggggccattcagcctgcaggccacgctatgctggctggacctgctcctggccgcgttggagtgctacaacacgttcattggcgagagaactgtaggagcgctccaggtcctaggtactgaagcccagtcttcacttttgaaagcagtggctttcttcttagaaagcattgccatgcatgacattatagcagcagaaaagtgctttggcactggggcagcaggtaacagaacaagcccacaagagggagaaaggtacaactacagcaaatgcaccgttgtggtccggattatggagtttaccacgactctgctaaacacctccccggaaggatggaagctcctgaagaaggacttgtgtaatacacacctgatgagagtcctggtgcagacgctgtgtgagcccgcaagcataggtttcaacatcggagacgtccaggttatggctcatcttcctgatgtttgtgtgaatctgatgaaagctctaaagatgtccccatacaaagatatcctagagacccatctgagagagaaaataacagcacagaggtgggtacttgggtcacaatcggggacatgttgtcctggaatttcaggccctagtatgttgccgtgctcctgcagctgctcctgcttcctcagggaaggcttatatcagtgggatgtttgctgccagtgacctcaatagttgtttagaaaacacatttaactagtgccttccctgtaccaaacttaagcaaacttcagacatggttagcgccatgtttgatctccatgctagcttagtgcgtgtggatcctgttagatgttgcctctgtttgcttcat

SEQ ID NO: 134829 - DNA, 2837 bp, Homo sapiens
ggggcatttccgggtccgggccgagcgggcgcacgcgcgggagcgggactcggcggcatggcgggctccggagccggtgtgcgttgctccctgctgcggctgcaggagaccttgtccgctgcggaccgctgcggtgctgccctggccggtcatcaactgatccgcggcctggggcaggaatgcgtcctgagcagcagccccgcggtgctggcattacagacatctttagttttttccagagatttcggtttgcttgtatttgtccggaagtcactcaacagtattgaatttcgtgaatgtagagaagaaatcctaaagtttttatgtattttcttagaaaaaatgggccagaagatcgcaccttactctgttgaaattaagaacacttgtaccagtgtttatacaaaagatagagctgctaaatgtaaaattccagccctggaccttcttattaagttacttcagacttttagaagttctagactcatggatgaatttaaaattggagaattatttagtaaattctatggagaacttgcattgaaaaaaaaaataccagatacagttttagaaaaagtatatgagctcctaggattattgggtgaagttcatcctagtgagatgataaataatgcagaaaacctgttccgcgcttttctgggtgaacttaagacccagatgacatcagcagtaagagagcccaaactacctgttctggcaggatgtctgaaggggttgtcctcacttctgtgcaacttcactaagtccatggaagaagatccccagacttcaagggagatttttaattttgtactaaaggcaattcgtcctcagattgatctgaagagatatgctgtgccctcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggaccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagttcctgaggtgtatactccagttctggagcacctcgtggtgatgcagatagacagtttcccacagtacagtccaaaaatgcagctggtgtgttgcagagccatagtgaaggtgttcctagctttggcagcaaaagggccagttctcaggaattgcattagtactgtggtgcatcagggtttaatcagaatatgttctaaaccagtggtccttccaaagggccctgagtctgaatctgaagaccaccgtgcttcaggggaagtcagaactggcaaatggaaggtgcccacatacaaagactacgtggatctcttcagacatctcctgagctctgaccagatgatggattctattttagcagatgaagcatttttctctgtgaattcctccagtgaaagtctgaatcatttactttatgatgaatttgtaaaatccgttttgaagattgttgagaaattggatcttacacttgaaatacagactgttggggaacaagagaatggagatgaggcgcctggtgtttggatgatcccaacttcagatccagcggctaacttgcatccagctaaacctaaagatttttcggctttcattaacctggtggaattttgcagagagattctccctgagaaacaagcagaattttttgaaccatgggtgtactcattttcatatgaattaattttgcaatctacaaggttgcccctcatcagtggtttctacaaattgctttctattacagtaagaaatgccaagaaaataaaatatttcgagggagttagtccaaagagtctgaaacactctcctgaagacccagaaaagtattcttgctttgctttatttgtgaaatttggcaaagaggtggcagttaaaatgaagcagtacaaagatgaacttttggcctcttgtttgacctttcttctgtccttgccacacaacatcattgaactcgatgttagagcctacgttcctgcactgcagatggctttcaaactgggcctgagctatacccccttggcagaagtaggcctgaatgctctagaagaatggtcaatttatattgacagacatgtaatgcagccttattacaaagacattctcccctgcctggatggatacctgaagacttcagccttgtcaggtaatgtttagaagaattgtgatgtgtattgtaattaaaatggaaatggagtaactataataggtaggactgtatttttgtaacttctgaaatttaagcccagtgtgttcaaaatatgtttgattgctatttttgtaatttccctaatttatctgactctaattgtgataaagaaatatagttgaggtattaaaaaatttttcatttactcacttatagcttactaagatttataaaatcttcaaagacaagtactgtcttcaataccttgaaatttttatgactcctaatacactgctttgcaaaaaaaacttgttgaataaatcagtcaggaattaaacacttcagaaaattcaacagt

SEQ ID NO: 134830 - DNA, 516 bp, Homo sapiens
caacaatcagatcaagatagagaacatttccaggaccttgaaagcttccctcctgtactctcttagtcattgcttaacgaaagttaccacttttctgatacccatcactatagattagttgtgtttattcctgaaattcatataagtggaatcaaatcattcttttatgtctaatttcctgtgttgaacattacatctgtgaaatccatgttttttgagttagtagtagtaattctttttcattgctctgtattatttcattatacgagtgtctatttgcgtcttctgttgacagacatttgggctgtttccagtgtttagttcttagaaacaaagctaccataaacaattttgtgcatgtgttttggtggccataaaaattcattttttggcaaagcgcttcatttaaatatataataaaacatatctccatatatatacacacatatacacacataattcttttttttaattatactttaagttctggggtacatatgcacaacgtgcaggttt

SEQ ID NO: 134831 - DNA, 1026 bp, Homo sapiens
tccgcggaaattcggttcgtgagcgtgcgcggaggtcgccgcggggaggcgggtgaggggagggggccggagggtcgggggtgccggggggtgcgggaaggctgcgggggtggctgttggggacgttcgtggcgggggaggctgttggggacgttcgtggcgggggaggctgttggtcccctccccgccccaccgcgtcccagggaaccccggcagggcacccagtgaggggggccgcgtccgcccattcctcactgctgtccccgcctgtgcccgaaacccccgttcacgttcaccgagaaaacagacataaacccagccaggcacatccactagaatggctgtgatttcagaaaagcggacgtaagtgctgccgaggagatggaggcgttggaccccctcgcgcattgtcggggcgggtgcagccgcggtgcaaaaggaccttcctcagaaagttgagcacgaagttcccacaggcccggaagttcccctcccgggcgctccccagagagctgaagactgggcgcgtgccggcggcaaatgttcacagcaaagggcggcccagtgcgcagctggaacatcagccccaggcggtcgctgcgacagggacgagcctgggaaacgtgaaaatgtccagaacagggaatccacagataaagaaaagacatcgtggttgccagagctcgcgggagggggcaacagggaccgactgcttaacgtgtatggttccccttcagggtgaggacgtgttctgggacgaggtcgaggtcagggttgcaggacaagatgaaagcgctaaatgccactgaattgtttgctttaacgtcattaattttgttatgtgaatttcatctcaatagaataaataggtcaagctggctgcagggcccaccccaccgcggcctggagcagggtcttctggggtgtaccacctctgccctcacccaggctccaccacgaccagcttcgtccaccccccaggagaccatgaaggcccacgtctgaaatcctcactaagcccaccct

SEQ ID NO: 134832 - DNA, 256 bp, Homo sapiens
gccacgggacgtggagcagatggtgaggatagtggggaggtagcagcagaggatgacccgaggcaaaagtgcaagtgaagaaaagtcgccttgccgggcagaggtacgggaccaaggcgcctcctctgggctgaggagttagagggaagaaaatggcgccctgtcatgagggcgcgaggtccgagttgaggggagaagactgagggacacagaagtggccgaagtgagggcgctgaggtcagcctgagctgagagg

SEQ ID NO: 134833 - DNA, 289 bp, Homo sapiens
gtgggactcactgggaaaccgctctctgtggtgccagggaaggacgtctgtgggaggtgcctaccaaggaagtctctggaaatcagcctgcaggggtggagtgccgggaaactcccgccccctccccccctccccgaagtgaaccgcccacagggagatgcccctatgggagcttcgcaccagaacccgtctgcgccagtgtccctgcagcgccctctactggcgaagctggacatggcgtccgctggcaaaggggaaactcttctttcctcccaagccgagcaatgct

SEQ ID NO: 134834 - DNA, 577 bp, Homo sapiens
tctcccactacaaacctcagtgtagatatctggtcttactgcagcaggcaagcgggccccagtttggttctctaacagtagcaactctgtaaatcggaattttcctgcacccccagagtttattcttgttatttgttgtcactggtttgtgttgtcatttctgaattattttaagtctatattttttaattgtgtgtggccaccaaggtctctgcttggttagtttaatggtcagctcataattgtgcagagacttccttaaatgcctgcaatcattaagttctcctgtctggccaggcatggtggctcatgccataatcccagcactttgaggggctgacgtgggtagatgacttgaggtcaggagttcgagaccagcctggccaacgtggccaaaacccatctgtactaaaaatacaaaaattagctggcatgatggtgtgcgctggtagcttcagctattcgagaggctgaggcaggagacttacttgaacccaggaggtagaggttgcagtgagccaagattgtgtcacttcacttcagcctgggtgacagagaagggctctgtctaaaaaaa

SEQ ID NO: 134835 - DNA, 192 bp, Homo sapiens
tttcatacagagaatgaactcctcaccgtcctctctgcagagcttcccaagtggtatgctgtggattatgggtttgcagagatactgatctcagtggtcggggggcagctgggagaggtgatgcaggcggagctccagactggttgactctagctgcttctggtcagagctacgcccccaaaccggttacca

SEQ ID NO: 134836 - DNA, 312 bp, Homo sapiens
acttctacccacaaccaccttcacattcctaattgcttttttatcaaatcctagacatcatgtcatttgaaaatacactgcagttatgtttgaagctccttcatctgtagtaaagcaactaaataaaagctgtttctatactgaaaactgcagtggtccctcacaattagaatacttaagtatctacttaacataaactaaaatgaaagacctttcgtattctactaatacacagcaagaaataaaaatgcctacataagtcaatttcaccaatctctgttttaaaataagtcagatgatacctaagtgctt

SEQ ID NO: 134837 - DNA, 291 bp, Homo sapiens
ggtgttggaatccagggaagtcattaactggctgtacaaggccaagtcagaacccatattcactctccatgtacatgagataaactgcctagaagaccaaatgtgtaaggaaggagaaacaatgattctctgtagtagggtgtggctatatgtcctgcctacctggcattttccccaacacttcacattcaagtcttccatgaaatttatagtttgccatatgttcatattattccatcttaggtctgctcctcctgctgctgctttctctggcggggaatgcccttccac

SEQ ID NO: 134838 - DNA, 123 bp, Homo sapiens
gatagagaccatgtggcccacaaagcggaaaatacgtactatctgaccgttttcagaaaaagtttgcccactcttggcaaaatcatttgacaagcctatctaaactaagatcacttctgtggc

SEQ ID NO: 134839 - DNA, 523 bp, Homo sapiens
tgttatctgcataagacacctaacctgtaatgaccaattaagactcaaattagctagcgccaacagcgggtatcaaaatgccatcaaaattttctaagcttgcacctacaaatgttccctaaggcaagcataaaggcatctaacatttaccctaaattatgccagtgagtagcaaaaatgtgctcagttagacgcaacatgtcacaacatggtctgactgttggaagaacttagtgcagggagagctatacccagaggaaagaagtaaaattaggcagagtgttgatggctgagttccagtgtcacatttatatacagctcaatgactctagaattgtccttacaccaaaaaaaagttattcatagattcaaaaaatcaactgctcactactttcatttaaaaatgccttgtgtgaacaaggcgttccaactgaaaactggcagaattcatagaggttcttaaagaacatcaattagattcttagtcaaccaatttggctgtaaaatcaaaactgaaagtgca

SEQ ID NO: 134840 - DNA, 468 bp, Homo sapiens
  misc_feature (25)..(25): n is a, c, g, or t
ctagttttagaagtttcaatagcanaaagaagtgttattagaaagcaattttttcaaaatgaacactcaggtacttcacttaccgttttagttgccagagctgctctgtctcactctaaaagcattttcttgcaaaggggttggttttgatcaacccaaaaatctggcagctgtgaaaatcaaagttaatgctatagaacagcgttgtccaatgggacattctgtgatgatgggaatgttctgtgtctgtatatggcagccactacacatagatggctattgagcactcgaaagagtggtaataatgacaaaatgtgtcaaacagagcccagtgattcctaatattttatgcaactggaatgaacaaaaaacagatctacaactgaatggctccaaattatttactgaaagtttaccctctgtcattttaggtggtttaatattttctgttgaaactcataaaacagt

SEQ ID NO: 134841 - DNA, 352 bp, Homo sapiens
ccagccgggcttatatggacagagagctctgatctctccctgggatgcagctcccagaaggaggggaggctgccatctctgtggttcagtcaactgagctgttccagcttgcctactctagagagtctgggcagtccagatgaggaagggtcctccccaacagagcacacctgctctacagccagactgcttctttaagcgggtccctaattctgttcctcctgactgggtgagacctttcaataagggtctccagaaacctctgaaacgagcatttgggccagcagcaggtcagtacccaccctgggatggagtgtccagaggaaggagcaggctgccatctttgctgctt

SEQ ID NO: 134842 - DNA, 632 bp, Homo sapiens
gctcacccttcttggggcaggcatgcctggacagagagcacctcacagacattgtccaccgctgggacagagggtgcagcagtgctcagaggagctggactgtgctgatgagttaccgagtttttgttgagctcctaatgtgcaccagccctgcacaggatgctatgggggatgtggaaagaagagcaagtgcatttaatgaaccagcttcaggccttgttgtaatagaagacaagagacagaatcagggatgtagctctagaacattccatgacttcagtccccactaaagaccccaaagagtactctgcaaatatctgtggaaggacaaaatgttctccatagcccttgaagattctctgataagagataaaggagaattcaagaatagacagtggagacctaagccaacccatcagctccagagactcctcactgccaggggaaacaacatctgccaagtctcatggtaggaatctcacttgattaaacaaaaaaaagcccaggcactggtgactaatttgactagcaattctcaacccattgaaggaattttagagatgagcaagttgagacccagataagaaaactcagtaatcaaaggggcacacctctccctgtcctccttagtc

SEQ ID NO: 134843 - DNA, 297 bp, Homo sapiens
taggtggtagctagctgcttcttgaaggtctgctgacaagaagtggcccactaggcaacttgtgctccacttccgggcactgtgggtgggtaaggcaggctggggtgccacggatgccttaggatcctgcccgagccaggagggcatcttcattgcgtgagccccccactcccacaaatgttggactttttggtccatgtgattcttgtgttttcttttgctttttgaattaactaggtaacaattcattatactaattgtatggtactttgtattaaattctctctgttaaaacca

SEQ ID NO: 134844 - DNA, 423 bp, Homo sapiens
gttgagaaaatgtagcagcctgagatttaagaaacaagtgatccctgagacagagcccttgaccctaaaggggaaaaatattcagttacactcatgagatataaacatagtacttttgttgtaactgctgagaactgaagagctaaaagtcaacattattttcctttttgagactcaaagtgtgtccaccaggagcactcttcccaatggaggcaaaatctgccaaagttgtttttgttgctgtctaaccttagaccatttcatctgccccaactaaaagtcctagccacagctctctcaagcgattctccaccctcagcctctgagtagctgggactgcaggcacatgtaccacacccagctattttttttaaatttttaaattatgttttttagagtcaagggtctcaccttgtttctccg

SEQ ID NO: 134845 - DNA, 325 bp, Homo sapiens
tgtggctctggattccgtgttggtgcatgctgaggtgggcattggttctgatgtgtggctctggattctgtgttgacatgtgttgaggtgggcattggttccagtgtatggctctggattccatgttgatgcatgctgagttgggcatgggttccattgtgtggctctggattctgtgttgatgtgtgctgaggtgggcattggttccagtgtgtggctctggattccatgttgacacgtgctgaggtaggcgtaggtcccactgcatggctctgggttccatgtttgtgtgtgctgaggtatgcctaggtcacccgagctagtt

SEQ ID NO: 134846 - DNA, 369 bp, Homo sapiens
accatattagatgcacagcgacaaaagattaaacaaagcctgacagggccagaagcatccacatgtaattcaattacttggtttagcaaaacagtcaacatcctataatggaagtcagcattatccagggtagtgagttgaattgtatccctacaaagttcatgtctacctacaacctctgaacatgatcttagtgaaatagggtgtttgcagatgtaattaggataatgactgaaatgagcgtatcctggattagggcagaccctaaatccaatgagagttttcttacaagaaatagacaaggacacactaggacacagagaagacagtgtgaagacggaggctgagattggagtgatgtgcttgcaa

SEQ ID NO: 134847 - DNA, 315 bp, Homo sapiens
ggaaaatcatgactgcatttaaaataaatatatcttgcttggcgctgtggctcatgcctataatctcagcatttgggaagccaaggtgggaaaacagcttgagcccaggagttcaaaaccaacctagacaagatggcaagacctccatctctacaaaaaatttaaacagctgggcgctgtggcgcatgcctgtagtcccagctacttgggagaccgagacaagacgggaaaatggcttgaacccaggaatgtgaggtggtagtgagctgtgatcacaccactgcactctagcttgggcagcaaagcaagacctca

SEQ ID NO: 134848 - DNA, 657 bp, Homo sapiens
gtccattacgttatggtaaaattctgcaaggatgtagaaaggtaatattgattgaagaagtaaaaatgcaaaacatataactgaaaatgctcattcatacatataattgaaaaaaacttaagtaaaattctacatttttattaacttaaaaaaatcatatttcaaacagtagagtctgtgagctatgaaaatttacaattcacttggcattcccagcgccttgcgctccctgtgactgcgctgtgcaggcgtcttggtttgtgcagggtggttctcatccttgccagcatccccttcccctttctccccttacacacctcactcccttctttgccgagttgtgggggctgttttaggcctggcttttgtttttggaagggcaggtttagcagacaaccctgcctatctcctgtgtggctcctctatcacctttgctgtgtcacctttttagccgatttcctgggcatggtggcttggcaggcagctttgccaatccaaggtatgctctctgctcctggaaagatttctgagtcccacagccatccgagggctacggagctcccagtttccaacctggctgagaaggtggcctcagcttgggcagaacaggtggagactttgggaccatgaagagacatgcagagccaggaaagagga

SEQ ID NO: 134849 - DNA, 273 bp, Homo sapiens
gagatggatcttgaaaggacaatggtttcctctgaggactgtcatctgaaaaggatggcaggtggtgtcctggggttctagacaattattacatgggtgtatattttataattattgattaaactgtagatttatgttttagacacatttcctctattattccacaattaaaatactaaataaaaatacacaacacaatacacaattaaaatactaaatttcacaattaaaattctacccacaaccatgtaaaaaattaggtaaacaaaaatc

SEQ ID NO: 134850 - DNA, 420 bp, Homo sapiens
atcatattttagtactttttatcatctccttcattgcttccttcccacccttacttaaactgtgtggtgcatacttctgtatagcatttgcatattgtatgggaataatttgcagcttaaaaaaactttgccttttttatgagaacacaagctctttgaagtcatggtacagggtttttcctatttgcagcaaagggcctagggcagtgcctgtaatctagcagaattcagcgaatgtttgtggaataaatgaggggttctatctgggtgtattgcctccattagattacaaatagcatatgctgggtgaggtggctcatgcctgtaatcccagcactttgggagcccaaagtggaaggattgcttgagcccaggagttcaagaccagcctggggaacataggaagaccccatatctaca

SEQ ID NO: 134851 - DNA, 518 bp, Homo sapiens
gacgtccccggtgcatcccagaaccggtcggaatgtccgaaggcggttgttgctcccttgtttttccttgctgcttgtccgttcgctaaatacgctgggcgccgttccccaactgtccttccgagagccccttgcccacttctgtactgttacagtgacgccgctctgggcgcaccgagccgcgctgtgtttcgctgctcttcctacctattctcagtttgtaaagaaataatctcacataacactccttaatgtactcctccgtaagataaattgcagataatatacgtctgctaattctctttatctccacgtcttctcacgccatgtactaagtagaaatggtttcatttaggtgaaaataatgcagactagcacatagcacaacaagggcttgtaactattaaggactttatgtaacagtctgtaattctgtgtatctgtctggtctttccggacttggcactttagtctccgagaataagccatttcctgtttaggtagggtaggaccaacca

SEQ ID NO: 134852 - DNA, 439 bp, Homo sapiens
attagatacagggagctagaagaagatacagaccaagcaatggaactgggaaagaacgttcttgaaagctgagctggaagcctttcctctgcatgtgttatttctgccatatgattcatctacactgagacaggccttgctgtataagtcagagtcacactggtaccctcaagaaggctgacatgaggatatgttgctgggagctacctaggcaatgacaggggacaggctggaatgacagggaagccacgttcctcagcagcagattacaggaaacctgcccacagcctgagcagtgcccgcaactgctctgtgccatcacaatttcccaagtagttattgtggctatgattggaaaggggtcaccgtcacatgtttaagataaatgtaatttctttggctagagtttatgttctggaatgctgcaatctgagtcaag

SEQ ID NO: 134853 - DNA, 415 bp, Homo sapiens
aatttaaatgagtttccagagatatatttatatgaaaaagaaaagggggaaaaattaggacaaaaaagtagagtcaggaatgaggctaatataaacaaaaagcaattgtaagtattgccatactatttaaatctatttggttcctgagtttaggttaagaaaaactaggaatttggatagtgagacatttaacagaaattttaaccagatctctttagcatataaatttggacaacaaaaaatctgatactaagtaatgccactaagtgatcactataggtgagtattttattagtattgagataaatacaatacacagttgacccttgaacaacacaggtttgaactgcttgagtctacatatatgtggattttcttctacttctgagacccataagatagcagcacatttaag

SEQ ID NO: 134854 - DNA, 304 bp, Homo sapiens
ataagatctgccacctgtggcttcccaaagtgctgggattacaggcatgagccactgcccctgtccgagagctaattttcttaggacacgcagcaacttctactggatgatcgcaccttagaatgataattatgtcaccttgcatttccagaacatttggtatttttttcagagagttttcacagtgattatctcagttgttcatcaaaggatttttcattatgaactgcatttgcgtattttatttacctataatcctttccccgctgctgaaacaatagcattctgggcacacattatggag

SEQ ID NO: 134855 - DNA, 275 bp, Homo sapiens
gtcaccctgtggctccatttttgcttgtgggggccttccacgagagacacaggcacactgcttcaaagcatgggcatttgcagcctgcccgggacagccctgggatcttctggaatggaagaggcctccttgggaggctcccattattttctgagatctcgccgcttctcccttctgcctgcctcaacgtcccccggagtccctgcgtcccgcctacaccaccctgcagcctcgttttctctattgggcaccttcggcaagagacacaggaacct

SEQ ID NO: 134856 - DNA, 171 bp, Homo sapiens
atggggcagctgaaagaaagggctgtgtcagggtgtctttctcccttttctccctcatttttctagatgcttttttgccttgtagttctttctctttttctttgctttctctttcctttttctgtctgtctcctatacctccccatctctcccttgcccctgccccatctt

SEQ ID NO: 134857 - DNA, 425 bp, Homo sapiens
ggcacagtttctgcgctcatccttacttcagctctcagactgtaaacaagggttcttttcgaggtacagttaatgttgtgtttctttcgcatttctgtgggtgatttcacagtttaaaatggcccccaggtgtggtctctagtgctgtctagggatcctgagggcaagaggccatgagccatgacgtgcctcatgcagaaaatatggttagagaaaccatgtgcaggcatgagacacggtgctgccggccagggctgccccactgatgagtgaagaacacgtattatgtaggtgtctttacacagaaacacacatcacacgatgccaggtgctggtcattgatgaaattgttgtgaccagaatcttgcaggaatctaactgtgagggttaattttctgtgtcaagttggctgagccacggcaccc

SEQ ID NO: 134858 - DNA, 376 bp, Homo sapiens
cagcacaccaacatggcacatgtatacatatgtaacaaacctgcacattgtgcatatgtaccctagaacttaaagtataataataaaaaaaagaaaattgttaaaatagattgaaaaatgttttgaggctatctaaaagttggctttgtttcaactgagagggaaaaaaaatagtgatttaacagttcctggaatgaaacatgtaaggatttctgaaacctctcaaggtgactgaaaaatttggagggaatatggctgaaagaaaaagtaatgcaacatctttggcctaataaaacttccttttcagctctaatgtaagtttacaagagacttgtaccttaaataacaaattctatgaacaaatctttattaaaaa

SEQ ID NO: 134859 - DNA, 174 bp, Homo sapiens
cactattctactcgctattctacagactccaaatcatttactgctggcatttttctctgttaagtgattgttctcctgaaaaatgccagattgacagccttttaaacctaagtcttgtcccctttcagtcctgggagtgcgagctgcattgactgaagcaatgcattcctccac

SEQ ID NO: 134860 - DNA, 556 bp, Homo sapiens
tttcacttccacttcccccatcctgaacactccacaagatgatgctactctctgaggcaacagcaaccattttgtctttgtctccatgtggccctccaggttgattgttcattggaggatccactgtaatctatctgaaagatggatctgatgatgtcggtcgctgcttaaagtcgttaagattgtcatctttcctttgagaatcaggtattaacctttttaaagtcttatctctttcttattcctctcaagtacttgagagtatttagcatgctatcatctctgaacagattatgggttttcacacagatctgtgctcctattctggaaataaaatttgcctggactaccatgctcaaggcatagaacttcgaacatttaaaataaatggagaaatgcaaaaccacggtttaaaaaactcacttattttccaaagtaacttaaactcttgaaaatatgctcaaatatgcatctagcaaaaaaatttaccactacatttattcaatatttgtataaccaaaagcagaaacagtacgaattctacaaggaaaaaaaa

SEQ ID NO: 134861 - DNA, 560 bp, Homo sapiens
gttgggagacctttctgtaagcgaggtcgttgattaagtatgtatattagttgggcttaggtttgactgtaaacaacaaatacatagaataataatggcttatttgtttttcttatttttgatggagtctcgctctgtcgcccaggcaggagtgcagtggcgtgatctcggcttactacaacctctgcctcctgagttcaagcgattctcctgcctcagcctcctgagtagctgggattacaggcacctgccaccacacccagctaatttttgtattttttgtagaaatggggttttgtcgtgttgccaggctggtcttgatttgtgagctcaaaatgattctcctgcctcagcttcccaaagtactggggttacaggcatgagccaccgcacatggccctgaaatctatgtctttaaaaaagtcccattgtggggccaagcatggtggctcacgcttgtaatcctagcactttgggaggccgaggcgggtggatcacgaggtcaggagttcgaaaccagcctggccaacacggcaaaaccctgtctctactaaaaatac

SEQ ID NO: 134862 - DNA, 393 bp, Homo sapiens
taatttataaattaaatgttaatgaggctaacagtagttaataataacatagaacaattataacaatataccagcattactactcttgcacttttacattgttaagtaaaataggagttacttgaacacaagcgctgtgatactgcaacaatctgataacccagacagtactgagtgactaactggtgggcgatatatacagcctggatgtgctggacaaagggatgattcaagggtgagatagagtggatggcacgagatttcatcatgctgctcctagttttagaagtttcaatagcacataaccaataaaccccaggcagcaatgaacagaaagcacattcttgtgtggcattttgcttatggcacaatcggggtgggtacatggaaggc

SEQ ID NO: 134863 - DNA, 667 bp, Homo sapiens
tgtacactgaagcaagacatcaagactttgaaagctgggttgataatctcacaacttagaagggcccctccagactctttaattgtaaacccataggagatcttaaagctaaccagaaagatttctcctaaaaagcagatggatatctttatgtagatagcttttttaataagatcaaaaatcaagacacatttgctatcatgatactcttagttaagtttgtttatggctctacaaacaatagaaatttaaaaagcatcttttgtgtgcactcattgggtatacttatatgtagagaattttgcagccaacgtgtgaaaaaacataacatcttttataggtaaaaaatgaaaggcaggccaggcacggtggctaatgcctgtaatcccaacactttgggaggctgaggtgggcagatcatgaggtcaggagtttgagaccagcctgaccaacatagtgaaaccccatctctactaaaaatacaaaaattagtcagcgtggtggtgcactcctgtaatcccagctactcgtgggagactggggcacgagaatcgcttaaacccgggaggtggaagttgcagtgagctgaaatcgcgccactaccctccaggctgggctacagagcgagacttcgtctcaaaaaaatagaagaaaaaaaaaaaaaaac

SEQ ID NO: 134864 - DNA, 729 bp, Homo sapiens
gtgtttattatgaaaaatttcaaacatataggtaagtatagaaaatatcagacaaacccatccaacccattacccgtgataaaatgttaacattttatcatgtttgtttcagatcttttctttaatgaaacaaatcatgaaagctgcatttaaagccccttcctttcccttcctcatcattttcccatcctttctccttcagaagcaagaaatatcttaaagttggtgtgtatctttcccagtgtacatttctatgctttgactacatatacatgtgtctctaaataatatatgataatggtttgtgtgataaaaatttatatgtgatgccttacagctttttaaaaaatgttctggtgttttctttatatttaagttctttctagattttttgtgattataaacagagctgttgataaatatctttgtacatgtctccttgtatatgcaagcatttctcaagtgaatacatgtaaaattgcagttacgggggggtcacaggatatacccaggtttaacttgatgagtatttaacttggcactttggtttggagatgacaaacagtaagactgggaagtcagaacttttggatttaaatccttctcactgttgaccatctaaattatattgggcaaaaacttaaaagtctgttttctcatctgtaaaatggggctaattctagaacctaccttgtagtgaatggtgaggattaaaggagggcatagcac

SEQ ID NO: 134865 - DNA, 355 bp, Homo sapiens
ttaagttctctaagctactaagctatttcatgagtttgctataagggttaaataagaagatatatttaaatcattagctaatatatactcaataaaatgatttgtgattaatatagtgtgtgttcagtgtttgttaaacaaatgagtttatagtaagttttggaagaatgaaacagtgcacaatgaaatcgttcaatgttcttgcttaatgatgtatgatgtgaaccagaaaatgactcagtgttaagagaatagcctcttgagtcagacttctagggatcaaatccatcccttactacctgtgtgagcttaaccaagtattgaacctttctagtcctgagttttctcatctact

SEQ ID NO: 134866 - DNA, 310 bp, Homo sapiens
cgagactctgtctcaaaaaacaaacaaacaaaaaaactatatagtggggatatgtaatcaaaatagtttggaaactactatgctacagctctagtcctgagggatgttatgggaagtaaagagcctgttatagagtaagtttaagaagcacagtattctctcatcccctcatacagattcctagggcacattaacagtcctctgctttgagaaatcctgcagtaaacttgtttaaccgagcatttccctcacctatttgaacatacagcctttttaaattaacatctattaatcccctgaggcactagct

SEQ ID NO: 134867 - DNA, 710 bp, Homo sapiens
gatcaaacaaaatgttatcccaagaatttgtctgttccgctgattcttgatggtggaagtcagcttcactttttcatcaaagggaatggggtgaaatagcagtcatgtattgtctgaaaggcatttgaattttcctatccaaaacgctgagtgcatttccactacccatttctgcttctgcctgtcttattattcaaggtgagggtaaaattgggagacttgttttttcttctctatcttaatacaaacacagcagaacttattcatccttgtcactgtcatccccttccttgttttttccttggggagactaaatgcttatctgaatgctgcggctatgcttagactcagaaaggttttgcagtaccccctcttttgcagttgctttcagcgtattcttttgaaaatcctccctactaacaaatctttgtcctttgaagggtgaatttgatatttggaaattaccaaaagcctctttggagccgagtctgacatacaagtctggatgatcaggctgaggccaaagtagggtgtgaccctgtgtcctgcaggcctctagagtctacctgggagagcatgcccacgacaaaggacaccaaagcaggcacctttgccgtcaataacttggattttttttctcatttgttagataggaataaagatactggttgtgagaattaaggagacgaacgttccggtctatttgttga

SEQ ID NO: 134868 - DNA, 370 bp, Homo sapiens
cccaggccacacattctgcagtgactgtgagggctgaatgaatgcttccaggccatcaggaacaagcatagaaacacaaatcaattttaaaatacactcaaaaatgtcaaaataatccaacttttttgtcttgatcagatatatctactagcacatattacttcattttttcagccaatatttattaataacctactgtgtgcttgacagtgttctagtggcagagacacagcagtgcataatgccttgccctctgaagcagatgttgcagcaggaggagacattccaggacatgacaattaaagtggaggaatgtcaagcagaactggggaataagggatgtgaagggggtgagacttgctattttata

SEQ ID NO: 134869 - DNA, 290 bp, Homo sapiens
caccggctgagcaggctggcggcagccaggcaggctgggaatgacatttgccatgctgtgcccccggctctggcactgggcggctcctgaggcccaggaggagcgtgactctccccagcaccgtctcagcacaggtgagcagagaaaccagaccctccccctcagcctgttggagggcagaagtgaacacccctgtcccccaaatccctgtcatgcttttttgagccccaggaggggacacggcattgtcctggagccacagcattggtctgactctgactcgcattcga

SEQ ID NO: 134870 - DNA, 468 bp, Homo sapiens
agcgctattcttagtgattgcaaaacaaaggggaataaaacatagttcctgagaagctcaaagtctatcaattacagaaataaaaataccaatcatgactcagctaatgttcattgagtgctatgtgctagatactgaactacatactttgcatgcattatcttgtgtaatgatcttgacagtacattacttgacagtaatataccattattactcccattttacagatgaagaagctaaagtttatggacaaagctaaagtcagatcatttgaaaatggcagagtcagggttttgaggggggtttttgtttttgagacagggtcttgctgtgtcaccaaggctagagtccagtgacacgatctcagctcactgcaacctccacattccaggttcaagcaattctcctgcctcagcctcccaagtagctgtgactacaggtgtgtgccaccatgcctgactaattttt

SEQ ID NO: 134871 - DNA, 499 bp, Homo sapiens
ctccaagctgatccacgttgctgcaaatgacaggatttcaatcttatttatggctgaataatatcccattatatacacagcaatttttattaaggggtcatttctaaacaaggttgtaaccaagcgcttggggtgaggatgtagattggcttcagaacagtgcttgagacctaatgtgattccctccaattcttgaaagagttcttccaacaagtttgaggtttgaacacgagattgtcccatggggctacaggtgtcaaggcaggccttttaatgcagtagccaaaaatagtatatccagggctttcctcacttgcatcctcccattcatttcttcctcctgtaggtgaaaagcttgagcatacagatgggaagaaatgaatgggaggatatcagtgagtaaaggcgcggatatactattctcggaaacaggatgggtatgggtgaggagatacaaggtgtcagctaatgacaggtagtgtttaaagttcgcgctggt

SEQ ID NO: 134872 - DNA, 110 bp, Homo sapiens
ggggaacctgaccttctccagcagtggggaacctgaccttctccagcaggggggaacctgaccttctccaggaaggaggaacctcaccctctccaggacgggggaacctg

SEQ ID NO: 134873 - DNA, 552 bp, Homo sapiens
agacaggagttggtcttgactgggctcactctcagtatgtggcaagcgctcatgctttatgagtttttaagattaggaagatgattagggactgaatacagagagatcagggatcttccccaggaacatataatttaatatggatcaatttgaaattcgacattatgtgctggtcttgaatgtataaatttggattatgtttttcacctttctattgtttagaatgatgaaaagttacatttacggatgaatggtaaatatgatcatagtgaagatgatcattcaccagcagaagttgttgagaattataaactctgagaaccaagaaatacttacaagatttttacaacctaaaatgttcaaatatgagcacttattaagtcagacatattcattatatggagctattctgtagcctataaaatatttactaaattattgatgacaaggaaaatgtttatgatatagtactctgatctaatggtgaatctggagcttcaataaattctttaattttatacaaatcttattttataaggttttacagaaaaa

SEQ ID NO: 134874 - DNA, 180 bp, Homo sapiens
agaatccagcatactggaagaacaacgaaaaagatgaaataatcttttagctgggaaaaatatgttgttttgaatattttgagtatattttaacttcaacgataagcttaattccaatttcaggatattatttaaggaaaagcttagaagtgtactccacaaagaattaagaaacacaag

SEQ ID NO: 134875 - DNA, 342 bp, Homo sapiens
gactacaggcacatgctaccatgcccagctaacttttgtgttttttgtagagatggaggtcttaccatgttgtccaggctggtctcgaactcctgggctcaacccatccacccaccttgacgtcccaaagtgctgggattacaggtgtaagccactatgcccaggggcaggctttttgttttagtgctttgaatatgccctctcattttttttctggcctataagatttctgctgaaaagtctgccattgctcttttcttactgattttagaattctttcactttgactttcgacaatctgattataatatgctgtggtgaagtcctttgtgcagtgtattt

SEQ ID NO: 134876 - DNA, 427 bp, Homo sapiens
acggggtttcaccatgttggtcaggctggccttgaactctgaactcaagtgatctgcccacctcggcctcccaaagtgctgggattacaagcatgagctaccgttcccagccagagacaatacatttttgttgtttaagccacccagtttgaggtactgaactacagcaggcttaggaaactaacacaacctttaatcgcttatgattgacattttgatctttctgagatgtcagcaaaagtttgtgtagtcccatacttggacttttatctatgttagttttgggcaggcacttctgaattttagcctcttttgcaacctggatgggctgagaattttccaaattatcaagtcctgattccttttttttttttttttttttgagacagagtcttgctttgttgtccaagctagagtgcagtggtgc

SEQ ID NO: 134877 - DNA, 617 bp, Homo sapiens
acatacatgcatttttaatacttaaaatcgcatacacactccctggttgccggtcccttttccctctattattgtggacatgtttccatatcatttcatatagatcaaccttattctttctcatggctacataattccatagtatgcatttgtaatatctttaaccagattggtagacacttacttatattgttgccttttacatacatccgtgtatccttgtggggagtatactggtagggtaaatttctggaagtgaaattgctggatcaaagaatcaacacattttaaattgataggttcaaactatcctccagaaaagattatggcaatttatgtttccaaaaacagtgtgaaatatcttcttagagattattagtcttaaatatttgctagcccaagagttaattttgattaactcttgattttatattttcttagttatgacaggtttaacatttattttctatatggaaagcaatattattttgataagcaaatcaattttttaaactgtttgtttgtttgtttttttggagacagagtaagcttgcactccagcctggtgattgagcgagtctccagtctcaaaaaacgacccacaacacacaccacca

SEQ ID NO: 134878 - DNA, 225 bp, Homo sapiens
ttccgcttccaccccgaacacttcctggatgcccagggccactttgtgaagctggaggccttcctgcctttctcagcaggccgccgtgcatgcctcggggagcccctggcccgcatagagctcttcctcttcttcacctccctgctgcagcacttcagcttctcggtgcccaccggacagccccggcccagccactctcgtgtcgtcggctttctggtgacgcca

SEQ ID NO: 134879 - DNA, 928 bp, Homo sapiens
aacgttacttaatttcattgtgtgttttgatactttttaaaaacaactgggttggggcgagtaagtatttgtccaaaaaaattatgtatatagttttgcattatcagaggaatgaaagcttgtttttcaaagtctccacaaactggtgacttacagccttgttttgaccacgtaaagtacaccctctccttaataactttctcattctgatggatatcctccttatcaccacccttgttccaccagttgatgacttgcctttcactgctcttcattgtaaatcactgatttagaatatttctttttcctcctgtatactgagtcatcaatatttattagtccttgttgtaagagcgtatatttgtttgaaacagcagtttgaaagtgtttaaatatgtaaagtgtttattttatctgatgcactgatgttaagatccctgaaaaacagaacgtcttagcggatttttcttctcagtaatttttataaaatcagattattttagttgacaaagatgatgagtacattaaaatataccagtaacattaagcaataggtttgctctgtgtgtcagcacagggttatttaagttgtatgtcataccaggtgcattcacatacctaagaaatagtaccaccagcagtgtgtgatgtgaaagctcacaaagggcttaataaataacagtgcctatgtagtactatatatatagacctaaagattggccacgttaactctgtggcaaaacccattttatttcattttacaaagattttttgaggtctgcatgaaaagttgttctccatagcaatagcagttggtcattgttctcctctcattgtttagacatagcttttaaaattgaatatatttcttaaataatttatagatgtattcaacctcataaaactaatttttaaaattagcaccaaa

SEQ ID NO: 134880 - DNA, 240 bp, Homo sapiens
atctgcacacaagccaaggagagcggcccgggacaccttccccacagccctcagaaggagccaattactgcttgggagtctgaatgtagaatgaaagaaagagagagtagatgcgggagaggcctgaagctgcaccacggcgagagacacacagtcacgactaaatccgagggacagagaagagcgggagggtgccgttgtgacagaacttggagtatcggggttgtgatgtcgtgtcga

SEQ ID NO: 134881 - DNA, 120 bp, Homo sapiens
atgaccaaatttaggaggaaaggaattagacagaaggcaagatgactcaaaatctcttaaaggaataagcagaagtgcctgaagcaaagctaatgatcaaagaataggactagaaaggga

SEQ ID NO: 134882 - DNA, 362 bp, Homo sapiens
cagctggaaatcacccatttaggttacataggtctgaaaggttcatatctcataaatgaataacttcagattttaaaaaattacaaaaacaaatctggctatttcagaacaaggtcccctttaccatttataaatcttatcagtctttcttctcactctccaaaactgaattttcaagctaaagctagaattgtccccttcataaagcaaatacttgttaagtatagctgggggcgggggttgtttttgtttgtttgtttgtttgagacagggtctggccctgttgccaaggctggaggctggaggctggagtgcaatggtggagtcatagcacgctgcagcttcaacctcttgggcacaag

SEQ ID NO: 134883 - DNA, 203 bp, Homo sapiens
atccaatcaggataaaattacgcagtcatgtaagaaataatatctattaggctaatttaatcaccgaatactttacagatgaattagaatttagaatccaattatttcttacattcggactgtcagagctggtatctctaagcaggaggaggggggaaaagggcagtaggaaaaggaagattagggcaaaaaggaagatcagg

SEQ ID NO: 134884 - DNA, 326 bp, Homo sapiens
tattttagacagagctcaaggagccaggtatcttaccatatgtgctagtgaataaaatgaaaagaatacttctcttcatggaacatggagtgagcctgaggagtgagaagattaagcgaataattttacaatttccttcaagtagtttgagatggcgggtctagctcttattgcccaggctggagtagctcttattgcccaggtggagtagctcttattgcccaggctggagtagctcttattgcccaggctggagtagctcttattgcccaggctggagtagctcttattgcccaggtggagtagctcttattgcccaggctgga

SEQ ID NO: 134885 - DNA, 432 bp, Homo sapiens
ctcctgacctcaagtgatctgcccgcctcagccttccaaagtactgggattacaagtgtgtgccaccatgcctggccccaaggcttaactcttgattggaaaatatgatagagttgccagataaaatatatttaggatattttcacattaaaatgttatttattatttttctgaaattcaaattttactcgtcctcttgtatttttatattctatttgtttgctaaatctggaaacctaaaaagtggactcttttttctttaaccacacaaactaggactgtgaccaaagagagatactgaaaccagaacgttcttctgcaattgatattcacaactaactgactaaacattctggtcgaggatgagcagtgatttggtatctagtacagatgtgtatggtgtgatgccaaccagcccctggccagtctctg

SEQ ID NO: 134886 - DNA, 210 bp, Homo sapiens
aaaaactgttcatctgtgaacttttccagatgtgcaattttaaagctaatgtcacttgttttccaaattagaagctgttagcaaaatatgtcactatatcattctgctgcctagtttatgaattggaagacactgaaaagatactataaggttaccatgtccggtaaaaaattcagacgacattgaaagagagaagattccacttgacag

SEQ ID NO: 134887 - DNA, 921 bp, Homo sapiens
gggttttaggaccactcgaaaaacgagagtgtgctgcaagcatgaggcttctccctctcccatctcagccttggctgccatagctaaggaggagggtgttattttgcttttgtggacattcaccctgggaaataaggtatccgcccccaaatcggtgaacggcgccctgaaccccgcctctgttgcgtttgttgcgaccgtcccagtcgacttgctacttgtcggcagatcgcccattctctgaagagaccttggcaactgtggactattctgtgaccgcgcagtacgacgcaggactactccacagagaacacgttctaacaccgaagccgtgcggcgccactgatgtaccgacaccatcatcccatcaccagggcaggcaccatggcagaaatcccacaggctccccagacgaagggactcgccgcagcgcgtagagcaagccgggccttattgacacatacgatgagaccaatccacaggccatgcccgcgacaaagcaacgatacacatgcccgctcttgcaaccactacccacgatcctgcaccacggacctcacacgcaacaccatgccaaccactcctaaaccacctctcgccaccgcaccctcaacaccgacaccgccctcaccccacgccgacccagcaccacccccgccgacatgccggggcaacagagacccgacgacacctcccgcaccgctggacagcagtacaccgccccacgtgtgcccccaaccgacaccgccccccccattcgctggcgacgacccactgagtgccatcactcggcactacgaccagacaccgtgtgcaccacggcttgccacgcctgaaccaacacagcattggcaactcatacatcacactggcagaccccattcacgccgccttgccgcaccacacgcccccgctctctct

SEQ ID NO: 134888 - DNA, 222 bp, Homo sapiens
ctgaaaacattcagaaaatgtttgggggcctgagggaagatgagcaccatggttactgaagatgcacatacctggagaaggcacattcttgtgaccggttgccccaggtcacaggcatccaggcctaaggctgcccctccaaccaggaagtacctgtggagtgccagagtggagcctggatggctgtggaggagaagcccaggtgcacacattgcccagatg

SEQ ID NO: 134889 - DNA, 776 bp, Homo sapiens
gcaaaaatggaaaaagatgtaccatgcaaacactgtattagttcgttttcatgctactatgaagaaatacccaagactggataagttataaaggaaagaggtataattgactcacagttcagcatggctggggaggcctcaggaaacttataatcatggcggaagaggaagcaaatacgtccttcttcacatggcagcaggagagagaagtgccaagcgaagggggggaaggcccctcacaaaaccgtaagatctcatgagaactcatttgctatcatgagaacaccatggggaactgccgccatgatctaatcacctgccacgaggtccctcccccaacacatgggaattacaatttgaattacaattcaagatgagatttgggtgggaacacagagccaaaccatatcaaacaccaatcataagatattcagtgtgtctatagtaatctcaaagtaattatcttgataaggaataatatcaacattaaagaggtcttttaataaggatgaaaggattccacctaataacagattttcaaactacatgcattaaaactgacagaactaagggataaataaacaaatccaaaattatagatggaaattttaacatgccactatgagtaattgatgagacaagtagacaaatgcatgtaaatctaacaattaattccagagtacacactcttttcaataggacaggaaattcaccaaaatagtctatgttctgggctataaaacaagtctcaataaatttcaaaagactgaaatcat

SEQ ID NO: 134890 - DNA, 564 bp, Homo sapiens
tactggggaagtgtcttccccttgtttctcactctgcctcctcctctgtgttattatgggcttgaggggcaggggtagctattgctcatgacttttactacaagataaccagacttcctaagccctccatattgggaccaatttctgctgaatgccaggtgatgagaggtttcagcccctggcgtgggtggatgacgtcagaccagggcagcagaggactctcattccacaagctccctcaggactgagcacttgctccgggtctcctgaagccccatgtccatctccttgtctgccctgccagtctagcagacttgggctgagaaccagacctttgcccttggcccagcctcgccttccccactgggtctctagatttctagattccccatagggtatgccagcaaggagaggatatgagggcccaagaaaactcaggaaagtttctatcaccaagggcagaacacgaacatcttgaggctaaaggagctgcatggttgctaccaacaaaggagaccgacggtgtgcagttgattcccatgtttttactgcacttcaccccca

SEQ ID NO: 134891 - DNA, 164 bp, Homo sapiens
tctttgattaataatcttcacctttcaataatttctcaaacttaaagattctcatttgcttgcaagctgtgtaatattcataaatgaaattgtagaattctttcaatacccaatgctttttttttcaactctaatgatgactagctttgacatctttgtttttg

SEQ ID NO: 134892 - DNA, 255 bp, Homo sapiens
caggtaaaaggaacagcttgaacaaaggtacgtagtgaaacggcaagtggtcttgagtggtggggacacagtcatccttgaggaagtaccaggaaaaagaatgataaagagaggccagtttgtgaaaaacacccaaaaccaaggctaggagtctggtcttgaaccaggaatgaaatccttagacctgtgctgtccagttggtagccaccaggtacatgtcagccactcagcactggaaatgtggctagtctaaat

SEQ ID NO: 134893 - DNA, 436 bp, Homo sapiens
ccacactggcttctcttcctcctcctcccactgaagccaggcctccgcctggaactagacaccctcacctccttcctcttcagggacctcactccatcaatcacccctgtatcctgcatccccagcttctctgttgaataattcttcttagcatgtcccattctctcctatctttaacacatccctcttctccctcagccactcctgtcttccccctgcagtcccaggcttcttccaggagtcatcacacacttctctactcctcagttgactttccctccttacctgctcctgccttgcccatgaaaggctgaaaacctccatgtcaccagcactaatcctcggtctccagcttccttgaggctcagtggcatctgaccaagctgtccccaccatgcctggatggtcttcccttggcttccagggtggcacatga

SEQ ID NO: 134894 - DNA, 481 bp, Homo sapiens
aaatgtgttgccagtctcagaggaaactgtaaaataagtggagttttcgttgtcctggctttcttttctgcttctttttattgatttttaaattagcctaccccaatatcttccagggaatttttaaaaagttatctttctctctttcttgaggttcctcatatactctcactcacacgcacattttcacgagagcgaagtctacctttaactgaaatgaatgactgctgaatggtcaggaactccaagtccacatggaattcttgctcttcggtcccagactctcccttctgtgtcccccttaggcaggtgagcattctgtagtttgtagccacagctccacctggtttgggttttcttcctgtcattgccttattccagttaatcattacctagactagttgctaagctgaaaattcatgttgtggaatttcatattggataacatagttacttttcttgttttttaaacaatgctttc

SEQ ID NO: 134895 - DNA, 215 bp, Homo sapiens
accaagtcgtatactcttagttttagtgtcttcttatgaaataagggagcaataataccaaccccacagggatattttggagaccaggtgaaataaggtagtagaaatcatgtgtccactagaatgctaagcatacggtaagtcttctgcacatgttttctggtggtatgttgtgtataaaagaggattacaggattatacttggtgtgttataa

SEQ ID NO: 134896 - DNA, 197 bp, Homo sapiens
tgagactgacttgccctgaggtttgtgtgagcgaaatcgggtcttatgcaacagtgagtgcgtgcatctccgcttcgagctgttacatcagaaagctaaacacagagagcccttgcaactggagaactagcaggaggccctcgctctggttctttgtcagcgggtgggacggggtaggatgtggcttacaggcagct

SEQ ID NO: 134897 - DNA, 403 bp, Homo sapiens
tctagaggatcccggcgtctccttagtctaacaaaggtgatttttagcaacactatttagactagcaaatagtgggaacagcctacttaccaacaattggggaatggttaggcaagtcatggtacatttgactcactgcaattttatatagacattaaaaatgaaaaatacaaagaaaatgtactgatacaaaatactcatataaaagtgtttataaaatatgtggaaaatatagttctgagttgttcatacgattgattacaaacgtgttatatacaattgattacaaattactgtgaactcagatgaataaacgtagagatgcagataactgtggagccagtgtgatgagggttttatgcatttttctctaaagtttgtctgtttacattaagccagaggg

SEQ ID NO: 134898 - DNA, 262 bp, Homo sapiens
tctagaggatcccggcgtctccttagtctaacaaaggtgatttttagcaacactatttagactagcaaatagtgggaacagcctacttaccaacaattggggaatggttaggcaagtcatggtacatttgactcactgcaattttatatagacattaaaaatgaaaaatacaaagaacacatgcttcaaaaggcaaaaagcagaactaaaaatggtctaacaaagatcacatgcttctgagggaacaagacaaagggaaaca

SEQ ID NO: 134899 - DNA, 729 bp, Homo sapiens
gagaaggtgaggccgagactgagaaaggtaagagcataagcctcaaagacttctgggaaaggggcacaccagaaccaattgaggcagagagccctgcggtaaggtgatgctggaatggtcaagggtcaagagcccactggggctggagcagcgtgccagaggagagccagtgggcagcagagtcagagaggacaggtgccagactacgaaggctagggacctgccagaactcaggctaactgtgatgttgagcacaggagtggcaggttctgacttggccttctcgaagggatcctctggccactgtgttagaaaggaagggtgggttggggacaccagtgaggagtgactgcagctgtccaggtgagaagcactggctccatgagatgagaagtccaaacaaaaaatgaagcagcctgaccatctcagaaactctgacacccctgcgtgactcatgtatctcatctacacaagttccctgatttgaagatacacgtttctcctactttcacaatttctataattgtgacatgtcttcgaattgctgccaaaactgaaaattgctgtttcaggatctggcagtggattacctacgtgtgtttattttgcagaaatacactgagttgtacttttacgatctgtgcacatagctgtatgtgttgtatttccacacacatgtaaggacaccggggcctaggaaggcagccagttgccaggcagcggactccg

SEQ ID NO: 134900 - DNA, 375 bp, Homo sapiens
ttgacccggccactctagtcatgtgcatatccacataaagtatagaattggctgttaatttctacagaaaagcctgatgtaatatgctatatcaatcatatttctaagaaaatccctcacttcctccaatttgatagccttaacctcattcctttaattttcagtttttcacttctagtcttctgagagttagcctaatgaataattttcatcttattctagttactccttgattttccaatgccatgattaaatcagctcaacttcattcccagagtcagactgttccgagcacatgccttttttgtttgtttgatcgttctgagatcgagtctccctctgtcgcccagactggaggatcgcttgagcacaatc

SEQ ID NO: 134901 - DNA, 781 bp, Homo sapiens
accattacagattgtgttgatgctggattgaaagtaaaattaaatgttcagaaaacctaaagtaacatagtgccatacaaggacatgtctaaacaacaaactagcaaaaccatattgatggcatgtattagtatctgaatatccctatcatgtgagtagaaatagtctaaacttatagactcaaggaaattttaaatttaaaatagtccctttttgaaggcatagtataaaacctactttggcagcccctaaggcgaagataagtggaaaggaaaaatcaaaccataccacactgggaggagattattattatcgaacacaagaaaagaaagagatatatcctctctatgtgcttggaattgttccactgaatctttcaatttgttaatacatttaaatcaagaattttcatatttttttctggagaattataataaatattttaatagttcaaatgtttcaggctttcaaatataaatcagatagttagaaataaaaggaaaatagacaaggaaaaagtcttcctccatggtggtttactaaaacatcagtgataaaattgcagtgttattacagatagcaacagtctttaagagataaaattatgctgagataaattgtagcacttttgctgataagaatcatgcaacagagaggaagattaaagatgcaggagaatatctaaaggaatatccttaagtaagtaagtgaagatcaaagagaaggaatttgtcttatgaacagtgagggttcattgatactagaaagaagtaagagttgt

SEQ ID NO: 134902 - DNA, 755 bp, Homo sapiens
acagactcaggtgggcgggaacttcaaggtcaaatccccgagccctcggagggggactcaggaaatcagttgctcagtggggggcagagtttggagccttggggcaggagccgtgtccagcagaggggctgctgcccgccatggctggccttgccattggctttggccccggccccggggaagtgcaaggcgcaggagagacaccacaaggcccttgggtgtccttcctgcaccttccttcggtggcaggcgggtgacgcatctatgtcactgcatccacgtaagatgctctgttagaaaaaaaacaagaaggaggccgggcgtggtggctcacgcctgtaatcccagcactgtgggaggccgaggctggcggatcacaaggtcaggagattgagaccatctggctaacacggagaaaccccgtctctactaaaaatacaaaccaaaaaaaaattagcagggcatggtggcgggtgcctgcagtcccagctactcaggaggctgaggcaggagaatggtgtgaacccgggaggcggagcttgtagtgagccgagatcgtgccactgcactccagcctggatgacagagcaagactccgtctcaaaaaaaaaattatgaatccaaattagatatgaaaataaatatttgaagtgataaaaaaacacacaaagctcacacatgaaaaagctgataggtgcactaaacgtcatcaaatggaagcaaaaaacaagatttgattagttactccctggcac

SEQ ID NO: 134903 - DNA, 724 bp, Homo sapiens
gatattttcatatggcagaatttttcaagattattcttgttttgtttcagtacctagtatgagccgggtacttcagtaagtaagtagttcagcatgagttcaggaagtagctcagtaagtaaggggtaaagcaaagttcagattatgaagaccttaagctggttctggcctgagggtctttgtacacattatctggaacactctgtcagacatattactgacttccttcagattttacatcaaatgtcatctgagttctcttaactcctcctaaaataatccgaccctttcgtgcattttcccggttaccctgccatagcgatcccatttgttttataacagttgttttgaaatttcctttatcatttgggctgtttcccatgggatccttacctccacacttcccacctactgctgcccccttgtcaaaaaagactacaagttgagtaaggatcaggaccttgtattattcagcagtatatcctggagcctacctggctaataatagaaagcactcaataaaatattgaattaccaaacatgttaataccctttgacttggcagtgccaattgtgagcatttctcctggggaaataaaatggacaaactgcaatgccaacaacatggaattagctgtaaatttttaaatatccataaaagtgaatactataacataattatatagatgaatatttattagccaagatacacttttgttctgct

SEQ ID NO: 134904 - DNA, 264 bp, Homo sapiens
ggtcaattgatcctgatgctcacgggctcagactgggcttcagagtcctctcaacgccgcactccaggtagcccagccacttgcttagaggtggagcctggatcagatccacttgctctccccgccttctgggactgatgctcagaccaggcctcagcccgcgcagtcctctctgctctggggcagtggagagtgggggctgctgtggctaagccagagcggcctggaagccttctctccagggcctcacacggtgccatccat

SEQ ID NO: 134905 - DNA, 133 bp, Homo sapiens
gaggggcgttgtgtgagtatcatcttcatgagggctggtgggggaacatcagctttaaggtgcctgggatctaaggcatggaacccagcagtgcagaggaacgtaggggatgtagcctcgggagcagagatgt

SEQ ID NO: 134906 - DNA, 275 bp, Homo sapiens
cgaaattacaagtgccctagttagagccagtgtgccacagcctgggggagctcatcctgagcagaggaagctgtacctgcagcccagtctcaggccagcttcagatatggttcagaagctgttagaagatcacagcctgagaacctctgttctctttaatcctgaaaaatgaaaatctgagcagttcaggctttggccaggtttcctctgttatccaggaagatgccacatctgacggcccataggagtatggagttatgtcgatggtagaattg

SEQ ID NO: 134907 - DNA, 474 bp, Homo sapiens
gggtttcaccatgttggtaaggatggtcttgatctcctgaccttgtgatctgaccaccttggcctcccaaaatgctggaattacaggtgtgagccaccacgcccggcctgggagctttatttttaagtaaacacttatgtacctactatgtgctagtcactgttatggcattttaataacattaaccccttcagttctcagaacagcccccctgaagttggtggtattattattattgttgttattattattttgcaagtaaggaaatttggtcagggaaaggtttggtgcagtggggccaggattccaatgcaggcaactgtagtgtacggtgccgcatctcttagtctcctgagaatagctgctatttcagtgtttctctgaagataaatgaggcaatctgtgtggacactacataatacctatgcaatacaggttagctagtgctttctctttatttctttctaaaaaaaa

SEQ ID NO: 134908 - DNA, 703 bp, Homo sapiens
agtgtatgtgagaacacaattgcattgggagaacatcgtttttgtctcaaaaggaagattataaactttaattagatgtttggggatctttaaagtgctttaagtcaccaaagttatgtatcaactttaaaaaatcaaccaagggaatactcacattgtcacttaagtcctcaagtcaaactttttcaccttgaatctgtaatttaagaagattcaaagttagacatattggatgttatttctgttctgtttgatacaacaggaaaaggaaaatgaatttatgttgattgattttcaaagagattagttctatggatatgctctaagaaaaacatggaatttttaaaaacacattattgtcaataataaaaacattgttaactaataaacaaggcattttctaatctcctccataaggtgacagctgcttttgtagccaaggcagtgaaattaaacctggaatataatgctactctacacattggggggcggggaaagaagcataaactggatcaaatgatgttttacacttcagacaatatggaataaaaataattgaagtcattttttttctaactattgcaacttacagaaatctgtgcccttaaaaagcagaatgcactgtagattttgaatcaccatttaccaaacagttgattttgccattataataaacccttttaaggagctttaattctaggtt

SEQ ID NO: 134909 - DNA, 717 bp, Homo sapiens
ggtgttaaaattggtgtttcacacgtatctatcatgtggaaggttttatagtggaaattatagtacacattccttgatactgaaaaataaaaactgaaaatattttgtgttatactatttaatagttttggacacattttaataaaattctaaacaaaggatagttacaattgtggaactcttcaaattctgaaaatcttatctgattaagaattagatatgaaatcatgtcatctcctgcttcaatcctttggcttactgtgcctacaggataaagtctgaatgccttcatggaacgtacatggccatcagggatttggttccttcctgcctctccagactcatttctcaacacactctgccttgaacttttttctttctgtggcactgaactggagtttttgtatagctatcacattctttcttaccttggtagctgtttttctatctcaagtcctttctgccttttttgtaagttcgtttctctgctggactcttaatacaattttaattctgaaactccattctaatccaagctaggatagtttcccctttctcctgttttccttgtagcttgtgtaaacctattttgttgccttaatcacattattatagtatttccctgtttgtcacttttttgagtcccttggcagcagataaaagcaccagtagtttcctaatttgtaaagagcatctcaaagaaatatggagagagag

SEQ ID NO: 134910 - DNA, 192 bp, Homo sapiens
tctttgaaatatcatgcacattttacacctgcaatccatcacaatttagaccagccacatttcaaatgctcagcagccacatgtgcttagtgactactctgtcaacaggcagatctaccctctatgttctaataacttgtctctaattctcagtccctctctcaattatatggtctctctgctccccagcag

SEQ ID NO: 134911 - DNA, 218 bp, Homo sapiens
tgcaagagatgggaacaggtaccagcactttgcgtccattcccagggctatgtgggaccatttccaacacaggggtcatcacctcaattgagtccctggtagaaagagtgctatgccagactcagcttcccttctggcatggttaccacctgctccctccaacacagcctcaccttgctaagaaaatgcagcccagggagagaggaagaacacataaa

SEQ ID NO: 134912 - DNA, 378 bp, Homo sapiens
ctggcagaagagctactccagccttgtgtcataagagctactcaagcctgggccataatgatgctactccagcctgggtcatatggagctcaaaagaaaccaaaatgtaagctacatatgtaatttaaatttttccggtagccattttaagggattttttttttttgtaacagggtcttactctgtcactgaagctagagtgcagtggcatgatcacagatcactgcagccttgacctcccaggctcaagcgatcctcccacctcggcctcccaagtagcaaggactacagatgtgcaccaccatgcccagctaatttttattttattttttgtagagatgaggtctcttgctctgttgtccaggctggtctcaaacg

SEQ ID NO: 134913 - DNA, 395 bp, Homo sapiens
agtccgttcgactgagcctcccacagtgctgggattacaggcgtgagccaccgtgcccagccccattaccaagttgtaagcattgctaggcacctgctgtccaaggcagattcagggacgcagtgtctgtggtctctgggatgggaataccacattccagtgccctctgaacactccttagaagagtgaaagattggaaatgacccaaggagccaacaggcagaccagggttagtcaaagttaccgcttcgtgaccacccccttgacgccctttaatttcattactgctctttgaagtaagtactgttatcaccccgtcttaacagctgaagaaactgaggcttagagaaacgaagtcacttgcccaggggcatacagctcagtcgaacggactg

SEQ ID NO: 134914 - DNA, 269 bp, Homo sapiens
ctggagagaaatgcaggtgagtaacatgaggctgtcacacgatggtcccttggagttacacttagccgccagggtcaggagagaaaaccaagtggtgcagtggcttccattttccctggtgtgtctggggccagcagcacacacactgccctcagctttagaccctttgaatgagggggccttttggggattcagccattagttcagcaaatactgttggcatgctctacccaagaaggtgctcagacagggcgaggtcagctggcagg

SEQ ID NO: 134915 - DNA, 332 bp, Homo sapiens
ttgtatctagtcttggatttttttcaccatagtatccccagctttggttatggtgagttgctttcttcattgaaattcttttgcacctttttcaaaaatcaaatagccatattttttgtgactgtatttctggattctccattatattctcttgatttgtgtgcctgtttcttcatcagtaccacactgtcttgattattaatagctttatagtaaatcttaaaatcaggcagtgtgattcttccaacctcattcttttccaaaattgttttagctagtctggttccttgacccttccatgtaaattgtagcatcagctcatctgtatccac

SEQ ID NO: 134916 - DNA, 415 bp, Homo sapiens
tgggccctggaaaatatatacttatcttatatgtgcttcaaaagggcacacccagaagcagctctgaaaatggagatggtcatggttgcacaacagtgtgaatgtacctcgtgccactaaactctaaaaatgactaacatagcaaacattgttatatacatttttcccacaataaaaattaaattaacaaaaataagagatacgcccctacactctgctacatatgttaagtgttttgttcacagaaaaggtctggagggatataggccatagatcagataagacattctgtatggcttttattttcttctttgtgtctgtctacttgtgtctacttgtattttctaattttctcatagtgcacatgtgttgtttttagattttttttttttttttgagacagggtcttactctg

SEQ ID NO: 134917 - DNA, 497 bp, Homo sapiens
acacagatttaccagaaaaggcagcttcagttgaacacagcggtttctttaaatcacacagcagtttccttcccaagagaagcagggaccgtgtaccaagattccgcccgttaccctgagtgcagcaccggcctctcctgaagccgtctttgatttgaggtcccagaaatgtgaccgataataggaatcaggagcgtatgagagttcacaaggggaaaaaaaaaaggtgatttataaattattatttgtttcacataaaaagtggtagtacggcagctttattcattctgcggtgaggccacttagagacagtgggaactcggaggggccacggaagaggcgggaatgagcagcagttgcgaccctgcttgcagtgcaaaggcacgtggggcggcagcagtgacggaggaacgagagacaccagaacggaatcttgttcagagaaatccagacagcaactcctccgacatcagccctgagtccttcctgaactcaga

SEQ ID NO: 134918 - DNA, 297 bp, Homo sapiens
ggttgtaggactgaggtccccatttccttgctgactgttgtaccctcaacgcctggaggcctttttctggtcctggcaagtggtcacctccaccttcaaagccagtgtggcacattgaatttttctcatgcttcagaactgtcttgacttcttctgcaactagctggagaaagctcctggcgtctgagggctcctgtgatgggatcaggcctgaataacctccccatcttcaggtcagctgtgtcatattaacgtgatgcagtcacagaggtgacagctcatcatattcacagcttt

SEQ ID NO: 134919 - DNA, 102 bp, Homo sapiens
ctcatctctccagttcatcccttgcttctaccagtctgtccttgctatggtaaaacgggcatttgagaaaggcaattacacggttacccctcccctgctcag

SEQ ID NO: 134920 - DNA, 515 bp, Homo sapiens
gtcactttaccagggtatctcacaaccaacctacaattcagcatgcagacttagcccactctttgatggcaccattttaaaaggtggcttccattgacttcagaggagaaattacacatgccttttctactcagagtcagttggcagaacacatcacattgagccaactaattgcaaaagtgcttggaagagtaacttctttttactcaataaagagagatttgaccatgagtgtgcacagaaatagtttgcatagcacttgcctgtattcatattatatttccttagtctaaacattctctcatgacaagtattctatactttcttctttctcctcaactatctgacaaatacttcttaattcttactttcaactatgtttttctttctacagaacataggatcaacttaaaaactccacaaaagcccacagtcacatctccatttatgtgtgcttgtataaataattaccttcatatttgttgccataattgaaacttttattcttgtatata

SEQ ID NO: 134921 - DNA, 748 bp, Homo sapiens
ggctatgtgatgtgcttctaataacaatgtctgatggattatcttggattctaaccaatcagattagctctttctcctcccttggtggtatctagaagagcatgagcattcttcctcttacaatggcaattatagacttggggacttaaggagtctaaaaggacctcccaagatgaatctattcttattatttatcagattgatatatatctgactttgataagaagctgaagacatgttgtttaaagaatggacaatccattctttcctttgcttatgtttggttttttaagttctaagtctgcaggcatggtgatatacagatatgatgatgattatatggttaaaacaaaacctaaaacaaaatcccctatatcctcacctgtattcagatgtggagcatgatcttacttccaagttgaaggaaaaaaaaaaatcacaaaagagtatgggattgagaaagaattttgtttctagctgctctctccagcctgtttatattatgatgtctattgtgaggctgccaatgttgtcaccaagagtcacgttctattagttaaattataaggtgcagaatgagaaagcttttgaaaactatgatcaatgttgaattccttataaacaaccaacttttggcctcccctttattacttccaagtgagagtgcattaaaaatatgttaatatctagctgcaaactcaggagtaattgcccagccagacttttgagattaattataagtccagag

SEQ ID NO: 134922 - DNA, 665 bp, Homo sapiens
tattcttagcctgaaaataactgcatggctgcaaataacctggttgtagctgctatgaacagatgttggatgagagctggaaagagccaatggactattcattttttcttttaagtctatactaaaactgagaacagcatccattttggaatagttgttataccatacttgagttttataatcttgctttttttgtgtaggaacttgaggtgtttttaacaatttttttaatcaacaattttttttttcaggtctgggttcaaattttaattgatgaatgttaattcttatgaatgatgctaatgtttttcataaatattttgccttctgtacagttcagaattggaagacatccatcctgatggagtctgttatggtagaggtaggaagttacagtgagtgagccagagaattgcatcaggtgacatcgcttatatttggaaaaatactcattttatacttatcccagtgagtgcaatgttatttttcagtgtttgggaagaacttatttgaagttaatcttaaaacttaaatttttcatattgtttattggtgacacattctaggttttatcaagcacattgcttaaatttatgatatgtaattttgcttttaggtacatcaaaagtgtaaaaattgaataaaagagtcattccccaaataaa

SEQ ID NO: 134923 - DNA, 933 bp, Homo sapiens
tgcaggtcatctggaattctttccgggtctcaggctcgtgaggtgctcattgtgtatgtgtcatgggagctggagaatggctgtaggtgcaaatggacttggaaaagaacaatgtcaaagtcgtaagtccagcctggggcatggcaggtttatgtatgtgtgagtggcgggaggggctgtagatttgaactccctgaaagaagatatgtgtaattcttaccaaagagtaaatgcatatgtttatgaaagaaagttcattgctatcatctggctctccaaggcacctgtgaccccaaaagattaagaacatctctcataagatattatcatccgttctacaaacctttcataaaaatgacctcaaacttgagctcctttttaattcagacaaactaggccataagccctgttgaggaaagaaccgtatctgtatggagagtcactgttacatcccaaggacacagcctggtacctgacacacagctggcattgagtacgtacaatgtgtgcctgatataaggcagctctgttctcccaataaggagggctgctaaaaaaaaattaaaaagcttattttcatatgtaaactttgtaggataatgttgaatagattattttagcgatacattttcaatcacatgctaataacaatacattaacttaaatactgctttcccccaactctcccagtttaggaaacattgtaactgttcactcccatctctgacatcagtgtccttcttgtcaccagaaccctttctgcatcagctcttcatgttctgtgggcatcatagtccctgtggtctaaagagagttagctgtttcaaattgatccaaaaggagaattgcttgaacccgggaggcaaaggttgcagtgagccgagatcacaccagtgcattccagcctgggggacagagaaagtctccgtctca

SEQ ID NO: 134924 - DNA, 400 bp, Homo sapiens
tactttcacagggaggaaacactttgttaatcccagagtagtttaggagatttcaaagtttactttaaaaatctttaatatctataccctgatggatactgggaagatgtcacaaagtttgtgagaaccattttatgaagagttaggaggtatctaatataaacatctttttataaaaatctatcagacaaatagacttttagctgtgcacttgaaatacacacttttctcaaatgactattctggtttgattactatgcttatcttaccaacatgggacatttggaagaaaggagaggaagtatcataatttagaaaggcagttacaggagtggctgaatgaactcaagactagaggctgcagatcccaagttcaaatattgcctgtgatgtgaagtaa

SEQ ID NO: 134925 - DNA, 708 bp, Homo sapiens
atatgtagtagtagtagatcagcttctcactttttttctgaatttgttcttgatagatcttatccagtctaaggttattaaaaaccctaatggaccttccatttattcatcattccttattatgtattgactccatatcagacactgtgctaggcacatggggatacaaaactaaggaatgtccttgcagaacttacaatctaatttgttggctttctaacagtcttaccagattcttcttcccttcttgcctatttctttccacatcactgtcttctccctttcctctcatctgcgctatctttttccatgatgctgacttcagtcctggttaaagacctaacaggacaaccccaggcctgactttcctgaccatagcccttgagggagtgatgaagcctgggaaatagtacagggagagacacagcaagggaaaaaatgaaacccattgggagttctgtctccccataaggaaagagagtctgtcctttatggagataggcagtcctgttgggaacatttaggtcacctactatgcttggaaaatactcagggtgtcatgtgctttcccttcacttatgtcttacataaagaagaaacgatatacatggatccaaagctttctcaagcaagatacgtactgtcagtagaaagagtaaagctgaaggcaaatatccctaaattgtcataaccaaagatggaaaaatt

SEQ ID NO: 134926 - DNA, 394 bp, Homo sapiens
tgtttatcgatgccaccactctcttgattcctaattttattcagaggtccaagagagtggtggttatgatttcagtcttttgttctgccagacactgattatgacagttcacccgaatctggaaagcaagaatgcactcttctgctggtctctggcctttagccttttcctttgtcctccatgaatatatgaggccaacaggagggatctaggctcagtatgataggctcaataatggcttactgagatgtcaggttctaatccctggaagctgtaaatgtcaccttctaaggaaaatggctctttgcggatgtggattaagcaaataattatacatgggaagatcatcttggattacctgcatgggccctaaatgcaatcacatgtgccttat

SEQ ID NO: 134927 - DNA, 364 bp, Homo sapiens
cttacacgcttagggtggtaattggggtgggggtgagtagagctcttcctttgtatttagcttaataggtgtgattaattttacgtatttttgcttgtctgtttgcttcacattttgataggacagataacatctcccagctatttgtgtaaggtgcagggcattagtatactttaagattgagagttttaattttaaaaacagtaataataaatgcaggtagactagctgtgcttttgatgcaatgatactgactctttgaagccaagagttttgcgataatggattcaatgtggaacagagcaagccgaaagttagctttctcaggcaagagaaactgcagataaattaaccaagaactttc

SEQ ID NO: 134928 - DNA, 453 bp, Homo sapiens
aaaaaaaatctctttacttgatccatttcacaaaagaatttccaagtgttgctcttgaggtacagatgagttaagaatgctgatatatggctgggcgtggtggctcacacctacaatcccagcactttggaaggccgaagaaggcagatcacgaggtaaagagatcaagacaatcctggccaacacggtgaaaccctgtctctactaaaaacacaaaaattagctgggcatggtggcgtgcacccgtagtcccacctactcagaaggatgaggcaggagaatagcttgaacctgggaggcagaggttgcaagattcttctgtctcagcttcccgagtagctgggattacaggcatgcactgccacgcccagctaattttgtatttttagtagagatagggtttctccatgctggtcaggctggtctcaaacttccaacctcaggtgatccacc

SEQ ID NO: 134929 - DNA, 426 bp, Homo sapiens
ccagggcctttatatcacaacctgttgccaagagagtcaaaagaaatccctgagtaattacctctgaaaagttacaggtacctttgcaaataaaccacctctgaatttggccatttttgaatttcaggttctggtgaactggtgctttttatgtcatttgtatttggaatgcttatcaataacctcacacaatggcaaaaacacttgaaatctttcttaagagttaacaatcacagtagaaccccaattcagaaggaaacttggagggccggaatattatttctccaagtactaaccaggcccaactctgcttagcttctgagatcagaggagatcggttgcattcagagtggtatggacacagaccagaatattatttctaaagcaaaaaatatgtgctttatactggaactttttcaaatgttg

SEQ ID NO: 134930 - DNA, 386 bp, Homo sapiens
tgagaatctatctctagtgatatgcctttctcactggtctttcagtatgattacccctaaaccaccaaaactgctgcctgagctggtggcaagactttaacctttcgggcattcaacacttgttagaagaaaagcttgatgtaatgcaaatcgtataaactctaaaaccaggcagacttgaaattccaccctaacccattaattttgagaatttacacaatagctaatctttattttctcatctatatgaaaatccacatcaaaaggctgttatgaggtctaaatgaacatataaacaggagggcaccattcacagctcccaaccgagagtaggcattctactcactggttgctcagttatgtgaaaataaagtatggagattctg

SEQ ID NO: 134931 - DNA, 339 bp, Homo sapiens
aagagtcatcaccactccctggtctcaagtacccagggacacaaacactgcggaaggccgcagggtcctctgcctaggaaaaccagagacctttgttcacttgtttatctgctgaccttccctccgctattgtcctgtgaccctgccaaatccccctctgcgagaaacacccaagaatgatcaataaaaaaataaataaataaataaataaataaataaaaaagttcaaggaaagactaaacctttatctcattctacctctcctcaccaaccttcaaaaataaagctcccagctgggcgcagtggctcacaccttgtaaccccagcactttggaaggc

SEQ ID NO: 134932 - DNA, 829 bp, Homo sapiens
gtccccaagggctttggaactgcgggattgggacacgtgacttccctggtcattcaccttgaagtggacacgggctggggtgagagaggggaaactgccccatcttctcatcttagaaccatgcagcgttaatgctggaagggaccttggagtcgattccaaccccgtgaactgggccagggaaggaagtgccttgcccaaggtcatgagagggcatttcatcatgttgcccaggctgatctcaaactcctgggcttgtgtccgaaactggtgagtgcttggtctcactgacttcaagaaggaagccgcggaccctcgcagtgagtgttacagctcttaaggtggtgcatctggagtttgttccttctgatgttcagatgtgttcgcagtttcttccttctggtgggttcgtggtctcgctggctgaggagtgaagctgcagaccttcgcggtgagtgttatagctcttaaggcagcgcggccggagttgttcattcctcccggtgggctcgtggtcttagtggcttcaggagtgaagctgcagaccttcgtggtgagtgttacagctcataaaagcagtgtggacccaaaaagcgagcagtagcaagatttatcgcaaacagcaaaagaacaaagctgccatattgtggatggggacctgtgcccgttgccactgctggctcgggcagcctgcttttattctcttatctggccccacccacatcctgctgattggtagagccgagtggtctgttttgacagggcgctgattggtgcgtttacaatccctgagctagacacaaaggttctccacgtccccactagatta

SEQ ID NO: 134933 - DNA, 187 bp, Homo sapiens
tgttaaacatttactagtacaccattgcatccaggcattccaaggtgtactcagtttcacctcttacccagccttgaacctgaccactatttcctattgcagttgctgccaccttagttcagactcacagttccccacttgtgttactgcagcagcctctagactggactccctgcccttgacctta

SEQ ID NO: 134934 - DNA, 300 bp, Homo sapiens
aaagcatttcctagtaaagtgaaaagaatgtacacagtcttagcctccagctgggtagcaaatttcagaatacttcctgaacaaaggctagtaagcatgaggtgtgtcatgtttgatcattaggtagttcagctggaaaaaagataacatgcaccaagacagcaagggctgtcagatattccgtgcagtgcttgcagaaatggggttcttttatttgccttctcagattctcacctgaacttccttcagttatccacagaatgacctcagggacgcccagctggattttatctcatctct

SEQ ID NO: 134935 - DNA, 622 bp, Homo sapiens
ggggaagggtctgctttcaggatcactcatgggttgctggtgggatttagctccctgcaggtgcttggattgagggcctcagttcttaagggggctgttggctgaggctgtcctcagaggtttcttgacatatgggtctctccagagggcagctaacaatagggcagctggcttcataagaagaaatgatggaagagagccagagagagtgtaggcgagacaggtcacagtgctttgtaacctaatcttggaagtgatatcccatcacatttgctaaattctattctttttttttttttttgacgcagtctcagtttacggaaaccttggcctccggggtccaggggattctcaaggcctcaagcctccgggagtaacgcgggaattacggggcaacccggccaaccaaggcccgagttaagttacaggaataagacgagtgagagcacggagaattcgcgcgacaaattgcgcgagggcaggacactgtgacagctgaagcgcagacgaatgggtgcacacaggacatgcacacagccccgtgggaaaaggcgctgggacccattagcgcagtgaagccaaagtgacacacaacctgggaacacaatccaacaataaatcg

SEQ ID NO: 134936 - DNA, 831 bp, Homo sapiens
cgcaggttgcgtggccagcgctgactcagatgcatgccgcccagcgcttggtccctgatttggccatggcctgcagtgtgggctggctggcagccaggcaggagggagggccccctgtgtgcctggcctcacacaccagcagccggatgttggccaacacatgtcttagctcctcctttggccaggagaggaagttcactgggaccgagtcggaggggtgaacccagatgactgtgctgggccctgggccatccccagttggatgtgtgtgccctgaccccctgcagtcccaatgcccaggtggcctcccctactcagacgcccatgctggccgcccccaacctccctgcccaccaactcccaggcttattcaccaaccactccaccagctctgaccctgacttctggggttcccatctcagtcctcagcctgtgctgctgccccctgaagagcatccttccaggcccccgtcggctggccggggcttagctctaaggttactccagaggccgtcctgaccagtctgatgccgcccctccctgatcactgtcttggccccattacaatttatgctctggtgccttgggatggagtcactgtccatgttgccagagacagtgcggccaggtggactctcccctggagctggagtctgagtccagcccaagtccagggcaggcactccgagaatgagtgttctgcctgctgggtctcctgagggccaaggggctctgctggagctgggggcatggcttggcacccgcatccctgtctgtgcttctcctacttaaggatcctttgtctgacctggctctcctaccagatgccat

SEQ ID NO: 134937 - DNA, 168 bp, Homo sapiens
tacacatcaaagtatgtgctcagcgaggaaagcaagtcacctaccagggccaagttcccacggcagcctagcagtgaggggacccaggtgtggagtggagacttgatgggctgcttggaagtgagtgacagttcagatgcccctgagaccacccagaaatcaagcgca

SEQ ID NO: 134938 - DNA, 457 bp, Homo sapiens
aatagtcaaatgtcaaaggtgacatttggaaataaggcatagatatacaacttggtttctgtaacttatattgttctttagtcttgatttaaagtgcaggaacaaagatgtttaaataaaaaccactgatgacgtattattgtggtgaagggtatactgctcattaagctgatacatgtatacttggtggttctcctttagaggcaccaaataaacataatgtaccctaaagaaaaatgtgagcagttaaaattttaagtgaggtgaatcttgttttttccctaataaaattaaaacaaaaaacaaaccgagacaggtttcaccattgttgcccatgctggtttcaaattcctggactcaagcaatccacctgcctcaggtgatccacccaaagtgctgcgattacagacgtgagccactgcacccagtctacttcatcttaacatctagccacctc

SEQ ID NO: 134939 - DNA, 844 bp, Homo sapiens
gctcccctcagaggaggaagagaccggaaggtcgttttagggggcacttcctgggacatgggccaagcctcctaaggagtgagggctccaaccagcaggtacagacctctcagaagtcagggataaggcggccattctgaacctggatctccaccaccccttgtcccatctcatcaagacagttctgaggggctattctggcacatgtctggacgttagaggctggaggacaatgtgggctttgatgggattcagataaggtctgttccagggaggcaggaggttgatgctcagcatctgggatggtgtccttgtggacagtgagttgcctctttgggtacaagtccattttcactacagaagagactagagcaggggtgtccaatcttttgactttcctgggctacattggaagaattgtcttggtccacacattaaatacactaacactagtgatagttgatgagcttaaaaaaaaaaagcaaaaaataatcttataatgttttaagaaagtttacaaatttgtgttgagctgtgcactgacaagcttgggctggagagtctgaacggctccccgatcccctctctgattctctttggcagcaaggccttgaaggggctgagtctcagtgtcttgggggaattctggaaagcctgtttgggaacctgagaagacctcttgcctggagcttgaatgcttgatttgctgtcctggccacatgcatgcttggcagccagagagcggggtttgcattcacaccagcacaacagtgagccaggggttgaagtgaccaggacaagtgtctgggtggcagtgtgcctcagtttttaacaaaaaagttta

SEQ ID NO: 134940 - DNA, 360 bp, Homo sapiens
agcagaggggagagtttttaactaatgtacaaaagtttacatggcatatatttaagaaatatagtacatcatgagagtaatataggatattactacataaaacattattcttaggtaggttggtgccacattgcagagaacatttaatgttttggactttattttagggaaaaattagagtgaaaagttattgcaatagtctagtctaagcaagagataaagagaaccagatagaaaagagctatattacccaaaactttacaagtgaaatttttaagctccaatcacaatgcagattaaataatgggcactgaataaatatttgtggatgatctcagcattgccaggtcagcttaaaaa

SEQ ID NO: 134941 - DNA, 694 bp, Homo sapiens
aagcttcctgccacccagtggtacagcaagcactctccagcaagatttaatctcagccttgtgaggagccctttcccaaatttatttctttctgtgttttttatcccttagtagctaatctcatgttagccattaataactctctatgttaaacccttccttttgtatctgcggctacattgatcaattgtctcacaccgctcacccaccccctctccctggtcatgcagaggcctcaccagtcattttattgctattcccaggcctctgtgtgcccagatctcttcactgccctgtcagttgtgtcctgtccccttctcgacctcctggccttgtcctcaatgatgtttctatgaggctttggaaagcctcatcccaagagtcctggcaactgatacattagtctcaccaacactagcccctactcctgatctcattttaaaattttattttcttattttattattattatttttagggacatcaccctgcttctgactgacccaatttttaaagtttctctttattctccttaaagaatggctctcccatttgtttccctcatctttcttttcactgacttagaattcaggtccagacaaaaattccacttccttgaagagccttcccagtagccatgaaccacactctggggcagagtttgtggctcccaagcactttgttcacacctgct

SEQ ID NO: 134942 - DNA, 455 bp, Homo sapiens
aacccaaatgtggcttgacatttgcactacctgtctgaccctatggtcatttgagtttgtgtgacccctaccataaggacatggcatggcccaaaagctggtgcttcccaaaggatactgcagcccctttttaaatttttattttattttgagacagggtctcactctgtcacccaggctggagtacagtggcacgatctttgctcactgcaacctctgcctcccagcactttgggaggccgaggcaggtagatcacctgaggtcaagtttgagaccagcctggccaacgtggtgaaaccccatctctactaaaaaaaaaaaaaaaaaaaaaaatcagccaggtgtggtggcacactctagctactcaggaggctgaggcaggaaaattgcttgaacctgggaggtggaggtttcagtggactgagattgtgccactgcactccagcctgggcga

SEQ ID NO: 134943 - DNA, 123 bp, Homo sapiens
tggaatgcaaaaaaaaagtaagccaaaagcatagtctattttaagtaatggcttagtattttccatttaatcatccaaggtgagaatcatagctcaaaaaaaagcagggattacccaatttca

SEQ ID NO: 134944 - DNA, 299 bp, Homo sapiens
acctacgtaccacagagctctgggagtatgagcccaggggtgcccagctgccgacaggggtatctttgtgaatttttgggtgtcagcaactaattcagactttaaaaaagaagagggaggagaaagaggaagaaaaggaagaaactggtatggtataaacaaaacaaatctgaaagctcaatgtggcccagtgccctaccagattataaactggtttggatgaacccactctcaggtcttttagtggaaggcaggtttttggtaagtttttgagctggaatttgggaccagatgaactc

SEQ ID NO: 134945 - DNA, 901 bp, Homo sapiens
  misc_feature (719)..(719): n is a, c, g, or t
ggggatatcgtcgaccagcgtcgccacgcgtcgccatgcagaattacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacacagataatgctgccttgacacacacatgcacggatattgcctggacacacacacacacacgtgtgcacagatatgctgtctggacacgcacacacatgcagatatgctgcctggacacacacttccagacacacgtgcacaggcgcagatatgctgcctggacacacgcagatatgctgtctagtcacacacacacgcagacatgctgtccggacacacacacgcatgcacagatatgctgtccggacacacacacgcacgcagatatgctgcctggacacacacacagataatgctgcctcaacactcacacacgtgcagatattgcctggacacacacatgtgcacagatatgctgtctggacatgcacacacgtgcagatatgctgtccggatacacacgcacgcacacatgcagatatgctgcctgggcacacacttccggacacacatgcacacacaggtgcagatatgctgcctggacacaccacagagatnatgctgcctaacactcacacacgtgcttccctgcagcacacatccagaagcaaagctaaaaggccccacctaatcaacaccactgacacaccttcagaaaaaaaaaaatccccccatccagtgaaagtaatttcaaaattaggaaaaagcaactgttacactagatgccgtctaggagcgta

SEQ ID NO: 134946 - DNA, 168 bp, Homo sapiens
  misc_feature (17)..(17): n is a, c, g, or t
  misc_feature (20)..(21): n is a, c, g, or t
  misc_feature (23)..(23): n is a, c, g, or t
  misc_feature (25)..(26): n is a, c, g, or t
aaaaaaaaaaaaaaaanaannanannacaccaccccccaccccactgtcgtggtggccccagatctctgtaattttatgtagagtttgagctgaagccccgtatatttaatttattttgttaaacatgaaagtgcatcctttcaaaaaaagtcgacgcggccgcgaat

SEQ ID NO: 134947 - DNA, 3391 bp, Homo sapiens
gccgccccgccccgagaccgggcccgggggcgcggggcggcgggatgcggcgcccggggcggcgatgaccgcggagcgcacgccgcgggcccggccctgaccccgccgcccgcccgctgagccccccgccgaggtccggacaggccgagatgacgccgagccccctgttgctgctcctgctgccgccgctgctgctgggggccttcccaccggccgccgccgcccgaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctggatgacattagcccagggaaggagagcctggggcccgacagctcctctgggggtcaagaggaccccgccagccagcagtgggcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccagcggacccgttccaagcccgtgctcacaggcacgcaccccgtgaacacgacggtggacttcggggggaccacgtccttccagtgcaaggtgcgcagcgacgtgaagccggtgatccagtggctgaagcgcgtggagtacggcgccgagggccgccacaactccaccatcgatgtgggcggccagaagtttgtggtgctgcccacgggtgacgtgtggtcgcggcccgacggctcctacctcaataagctgctcatcacccgtgcccgccaggacgatgcgggcatgtacatctgccttggcgccaacaccatgggctacagcttccgcagcgccttcctcaccgtgctgccagacccaaaaccgccagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactgcctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacacagataatgctgccttgacacacacatgcacggatattgcctggacacacacacacacacgtgtgcacagatatgctgtctggacacgcacacacatgcagatatgctgcctggacacacacttccagacacacgtgcacaggcgcagatatgctgcctggacacacgcagatatgctgtctagtcacacacacacgcagacatgctgtccggacacacacacgcatgcacagatatgctgtccggacacacacacgcacgcagatatgctgcctggacacacacacagataatgctgcctcaacactcacacacgtgcagatattgcctggacacacacatgtgcacagatatgctgtctggacatgcacacacgtgcagatatgctgtccggatacacacgcacgcacacatgcagatatgctgcctgggcacacacttccggacacacatgcacacacaggtgcagatatgctgcctggacacacgcagactgacgtgcttttgggagggtgtgccgtgaagcctgcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacagcagccccaagcctgagaggctggagcccatggctagtggctcatccccactgcattctccccctgacacagagaaggggccttggtatttatatttaagaaatgaagataatattaataatgatggaaggaagactgggttgcagggactgtggtctctcctggggcccgggacccgcctggtctttcagccatgctgatgaccacaccccgtccaggccagacaccaccccccaccccactgtcgtggtggccccagatctctgtaattttatgtagagtttgagctgaagccccgtatatttaatttattttgttaaacatgaaagtgcatcctttcaaaaagacacaaacacacaaaaaaaagggggggcaaaaatccggggggcaagatgcgcaccctttctgacagggccaagagggtaaagcacaggcgcgttaacgcgggaaagcgcgggttgggaccctctgggggtgggcaccacataccgagaaagttgtcgccgcgggtgacaacaaaac

SEQ ID NO: 134948 - DNA, 3201 bp, Homo sapiens
caaggctgtaccggtcagggattatgggatcgcgccgagccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctggatgacattagcccagggaaggagagcctggggcccgacagctcctctgggggtcaagaggaccccgccagccagcagtgggcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccagcggacccgttccaagcccgtgctcacaggcacgcaccccgtgaacacgacggtggacttcggggggaccacgtccttccagtgcaaggtgcgcagcgacgtgaagccggtgatccagtggctgaagcgcgtggagtacggcgccgagggccgccacaactccaccatcgatgtgggcggccagaagtttgtggtgctgcccacgggtgacgtgtggtcgcggcccgacggctcctacctcaataagctgctcatcacccgtgcccgccaggacgatgcgggcatgtacatctgccttggcgccaacaccatgggctacagcttccgcagcgccttcctcaccgtgctgccagacccaaaaccgccagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactgcctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacacagataatgctgccttgacacacacatgcacggatattgcctggacacacacacacacacgtgtgcacagatatgctgtctggacacgcacacacatgcagatatgctgcctggacacacacttccagacacacgtgcacaggcgcagatatgctgcctggacacacgcagatatgctgtctagtcacacacacacgcagacatgctgtccggacacacacacgcatgcacagatatgctgtccggacacacacacgcacgcagatatgctgcctggacacacacacagataatgctgcctcaacactcacacacgtgcagatattgcctggacacacacatgtgcacagatatgctgtctggacatgcacacacgtgcagatatgctgtccggatacacacgcacgcacacatgcagatatgctgcctgggcacacacttccggacacacatgcacacacaggtgcagatatgctgcctggacacacgcagactgacgtgcttttgggagggtgtgccgtgaagcctgcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacagcagccccaagcctgagaggctggagcccatggctagtggctcatccccactgcattctccccctgacacagagaaggggccttggtatttatatttaagaaatgaagataatattaataatgatggaaggaagactgggttgcagggactgtggtctctcctggggcccgggacccgcctggtctttcagccatgctgatgaccacaccccgtccaggccagacaccaccccccaccccactgtcgtggtggccccagatctctgtaattttatgtagagtttgagctgaagccccgtatatttaatttattttgttaaacatgaaagtgcatcctttcaaaaagacacaaacacacaaaaaaaagggggggcaaaaatccggggggcaagatgcgcaccctttctgacagggccaagagggtaaagcacaggcgcgttaacgcgggaaagcgcgggttgggaccctctgggggtgggcaccacataccgagaaagttgtcgccgcgggtgacaacaaaac

SEQ ID NO: 134949 - DNA, 3314 bp, Homo sapiens
gccgccccgccccgagaccgggcccgggggcgcggggcggcgggatgcggcgcccggggcggcgatgaccgcggagcgcacgccgcgggcccggccctgaccccgccgcccgcccgctgagccccccgccgaggtccggacaggccgagatgacgccgagccccctgttgctgctcctgctgccgccgctgctgctgggggccttcccaccggccgccgccgcccgaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaaaggaccccgccagccagcagtgggcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccagcggacccgttccaagcccgtgctcacaggcacgcaccccgtgaacacgacggtggacttcggggggaccacgtccttccagtgcaaggtgcgcagcgacgtgaagccggtgatccagtggctgaagcgcgtggagtacggcgccgagggccgccacaactccaccatcgatgtgggcggccagaagtttgtggtgctgcccacgggtgacgtgtggtcgcggcccgacggctcctacctcaataagctgctcatcacccgtgcccgccaggacgatgcgggcatgtacatctgccttggcgccaacaccatgggctacagcttccgcagcgccttcctcaccgtgctgccagacccaaaaccgccagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactgcctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacacagataatgctgccttgacacacacatgcacggatattgcctggacacacacacacacacgtgtgcacagatatgctgtctggacacgcacacacatgcagatatgctgcctggacacacacttccagacacacgtgcacaggcgcagatatgctgcctggacacacgcagatatgctgtctagtcacacacacacgcagacatgctgtccggacacacacacgcatgcacagatatgctgtccggacacacacacgcacgcagatatgctgcctggacacacacacagataatgctgcctcaacactcacacacgtgcagatattgcctggacacacacatgtgcacagatatgctgtctggacatgcacacacgtgcagatatgctgtccggatacacacgcacgcacacatgcagatatgctgcctgggcacacacttccggacacacatgcacacacaggtgcagatatgctgcctggacacacgcagactgacgtgcttttgggagggtgtgccgtgaagcctgcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacagcagccccaagcctgagaggctggagcccatggctagtggctcatccccactgcattctccccctgacacagagaaggggccttggtatttatatttaagaaatgaagataatattaataatgatggaaggaagactgggttgcagggactgtggtctctcctggggcccgggacccgcctggtctttcagccatgctgatgaccacaccccgtccaggccagacaccaccccccaccccactgtcgtggtggccccagatctctgtaattttatgtagagtttgagctgaagccccgtatatttaatttattttgttaaacatgaaagtgcatcctttcaaaaagacacaaacacacaaaaaaaagggggggcaaaaatccggggggcaagatgcgcaccctttctgacagggccaagagggtaaagcacaggcgcgttaacgcgggaaagcgcgggttgggaccctctgggggtgggcaccacataccgagaaagttgtcgccgcgggtgacaacaaaac

SEQ ID NO: 134950 - DNA, 3631 bp, Homo sapiens
gccgccccgccccgagaccgggcccgggggcgcggggcggcgggatgcggcgcccggggcggcgatgaccgcggagcgcacgccgcgggcccggccctgaccccgccgcccgcccgctgagccccccgccgaggtccggacaggccgagatgacgccgagccccctgttgctgctcctgctgccgccgctgctgctgggggccttcccaccggccgccgccgcccgaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctggatgacattagcccagggaaggagagcctggggcccgacagctcctctgggggtcaagaggaccccgccagccagcagtgggcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccagcggacccgttccaagcccgtgctcacaggcacgcaccccgtgaacacgacggtggacttcggggggaccacgtccttccagtgcaaggtgcgcagcgacgtgaagccggtgatccagtggctgaagcgcgtggagtacggcgccgagggccgccacaactccaccatcgatgtgggcggccagaagtttgtggtgctgcccacgggtgacgtgtggtcgcggcccgacggctcctacctcaataagctgctcatcacccgtgcccgccaggacgatgcgggcatgtacatctgccttggcgccaacaccatgggctacagcttccgcagcgccttcctcaccgtgctgccaggtgcgcggctgccacgccacgccacaccatgctggtgcccggacccgccccctgggcccggcgtcccacccaccgggtggggccccacccttccctcccgggccgtgctggccaggtcatctgccgagggagggcagcccaggggcaccgtctccacagcccctgggatgggtctggggtgctctcctggtctttgtgtcggcgttcccctccctacctcctttcctctcgctcttgcagacccaaaaccgccagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactgcctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacacagataatgctgccttgacacacacatgcacggatattgcctggacacacacacacacacgtgtgcacagatatgctgtctggacacgcacacacatgcagatatgctgcctggacacacacttccagacacacgtgcacaggcgcagatatgctgcctggacacacgcagatatgctgtctagtcacacacacacgcagacatgctgtccggacacacacacgcatgcacagatatgctgtccggacacacacacgcacgcagatatgctgcctggacacacacacagataatgctgcctcaacactcacacacgtgcagatattgcctggacacacacatgtgcacagatatgctgtctggacatgcacacacgtgcagatatgctgtccggatacacacgcacgcacacatgcagatatgctgcctgggcacacacttccggacacacatgcacacacaggtgcagatatgctgcctggacacacgcagactgacgtgcttttgggagggtgtgccgtgaagcctgcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacagcagccccaagcctgagaggctggagcccatggctagtggctcatccccactgcattctccccctgacacagagaaggggccttggtatttatatttaagaaatgaagataatattaataatgatggaaggaagactgggttgcagggactgtggtctctcctggggcccgggacccgcctggtctttcagccatgctgatgaccacaccccgtccaggccagacaccaccccccaccccactgtcgtggtggccccagatctctgtaattttatgtagagtttgagctgaagccccgtatatttaatttattttgttaaacatgaaagtgcatcctttcaaaaagacacaaacacacaaaaaaaagggggggcaaaaatccggggggcaagatgcgcaccctttctgacagggccaagagggtaaagcacaggcgcgttaacgcgggaaagcgcgggttgggaccctctgggggtgggcaccacataccgagaaagttgtcgccgcgggtgacaacaaaac

SEQ ID NO: 134951 - DNA, 3575 bp, Homo sapiens
gccgccccgccccgagaccgggcccgggggcgcggggcggcgggatgcggcgcccggggcggcgatgaccgcggagcgcacgccgcgggcccggccctgaccccgccgcccgcccgctgagccccccgccgaggtccggacaggccgagatgacgccgagccccctgttgctgctcctgctgccgccgctgctgctgggggccttcccaccggccgccgccgcccgaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctggatgacattagcccagggaaggagagcctggggcccgacagctcctctgggggtcaagaggaccccgccagccagcagtgggcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccagcggacccgttccaagcccgtgctcacaggcacgcaccccgtgaacacgacggtggacttcggggggaccacgtccttccagtgcaaggtgcgcagcgacgtgaagccggtgatccagtggctgaagcgcgtggagtacggcgccgagggccgccacaactccaccatcgatgtgggcggccagaagtttgtggtgctgcccacgggtgacgtgtggtcgcggcccgacggctcctacctcaataagctgctcatcacccgtgcccgccaggacgatgcgggcatgtacatctgccttggcgccaacaccatgggctacagcttccgcagcgccttcctcaccgtgctgccagacccaaaaccgccagggccacctgtggcctcctcgtcctcggccactatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactgcctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacacagataatgctgccttgacacacacatgcacggatattgcctggacacacacacacacacgtgtgcacagatatgctgtctggacacgcacacacatgcagatatgctgcctggacacacacttccagacacacgtgcacaggcgcagatatgctgcctggacacacgcagatatgctgtctagtcacacacacacgcagacatgctgtccggacacacacacgcatgcacagatatgctgtccggacacacacacggcagatatgctgcctggacacacacacagataatgctgcctcaacactcacacacgtgcagatattgcctggacacacacatgtgcacagatatgctgtctggacatgcacacacgtgcagatatgctgtccggatacacacgcacgcacacatgcagatatgctgcctgggcacacacttccggacacacatgcacacacaggtcacgcagatatgctgcctggacacacacacagataatgctgcctcaacactcacacacgtgcagatattgcctggacacacacatgtgcacagatatgctgtctggacatgcacacacgtgcagatatgctgtccggatacacacgcacgcacacatgcagatatgctgcctgggcacacacttccggacacacatgcacacacaggtgcagatatgctgcctggacacacgcagactgacgtgcttttgggagggtgtgccgtgaagcctgcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacagcagccccaagcctgagaggctggagcccatggctagtggctcatccccactgcattctccccctgacacagagaaggggccttggtatttatatttaagaaatgaagataatattaataatgatggaaggaagactgggttgcagggactgtggtctctcctggggcccgggacccgcctggtctttcagccatgctgatgaccacaccccgtccaggccagacaccaccccccaccccactgtcgtggtggccccagatctctgtaattttatgtagagtttgagctgaagccccgtatatttaatttattttgttaaacatgaaagtgcatcctttcaaaaagacacaaacacacaaaaaaaagggggggcaaaaatccggggggcaagatgcgcaccctttctgacagggccaagagggtaaagcacaggcgcgttaacgcgggaaagcgcgggttgggaccctctgggggtgggcaccacataccgagaaagttgtcgccgcgggtgacaacaaaac

SEQ ID NO: 134952 - DNA, 1660 bp, Homo sapiens
gacccacgcgtcgcggacgcgtgggtcgacccacgcgtccgggccagcaccccaggcagtctgtgtgtgaggcatagcccctggacacacacacacagacacacacactgcctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacacagataatgctgccttgacacacacatgcacggatattgcctggacacacacacacacacgtgtgcacagatatgctgtctggacacgcacacacatgcagatatgctgcctggacacacacttccagacacacgtgcacaggcgcagatatgctgcctggacacacgcagatatgctgtctagtcacacacacacgcagacatgctgtccggacacacacacgcatgcacagatatgctgtccggacacacacacgcacgcagatatgctgcctggacacacacacagataatgctgcctcaacactcacacacgtgcagatattgcctggacacacacatgtgcacagatatgctgtctggacatgcacacacgtgcagatatgctgtccggatacacacgcacgcacacatgcagatatgctgcctgggcacacacttccggacacacatgcacacacaggtgcagatatgctgcctggacacacgcagactgacgtgcttttgggagggtgtgccgtgaagcctgcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacagcagccccaagcctgagaggctggagcccatggctagtggctcatccccactgcattctccccctgacacagagaaggggccttggtatttatatttaagaaatgaagataatattaataatgatggaaggaagactgggttgcagggactgtggtctctcctggggcccgggacccgcctggtctttcagccatgctgatgaccacaccccgtccaggccagacaccaccccccaccccactgtcgtggtggccccagatctctgtaattttatgtagagtttgagctgaagccccgtatatttaatttattttgttaaacatgaaagtgcatcctttcaaaaagacacaaacacacaaaaaaaagggggggcaaaaatccggggggcaagatgcgcaccctttctgacagggccaagagggtaaagcacaggcgcgttaacgcgggaaagcgcgggttgggaccctctgggggtgggcaccacataccgagaaagttgtcgccgcgggtgacaacaaaac

SEQ ID NO: 134953 - DNA, 2503 bp, Homo sapiens
gccgccccgccccgagaccgggcccgggggcgcggggcggcgggatgcggcgcccggggcggcgatgaccgcggagcgcacgccgcgggcccggccctgaccccgccgcccgcccgctgagccccccgccgaggtccggacaggccgagatgacgccgagccccctgttgctgctcctgctgccgccgctgctgctgggggccttcccaccggccgccgccgcccgaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctggatgacattagcccagggaaggagagcctggggcccgacagctcctctgggggtcaagaggaccccgccagccagcagtgggcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccagcggacccgttccaagcccgtgctcacaggcacgcaccccgtgaacacgacggtggacttcggggggaccacgtccttccagtgcaaggtgcgcagcgacgtgaagccggtgatccagtggctgaagcgcgtggagtacggcgccgagggccgccacaactccaccatcgatgtgggcggccagaagtttgtggtgctgcccacgggtgacgtgtggtcgcggcccgacggctcctacctcaataagctgctcatcacccgtgcccgccaggacgatgcgggcatgtacatctgccttggcgccaacaccatgggctacagcttccgcagcgccttcctcaccgtgctgccagacccaaaaccgccagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactgcctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacacagataatgctgccttgacacacacatgcacggatattgcctggacacacacacacacacgtgtgcacagatatgctgtctggacacgcacacacatgcagatatgctgcctggacacacacttccagacacacgtgcacaggcgcagatatgctgcctggacacacgcagatatgctgtctagtcacacacacacgcagacatgctgtccggacacacacacgcatgcacagatatgctgtccggacacacacacgcacgcagatatgctgcctggacacacacacgcacacccatgcgcagatgtgctgccgtggacacacacacacacacagagtagccgaccctggggatccgtctagag

SEQ ID NO: 134954 - DNA, 1020 bp, Homo sapiens
gccgccccgccccgagaccgggcccgggggcgcggggcggcgggatgcggcgcccggggcggcgatgaccgcggagcgcacgccgcgggcccggccctgaccccgccgcccgcccgctgagccccccgccgaggtccggacaggccgagatgacgccgagccccctgttgctgctcctgctgccgccgctgctgctgggggccttcccaccggccgccgccgcccgaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctggatgacattagcccagggaaggagagcctggggcccgacagctcctctgggggtcaagaggaccccgccagccagcagtgggcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccagcggacccgttccaagcccgtgctcacaggcacgcaccccgtgaacacgacggtgggtgctgggaagaggctgttaccccagaccacagctgtatcctggggcactggtggagttttgtctgacccccaatgggggatcctactagagcgac

SEQ ID NO: 134955 - DNA, 3330 bp, Homo sapiens
gccgccccgccccgagaccgggcccgggggcgcggggcggcgggatgcggcgcccggggcggcgatgaccgcggagcgcacgccgcgggcccggccctgaccccgccgcccgcccgctgagccccccgccgaggtccggacaggccgagatgacgccgagccccctgttgctgctcctgctgccgccgctgctgctgggggccttcccaccggccgccgccgcccgaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctggatgacattagcccagggaaggagagcctggggcccgacagctcctctgggggtcaagaggaccccgccagccagcagtgggcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccagcggacccgttccaagcccgtgctcacaggcacgcaccccgtgaacacgacggtggacttcggggggaccacgtccttccagtgcaaggtgcgcagcgacgtgaagccggtgatccagtggctgaagcgcgtggagtacggcgccgagggccgccacaactccaccatcgatgtgggcggccagaagtttgtggtgctgcccacgggtgacgtgtggtcgcggcccgacggctcctacctcaataagctgctcatcacccgtgcccgccaggacgatgcgggcatgtacatctgccttggcgccaacaccatgggctacagcttccgcagcgccttcctcaccgtgctgccagacccaaaaccgccagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactgcctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacacagataatgctgccttgacacacacatgcacggatattgcctggacacacacacacacacgtgtgcacagatatgctgtctggacacgcacacacatgcagatatgctgcctggacacacacttccagacacacgtgcacaggcgcagatatgctgcctggacacacgcagatatgctgtctagtcacacacacaccacgcagatatgctgcctggacacacacacagataatgctgcctcaacactcacacacgtgcagatattgcctggacacacacatgtgcacagatatgctgtctggacatgcacacacgtgcagatatgctgtccggatacacacgcacgcacacatgcagatatgctgcctgggcacacacttccggacacacatgcacacacaggtgcagatatgctgcctggacacacgcagactgacgtgcttttgggagggtgtgccgtgaagcctgcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacagcagccccaagcctgagaggctggagcccatggctagtggctcatccccactgcattctccccctgacacagagaaggggccttggtatttatatttaagaaatgaagataatattaataatgatggaaggaagactgggttgcagggactgtggtctctcctggggcccgggacccgcctggtctttcagccatgctgatgaccacaccccgtccaggccagacaccaccccccaccccactgtcgtggtggccccagatctctgtaattttatgtagagtttgagctgaagccccgtatatttaatttattttgttaaacatgaaagtgcatcctttcaaaaagacacaaacacacaaaaaaaagggggggcaaaaatccggggggcaagatgcgcaccctttctgacagggccaagagggtaaagcacaggcgcgttaacgcgggaaagcgcgggttgggaccctctgggggtgggcaccacataccgagaaagttgtcgccgcgggtgacaacaaaac

SEQ ID NO: 134956 - DNA, 2819 bp, Homo sapiens
  misc_feature (2637)..(2637): n is a, c, g, or t
gccgccccgccccgagaccgggcccgggggcgcggggcggcgggatgcggcgcccggggcggcgatgaccgcggagcgcacgccgcgggcccggccctgaccccgccgcccgcccgctgagccccccgccgaggtccggacaggccgagatgacgccgagccccctgttgctgctcctgctgccgccgctgctgctgggggccttcccaccggccgccgccgcccgaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctggatgacattagcccagggaaggagagcctggggcccgacagctcctctgggggtcaagaggaccccgccagccagcagtgggcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccagcggacccgttccaagcccgtgctcacaggcacgcaccccgtgaacacgacggtggacttcggggggaccacgtccttccagtgcaaggtgcgcagcgacgtgaagccggtgatccagtggctgaagcgcgtggagtacggcgccgagggccgccacaactccaccatcgatgtgggcggccagaagtttgtggtgctgcccacgggtgacgtgtggtcgcggcccgacggctcctacctcaataagctgctcatcacccgtgcccgccaggacgatgcgggcatgtacatctgccttggcgccaacaccatgggctacagcttccgcagcgccttcctcaccgtgctgccagacccaaaaccgccagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactgcctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacacagataatgctgccttgacacacacatgcacggatattgcctggacacacacacacacacgtgtgcacagatatgctgtctggacacgcacacacatgcagatatgctgcctggacacacacttccagacacacgtgcacaggcgcagatatgctgcctggacacacgcagatatgctgtctagtcacacacacacgcagacatgctgtccggacacacacacgcatgcacagatatgctgtccggacacacacacgcacgcagatatgctgcctggacacacacacagataatgctgcctcaacactcacacacgtgcagatattgcctggacacacacatgtgcacagatatgctgtctggacatgcacacacgtgcagatatgctgtccggatacacacgcacgcacacatgcagatatgctgcctgggcacacacttccggacacacatgcacacacaggtgcagatatgctgcctggacacaccacagagatnatgctgcctaacactcacacacgtgcttccctgcagcacacatccagaagcaaagctaaaaggccccacctaatcaacaccactgacacaccttcagaaaaaaaaaaatccccccatccagtgaaagtaatttcaaaattaggaaaaagcaactgttacactagatgccgtctaggagcgta

SEQ ID NO: 134957 - DNA, 2102 bp, Homo sapiens
gccgccccgccccgagaccgggcccgggggcgcggggcggcgggatgcggcgcccggggcggcgatgaccgcggagcgcacgccgcgggcccggccctgaccccgccgcccgcccgctgagccccccgccgaggtccggacaggccgagatgacgccgagccccctgttgctgctcctgctgccgccgctgctgctgggggccttcccaccggccgccgccgcccgaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctggatgacattagcccagggaaggagagcctggggcccgacagctcctctgggggtcaagaggaccccgccagccagcagtgggcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccagcggacccgttccaagcccgtgctcacaggcacgcaccccgtgaacacgacggtggacttcggggggaccacgtccttccagtgcaaggtgcgcagcgacgtgaagccggtgatccagtggctgaagcgcgtggagtacggcgccgagggccgccacaactccaccatcgatgtgggcggccagaagtttgtggtgctgcccacgggtgacgtgtggtcgcggcccgacggctcctacctcaataagctgctcatcacccgtgcccgccaggacgatgcgggcatgtacatctgccttggcgccaacaccatgggctacagcttccgcagcgccttcctcaccgtgctgccagacccaaaaccgccagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactgcctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctcctcacatgcagtaccgacacccatgcgcagattgctgcctgacacaccacggggtccg

SEQ ID NO: 134958 - DNA, 404 bp, Homo sapiens
gctcacccttaggggggcaatgagaacaaatggaggtgaaattggtgctacacccagaggggcaggaagaatttgggcagtaagcagtggcagagagaaaagggcattctggaagtcacaggccaagtccaggcaacataaaacctgaagagcagagaaagaagaggcagggaggaaaactggagccagacatggggccgtgtttgccaggccagggagcttggctttgatctcgtggttaacaggaagtcactcacatgacagtaagtggccagcagaggctgtggttactaagggctactgtaggaagctgggttgctggaggcccacctgggatgggaaacaggcagctggaccccctcagccagctgctcgccccagggagaggttagaaccgttcaggt

SEQ ID NO: 134959 - DNA, 170 bp, Homo sapiens
gagactgtgtcacaagttaatcaggaaaggtttccaaaccttctactggctgggaaaggagtggctctttttaagtctagaaacacttgtgcccggactttctgtttggaccattgtgtccttttgagagaaggtagccctgattgttagtaaatttcagttaattgaag

SEQ ID NO: 134960 - DNA, 651 bp, Homo sapiens
tatcaacatgggtttttcttttacttcacttttccttatttatatctttttataagtgtaagctcatatacgaagaggcttcatctccaagcagagagaccatcagctctggattgtcagttttccactcaggctatctgtctatccatcatcttacacaaactgttggaaccgtgttctatgggatcactagtactgatgactcagttgttcctcagcacacttactgctgtttctaaaactacagagtttatccacaatttcctatgcatacacctttctaattttaagagggagatacaattcataaatttaaaaagatgtatcaactgaagaatgataaatttcataaatttggaaaggagagctttacttttcataaaggttgcagcctgcagcgtagccattctgagaggccaggaagtgtaacctccatccagaagccagaaacacactttttgagggtcagaagaatatgacagggatttatgttgaatagactggccaaatacacatattcaataaactataggaagagtcatgaatatttataagtagagaaatgtgggcatgtgcagttgagtttcatgtctctctatgggacccatgttccaaaaatgggttagcataattcgaggatacagttttcag

SEQ ID NO: 134961 - DNA, 303 bp, Homo sapiens
ggagttcaagactagtctaggcaacatatcaacatcccatctctacaaaaaaattaaaataaaaaaatcagtcaggcatagtggtgcacgcatatagttccagctactcgtccaggagtttgaaaccagcctgagcgacatggcaagacaccatctcttccagaaaactaaaaaaaaaaaaaaaaatcagcagggccgggtgcagtggctcacatctgtaatcccagcactttgggaggccaaggtgggcagatcacaaggtcaagagatgaagaccatcctggcaaacatggtgaaacccca

SEQ ID NO: 134962 - DNA, 127 bp, Homo sapiens
ctcttattaaagaagcatgaatgtatcactagctgttaccagaacaaacagctgtagaatgtaatgacccatcctatttctaaatttacttctatcagtggataatttgtgtataggaaaaggtgtg

SEQ ID NO: 134963 - DNA, 420 bp, Homo sapiens
atccagatgtacaactaaagaagagcattgccagtgaagctatggcagtgcatattatcatgtagaagatgagttggtaaagtttattcatctaagctcaaatggcatctggtctacagaaagaattaggaatgctaaatttcttttctgaactactttataaattttgacttttgactatgcacaactttatataatgagggtaaaatttgatttgctgtaataaaatattttctggctgagtgtggtggctcatgcctgtaatcccagaccttgagaggctaaggtgggaggattgctgggtccagtggtttgagaccagtctgggcaacatagcaagaccctgtctctacaaaaaatacaagggattggccaggtgtggtggcatgtgctctggtcccagctattcaggaggcttag

SEQ ID NO: 134964 - DNA, 477 bp, Homo sapiens
tccaccaggacccaacccacaggctacttattgctggaaacctacgttgttccttggattgaagtaatctctccctcctctggtgcgcccacagcacttgcaccaacagtgggtactcaacagactagcgtgcctgccgaagaaggggtcctctgacaatcaggggacaatggggaattatgctctccagactttctacacacacaagtcacacaggaaggaaggtaaagagaaactagagaaaataatttttgaagaaaaacatttcaggaagtattgaaagtacacggtaactcagcctggggcaggggtggagggcagcagcactgtttgctgcagctatgctccttcctcagtgccctgcacacccgggacttgctcggtgagcatctctcgtgtcagtgacagctagtgtgagtactcttatgttcagctgcccctgactacctcttgactttggggacaagttacttaatc

SEQ ID NO: 134965 - DNA, 2395 bp, Homo sapiens
gtgcaggcgagcttcttggcctaagggcaggaagagatggcagcgggggagacgcagctctacgccaaggtctccaacaagctcaagagccgcagcagcccctcgctcctggagcccctcctggccatgggcttcccggtgcacaccgcgctgaaagcgttggcagccacggggaggaagacggcggaggaggccttggcctggctgcatgatcattgcaatgacccttccctagacgaccccatcccccaggagtatgcccttttcctctgtccaacggggcccctgctggaaaaacttcaagagttctggagagagagcaagcgccagtgtgcaaagaacagagctcatgaggtcttcccacacgtgacactctgtgacttcttcacgtgtgaagaccagaaggtggaatgcctgtacgaggcgctgaagagagctggagacaggctcctgggctccttccccacggccgtgcctctggctctccactcctccatcagctacctcggcttcttcgtcagtggcagccccgcagacgtcatccgggaattcgccatgaccttcgccacggaagcatctctcttagcagactgctccgtgaagccttgcaccaaacagctgcatctgaccttggcccacaagttctacccccaccaccagaggacgctggagcagctggccagagccatccccctgggccacagctgccagtggaccgcagcactctactcccgagacatgcgctttgtgcactaccagaccctgagagccctattccagtacaaaccccagaacgtggatgagctgacgctaagtcctggtgactacatctttgtggaccccacgcagcaggacgaagccagcgagggctgggtgattgggatctcacagcggacgggctgccggggcttcctgccggaaaactacacggatcgagccagtgagtctgacacgtgggtgaagcacaggatgtacaccttcagtctagccacagacctgaactccagaaaggatggtgaagccagcagcagatgcagcggggaatttcttccacaaacggcaaggagtcttagcagcttacaggccttgcaggctaccgttgcaaggaagagcgtgctggtggttcgccacggggagagagtggatcagatcttcgggaaggcatggctgcagcaatgctccactcctgatgggaaatactacaggccagacctgaatttcccctgcagtctgccaagacggagtcgtgggatcaaagactttgaaaacgatcccccattatcatcgtgtggcattttccagtccagaattgcaggggacgcgctactggacagtggtatcagaatcagctctgtgtttgcctccccagccctccgctgtgtgcagacggccaaactcatcctggaagaactcaaactggagaaaaaaatcaagatacgagtggaacctggaatctttgaatggacaaaatgggaagctggcaaaaccaccccaaccctcatgagcctggaagagctgaaagaggcaaatttcaacattgacactgattacaggcccgcgtttcccctgtccgccctcatgccggccgagagctaccaggagtacatggacaggtgcacggcgagcatggtgcaaatcgtcaacacctgtccacaggacacgggtgtcatcctaattgtgagtcacggctccactctggactcctgcacgcggccactgctcgggctgccgccccgggaatgtggggattttgcccaactcgtgagaaagatcccttccctgggcatgtgcttctgtgaagaaaataaagaggaaggaaaatgggagttggtgaacccaccggtgaagaccctgacccacggggcgaacgcagcatttaactggaggaactggatctcaggcaactgagagccacggtgatgttgtcataacctcagagtggagaggcagaaaccatgtgcagaggctgggagatgctgctgtttccagaggcgtcttagtctcacccaatgtgatttgtagaagcacgagacgcacttttatatcccggaatatttccctccggctttcgcctttgtaactcccatctgtggacccatcgtccaccagcccagctgcggggagcacagggcaggtggctgggtgaggatgccgccctgcagcatgtacaccgagtgtctgcagctggggacacaactgcccgggactctaacttccaggaattaaagactcaccacacacgaaggatctaaccacttcattttccatggtctaatcattaaattcccaatcgttttttctttttctgggtccatcactctttagccatatccacatgggctaaaacaggtgtaatagtcaataaaatggtcccagaaaaccatcgaccaggtca

SEQ ID NO: 134966 - DNA, 498 bp, Homo sapiens
cagaagcccaagggtcaagacctcattgagaagaaggttcagaggagctggactggagtttagtcaaggagagagtctttgtcattctccacccatgtctgactctgccatcacagagccctcctggtgttgagtaagaatgtgtgctggagattgactgtcagtgctttgccagttttcagcacaaaactggagcctgcctgttgaccatgagcctgccttgaggcagagccatcctggaagaacgttctccttccccagctaactgcagctgagccttcctaatccctacgaaagtgccagggcagcagcctctccttctcatccttccaggcccgcgtttcccctgtccgccctcatgccggccgagagctaccaggagtacatggacaggtgcacggcgagcatggtgcaaatcgtcaacacctgtccacaggacagtaagtgcctcaccatcctcagtatgaacagcccctggggcttggggaattatctctg

SEQ ID NO: 134967 - DNA, 2509 bp, Homo sapiens
gtgcaggcgagcttcttggcctaagggcaggaagagatggcagcgggggagacgcagctctacgccaaggtctccaacaagctcaagagccgcagcagcccctcgctcctggagcccctcctggccatgggcttcccggtgcacaccgcgctgaaagcgttggcagccacggggaggaagacggcggaggaggccttggcctggctgcatgatcattgcaatgacccttccctagacgaccccatcccccaggagtatgcccttttcctctgtccaacggggcccctgctggaaaaacttcaagagttctggagagagagcaagcgccagtgtgcaaagaacagagctcatgaggtcttcccacacgtgacactctgtgacttcttcacgtgtgaagaccagaaggtggaatgcctgtacgaggcgctgaagagagctggagacaggctcctgggctccttccccacggccgtgcctctggctctccactcctccatcagctacctcggcttcttcgtcagtggcagccccgcagacgtcatccgggaattcgccatgaccttcgccacggaagcatctctcttagcaggcacttccgtttcccgcttctggattttcagccaggtgcctggacatggccctaacctgaggctgagcaatttaactagagcctccttcgtgagccactacatccttcaaaaatactgctccgtgaagccttgcaccaaacagctgcatctgaccttggcccacaagttctacccccaccaccagaggacgctggagcagctggccagagccatccccctgggccacagctgccagtggaccgcagcactctactcccgagacatgcgctttgtgcactaccagaccctgagagccctattccagtacaaaccccagaacgtggatgagctgacgctaagtcctggtgactacatctttgtggaccccacgcagcaggacgaagccagcgagggctgggtgattgggatctcacagcggacgggctgccggggcttcctgccggaaaactacacggatcgagccagtgagtctgacacgtgggtgaagcacaggatgtacaccttcagtctagccacagacctgaactccagaaaggatggtgaagccagcagcagatgcagcggggaatttcttccacaaacggcaaggagtcttagcagcttacaggccttgcaggctaccgttgcaaggaagagcgtgctggtggttcgccacggggagagagtggatcagatcttcgggaaggcatggctgcagcaatgctccactcctgatgggaaatactacaggccagacctgaatttcccctgcagtctgccaagacggagtcgtgggatcaaagactttgaaaacgatcccccattatcatcgtgtggcattttccagtccagaattgcaggggacgcgctactggacagtggtatcagaatcagctctgtgtttgcctccccagccctccgctgtgtgcagacggccaaactcatcctggaagaactcaaactggagaaaaaaatcaagatacgagtggaacctggaatctttgaatggacaaaatgggaagctggcaaaaccaccccaaccctcatgagcctggaagagctgaaagaggcaaatttcaacattgacactgattacaggcccgcgtttcccctgtccgccctcatgccggccgagagctaccaggagtacatggacaggtgcacggcgagcatggtgcaaatcgtcaacacctgtccacaggacacgggtgtcatcctaattgtgagtcacggctccactctggactcctgcacgcggccactgctcgggctgccgccccgggaatgtggggattttgcccaactcgtgagaaagatcccttccctgggcatgtgcttctgtgaagaaaataaagaggaaggaaaatgggagttggtgaacccaccggtgaagaccctgacccacggggcgaacgcagcatttaactggaggaactggatctcaggcaactgagagccacggtgatgttgtcataacctcagagtggagaggcagaaaccatgtgcagaggctgggagatgctgctgtttccagaggcgtcttagtctcacccaatgtgatttgtagaagcacgagacgcacttttatatcccggaatatttccctccggctttcgcctttgtaactcccatctgtggacccatcgtccaccagcccagctgcggggagcacagggcaggtggctgggtgaggatgccgccctgcagcatgtacaccgagtgtctgcagctggggacacaactgcccgggactctaacttccaggaattaaagactcaccacacacgaaggatctaaccacttcattttccatggtctaatcattaaattcccaatcgttttttctttttctgggtccatcactctttagccatatccacatgggctaaaacaggtgtaatagtcaataaaatggtcccagaaaaccatcgaccaggtca

SEQ ID NO: 134968 - DNA, 997 bp, Homo sapiens
gtgcaggcgagcttcttggcctaagggcaggaagagatggcagcgggggagacgcagctctacgccaaggtctccaacaagctcaagagccgcagcagcccctcgctcctggagcccctcctggccatgggcttcccggtgcacaccgcgctgaaagcgttggcagccacggggaggaagacggcggaggaggccttggcctggctgcatgatcattgcaatgacccttccctagacgaccccatcccccaggagtatgcccttttcctctgtccaacggggcccctgctggaaaaacttcaagagttctggagagagagcaagcgccagtgtgcaaagaacagagctcatgaggtcttcccacacgtgacactctgtgacttcttcacgtgtgaagaccagaaggtggaatgcctgtacgaggcgctgaagagagctggagacaggctcctgggctccttccccacggccgtgcctctggctctccactcctccatcagctacctcggcttcttcgtcagtggcagccccgcagacgtcatccgggaattcgccatgaccttcgccacggaagcatctctcttagcagactgctccgtgaagccttgcaccaaacagctgcatctgaccttggcccacaagttctacccccaccaccagaggacgctggagcagctggccagagccatccccctgggccacagctgccagtggaccgcagcactctactcccgagacatgcgctttgtgcactaccagaccctgagagccctattccagtacaaaccccagaacgtggatgagctgacgctaagtcctggtgactacatctttgtggaccccacgcagcaggacgaagccagcgagggctgggtgattgggatctcacagcggacgggctgccggggcttcctgccggaaaactacacggatcgagccagtgagtctgacacgtgggtgaagcacaggtgagtgctgcctctggctgcagccccgt

SEQ ID NO: 134969 - DNA, 864 bp, Homo sapiens
ttccctgctgactcaagatttactttactattacctgcacactgacatgattcaggtcttgaccaacactgcatttttgtctgtctgtttcctctggcctgccaccttagccttatctggacctcagcagcagagaccatgccctcatgaaggcactggggagccgttcacagtcagcactggccactcctcatctcagcccaatgaagttttacatttccatgtagatgaggcactcgggatatagaaaagttgtgcagcttgactcaaagcagacagtaattgggtagcctaattgaagtttaactgcaagttccaactttgtaggctgcagaaaaaaaggaaaaaaaaaaacaacaacaacaaagtttaactgcaagtttcatgagacagcgatctgcctaaccattcactcctcctagaagcaaaagctaccgtgatcattgaggcacagccggtcttcatatatcctcaaaggagggggattagcttccacatcccttctctattcctggaggtgccagtagtgggagagtcatggcagaagttaccagaggcaagtggggcagaggcaagtagggtatatgtttggatcagtggatcagtgtcctttattgtgcagaaaaagctaaaattacagattcttctgaagggatacatagcagccgtttcaccaatgtccctcagtccatttgtccaggtccagaagtattcatgaggagctatgcgttagaagagagcacttgggctgggcatggtggctcacacctgtaatccagcattttgggaggccaaggtgggaggattgcttgagcccaggagtttgagaccagcctgggcaacacaatgcccccatctcttaca

SEQ ID NO: 134970 - DNA, 146 bp, Homo sapiens
tttgtagccccagcttgtctgccaatacttagcctgatgttcagtaatttgttctgattctgaatagtgctatttccacagacacaagacttagtttaaaactccagagaatatcctaaatgagtttcaagctgtacacgaaaact

SEQ ID NO: 134971 - DNA, 487 bp, Homo sapiens
gccgcctggggacactggcccctctgtcaggatcaatccctctaacactgtttggaacattccagaaacttcaacatttgacccactgggcatgcattgatgccagagaggtgagttcaacccagatgtctggatgggagccacgttttaagcccttgcattacacagcaaggccacaggtcctgcggcagcagtgggttcaagaaaagcaccttccatgggcctcagacaccagccagttcatagacaccaacagagtgtgggcacgccgtcctccaccccaatcagcagtggccagtgccctcgcccaggatagaggacacaaccacaagcttccagaggctgccctgcacaagtccagctccccaggctgtgaccgtaatgccacccttaaaggggctgctaaatggaaaatgttcctgagcacagctcgcatgcactgccgcttctgcaccaattcgctcatttagtcttcaaacagctcttg

SEQ ID NO: 134972 - DNA, 151 bp, Homo sapiens
agatattgtgatatttaaaattacagatctgatcattttattccattaccaaaaagcctttgctgcttcctgattgctcttatgatgaagcccaaattccttaatgtgttctatgagcccctgcatgacttcatgcctacctctccagtct

SEQ ID NO: 134973 - DNA, 611 bp, Homo sapiens
gatcttttgttgacacgtggtaagaaaaatctcctcttcagtataaaaaggcccatttgtttggttctcaaccagatcggtcttgagtcagcggcatttgaaactggagccccagtcataactgtgggctgcccttacccgacacacacataggaggaaaatttggatttttcacagatatcctctattctgccatgggagcctaggaaagcaggggaagttgcccttggcattgaccagacaatgaactcatcatcctgcttcacccagaaatagaaatgaagtgttaaacgtagctcactagtgtctgcctcagcattacagactgaagttaagttgcctaagaaagtacagagtgggaatgcttacttaatccatgataatgtagcctaccaccccgataatcccaccaccccactgtcatctgaaagcacttattaagcacctagtgtgtacacagcccttctttcctggagtgttccaaaaagagctctcaagtttgggctgcatgaacacaacgtgaatgtacttcatgccactgaactgtacactaaaaatggttaaaatggtaaattttatgttatgtgtattttaccattttcttaaatacc

SEQ ID NO: 134974 - DNA, 302 bp, Homo sapiens
tggcaggacaaagaccagggccagggtcagagccaggtctgtgctgggcctagggaagactagggtgagggccaaggtaaggccagggcagggtcaaaggcagagtagggccagggcagggtgatgacacatccggagcacagcagggcagggtgatggcaagaccaggggcagaccactgccagctcagggccagggaaaggccagtgcagagccaggaaagggtctgggtctgggtcagggccaggaacaaggcagagcagggccagggccatggcagagtcagggcaggtccttgacag

SEQ ID NO: 134975 - DNA, 759 bp, Homo sapiens
cttcccaggtacagcaattcttttgcatcagcctcccaagtagctgggattacaggtgcctgccaccatgcctggcgaatgttttttatttttagtggagatggggtttcaccaagttagccaggctggtcttgaactcctgacctcaagtgatccacctgccttggcctcccaaagtgctgggtttacaggtgtgagccatcacacctggccagttcatgttacgattaacatacaaagcactgttggcaaactgtggtgcccacaccagcaggctcagtagcagcaagtagcctcttagaatgcaaattcttgggttccactccaaatctcctgaatcagaaacgctggggatggggccctgaagtctgaattttcacaagccctcaggggattctcacatgtgcccaactttgagagccatctcggtaagggaacctcagaggcacgtgcactcttgaactaaactgggaagaagaaaaggggaggtcacatggtcatcaaaaagatggggcttttcgagtctgataggtctggattcatagccactgggacacttagacgtccttggtcttggtcctcaggtttggcttgtgtggggcctggtctgactcatggatggctgtgtgtccagatctggctggaggccttcttctctgtggacacttccccaaggggccaaagtggcccaccacacatgctggtaccccctggccaactgctgcaggcaatggtgtggattccatcaccagcactcca

SEQ ID NO: 134976 - DNA, 429 bp, Homo sapiens
ctgatggctttggtaactaaatggctgagtttcaaaacccgttaagaaataggagataaagccagtagtccaaagtgagcagtgagtttacattaatatgttctgtgtaaatccagctcccctaaagactacgcatttagtaaaagaataattagaacccttctaccttcaacagaaggacgtaagaaagctcctacatcatagcctgggcaaaagtctcttccaggaattcaagactactgatttaccttcaaatgaatctggggactaaatctatattagctatataatctagaaacccctagacaaaaaaataacccccaagttagtttctggtccatcaagcctgagtacctggaaaaagccaacacaaatgtctttgaagacatatccttaaaccaagttattgagaattcccagacaaaaaga

SEQ ID NO: 134977 - DNA, 786 bp, Homo sapiens
ctgatgccacaggatcgtatacttaaaatgatttggatggcaaatgttatgttatatatgtcttaccccaatacaaaagtacatctataaatatatagtattattttgggtgtgctcctctctgtatagaggttatcccgtggtgtgtgtctgtaacttgattttttccaattctgccctcagtttcctgctctttccgggcctcaggaggcttgacatccctttgaccacagcactgaaaggtgttctctttgctgagaactcagtgtcttctgcctggcagaggcttcggccctctgtttttgtttctatcccttatgcattctccccggcaggtgcccctcccagctttaagtgtatgtatactctggatttttccgtcttcagaacagtgctcaaaaatacctggggtgtccttctaacagaaagtgcagagacgtctgctgcaggattgcccacccccattttgtaacatctgctatttgagaactgctgaagctgccctgatctatgagggctgacctggaagaacagatgactgtgagtgtaccccaggacgttggcctggatggtgacagaccatgtgctctagtcaccgtgctggccagacccccacaggaatccaaaccatcccagagaaaataagggacttttgcaaggctgccccaggaagcacggaagacgtggaactgaatcccaggcctctggcccatcacccacgtggtgtccccaaggaagggagagttgtctcggaatgctcagggggactcattaaagcaacacttt

SEQ ID NO: 134978 - DNA, 199 bp, Homo sapiens
aggataaaaaaacacatagacagaaatacccagccatcccagctgagtccagttctcagctgaccagctgagaatgcagtcttatgagtgagtctaggtgagataagcagaataaacatgcagtcaatccacagaattgagaaataacgaactgttgttctttttaggctatgaagtagcagagaactgatacagaggg

SEQ ID NO: 134979 - DNA, 723 bp, Homo sapiens
attctaaatgttgaaaatatatttagtcttttatgatgtaaaatgatatttatgaagcacattcctgaaaggtgctgctaaaatgccttgacaggttgcttgtttatggattttcattttgcagagttcataaatctcagtcattttcagaggaatcacaagctactaatgagaaaacttacaactttagggtcttgtgaaaaaataattgaagagtaatagggaacaggtttatagacctgaggcaaaaactttttcagggagttctacgattttgaggactgtctctattctgtttatgtccataatattttcactacatttcatgaattgtttatattctgccttggaacctaaagggaccaggagtttggccagttacagaaggtaaaacaattgaatatacttacgatttatccgcttgtggaccgaggttcttttccattccagtttcatccctactggggtattcctaacactgttccccgttctgcccctttcccctcaacagatatcttggcattatacttcctagagaatatggaggtactcttgagattttttagttacttcctcccccttaaaagattatttaaaaatatctttctcaaacttttccttccattctcaggggaagaaagagctttctttctaaggttaactttcttgctgtgctttttattatcccttgaccagttagcctcccttgttctgactcctcta

SEQ ID NO: 134980 - DNA, 511 bp, Homo sapiens
tattattacatgacggtgttttctttagcttctgggaactcctcagagcttacagataaaatggttaccgtgagctccaatgagagaccaatgttgctttgccttaaatccacgcttggctagtagttgagttgggttgatcaagctgagctcttgcagactctggaaaggaggaggtgagagcagccatggctgacacctccatgttgggtcccctgagagccatggccatcttgggtttgacgcttgcacgtcagcctaaaggatgcatgatcctggcagctgctcgtgagttcagagagagggagaacaaagttgctatggttgaaaaacaaaaccacatttttttctataaggtatcagaaggtggatctggacttcaagttccagaagcatcagagatagactagaagattctaggctgttggggaggaaaaagatgtattttcctggcaggagttccttctaggatttagggtataaactactctatcgtcatatgctcttatca

SEQ ID NO: 134981 - DNA, 412 bp, Homo sapiens
cgttttgtcacaggagggtgacctaagggcaagaggcacaaggaatgaagtctctcccaagggccgaatatctgttgcatagtagcctggttcctctagaagtgccagtcccttaccagacaccattctgttatgtcagagtgtttacaggactatgtgccatccctttggtgaaaaatatgaattgacatagttcacaaaaatagacaactgactctattcttctggcttcatgtaagttaagttatagtatctcatattgagcttaccgagtttgaatatagcaacaaattgattttgtttaatgacatgctgttacgattatggaatacctagccaaaggctttccagtgcattcagaacatctcattgatcccatgattgctaaaacctgctcattaatatatggacc

SEQ ID NO: 134982 - DNA, 121 bp, Homo sapiens
ccaaggccagaatgctgcctcttgccagaggtggggacgggagggacactgaggactgagatgtctggggacaatgctggcttcacgaaagagagatgaggccaggtgcggtgactcacgc

SEQ ID NO: 134983 - DNA, 456 bp, Homo sapiens
gcttttgccttttgcagcctgtccaggcccagaatgtccttaactcggcgtctccaggacgagctcatcctcccagtgcgtctacaggcccgtctcctgcctcacaacaacctcctttggtccaactcctgctgagctgcttggcagcctctgtaggccacagagttcttaaagtaaagctttccaggcccaccttcggcctcccggcagcctcagcaatcaaactattccctcactgcggccaccgaaagccaagtttctccctgcctcacagcatcctccgaaaactgagcatttgcctcacggtggcctccccaggccacgaatctgcctgcctcccaggcagctgctgcctcacaatggtctctttaggcccagctcttgctaaaagacagactctccaggcacagctcttgcctcctggcaggctctgcaggcccaaattctccaaaagtt

SEQ ID NO: 134984 - DNA, 448 bp, Homo sapiens
ggaagctagttttctctaccttgtattagaggagcttttgaacgcccacataccttagaacttatcaagattctatcttgcatgtttttatgtcatgtcatttgggtatatcttgtttccccaaatagaatgagttccttttagggcaggaactgcaacttacatttcctgtactccccatctagtcctcaaatatctttatcttgctttatcctccaggaatgaactacttattatttcccatgcacaccgtgctgtttcttgcaccagtagctttgctcttgtcactctttctgattggaatgctcttcccaattttctgcccttggttaactcttactcacccctcaagattcaactcagaaattatttttagcaggaagccctccctgagccccaggctgatgctcctcctctgtgggtgtaagctctcatccctgctctgcaa

SEQ ID NO: 134985 - DNA, 219 bp, Homo sapiens
tcacacatgcgaatgcacactcacacatgaatgtatcctcacatgcacaaatggatgctcacacacgcgaatgcatgctcacacacaaaagcacacccaaactcaaatgcacacacacgtgaatgcatgctcacacacgtgaatgtatgctcacacacatgctcaaacacacaaatgcatgctctcacatgtgaatgtatgctcacacatgaatgtatg

SEQ ID NO: 134986 - DNA, 590 bp, Homo sapiens
atatcattagacacagggctaaccaaataaggtaccaccatacactcactgagagtcaaaaccacaataaggtaccactacacacccactcagaatggctaaaatttaaaaatctaaaaataacaccacctgttggtagcgacatagtagtccaaatggagttctcaaacattgctagcaggagtaaaaaatggcacaaccacctgcaaaactcataatttctcacaaagttcaagttaaacatacacttcccaaacaactcagccaactcattccttaaaatttattcaagagaaatgaaagcttttgtccattcaaagactggttcatgtatgttcacagcagctttatatgaaatacttaaaaactggaaacaactgaaatgtccattaacaggtaaatggatgagcacattgttttatgtccttacaatggaatgctattcagcaataaaaaagcaataaactatgatatacatacaatactcacctaggaattgttgtcaacaatctttgatccagaagtaaatccagacttagactaaggttgacataagagaaagctaagccaaaagtcaagaactagctccc

SEQ ID NO: 134987 - DNA, 1029 bp, Homo sapiens
attttattaagaactttaatataaaagatttttagcatcaggcaatcatagcagttagaagctaacaacgttagaagttaactctgttagaggctaactgctgtaagaaaaaaattgttagatgagctcatgaaaaatttgagatcctctcaagccttctcaaaagagaataaaactggcaagacgcagtaagagttaaacttttgggttaaaaaattaaaatatcttataatttcattgagtaaatcaatactttaagacaatttaattttttaacccaaaaggtgggctcttgtggttgtcagtaaactgcctgcattgactactaaaaaaaaaaaaaaaaaaaaaaaaaaaaaaaaaaaaaaaaaaaaaaaaaaaacacaaggaaggaagacaaaacaaaaaaaaaccaaacaaaacacacacaaaaaaaaagcaacaacacacaaacagcaaaaaaaaagaaaaaaaagagaacaagaacgagaagaagggagcccaacaaaaataatgctgagaaaaagaaatactaagaagagaaaaataggaaaaaaaagaagagaaattgagaggtggaaacacacacgtgatgtgactaacacagaacaagaaaagcaagagaacaatgaaaagcaaaaagaaaaaaagagaagaagaagaaagataaaaagaaaacataaccggaccactcaacaagaagaaaggaaaaacaaacacacgatattcacgtaacacgacgatagacaagaacaagacaaaaaagaaagaaaaaagaaagaaaaaaaacaaagagacagagcaaccggagaaaagaagccaggcaagggggaggaaacaagaagcaagagaggcagaaaaccgagagaagagagaggcagcccgaagcagacatacagcagcaaacaagacaagcagcataacagaatcaaacacagagaagagatagaacaccaacgaagagataaaagaaaggggagagggacaaaaaaggacagagaaaagacagaaggcagacacagaggaaacaaa

SEQ ID NO: 134988 - DNA, 390 bp, Homo sapiens
tgcctctgctataacagtgtccttggagtcctgaccatgggcatgaaatatatgagacccgaaaatatggaactgactgtaagctctctcctctggggaagggtgagtcataacccccttttggattcctgatgtctgttaaattcagtgggcattcactgaatggctgccacctccatgacatgaggcaagaatggcatgtaatacacctgtatatttgggagttctggctgatcacttctaaagggtcagggctcacaccaaaaccagtgcttactgggtgaccattttctattcattcatgcaacaaatgtctacctgggcaccttaccttagtcggttcaggctgttataacaaaaacaccacagactaagtggcttaaacaacag

SEQ ID NO: 134989 - DNA, 397 bp, Homo sapiens
tatgaaagtctcaacagtataagaggaaatgtagtatgatattttgattcatacagattacatttattgagtacctactatgtgccagagctgacagtttgaatgcaatggtgagcaacataaagatgatccatggcctcatggttcatatagtctagttagaaaggaaatcagttaaacaagaaattgcaatataatgtggtgagtgctatggtaaaggaaaggtactctgctacggcgcacccaaactgaaacttagagccttaaggtatgtttcctagaaggaagagtattgcaggcagtgtaggcttcactccatagcatgtgtgaagatccagagaagtgagaggcaattaaaatcggcaagcaaaagcatgcaatagtgagacagatgcat

SEQ ID NO: 134990 - DNA, 638 bp, Homo sapiens
gcctattatactccactataacatccaattaaatctgcccatagagtaacattttgtgctactggggttaagacttcaacatattttttggggggaacagttcagcccataacaaacaaaaagaaaattaatttaattatattgtatttagaacaggggttggcaaactatagcccataagccaaatccagcttgcagccatttttataaataaagttgcatgggaatatacctatgcccacttatttacatattgtgtatggctgcttttgcactttaataacggagttaactaattgcaagagagaacttaaagcccacgaaatctaaaatatttattatctggccctttacagaaaatgtttgctagcctattttagaaggtgttaagtgttgtagaaaaaaaaaaaatcagtaaaggggtataagaaacacagggtggttagggaagatctctatgaggaggtgaatttgagcaaaggctacaaggaattactctctatatattaacttatgaagatgtccactatgtagtgttaagtgaaaaaggttataaaacatttctcacttacatgatcccatctttgtaaaatagaaaagtgtgtatatttatacaatgtaaagttatataatacatg

SEQ ID NO: 134991 - DNA, 736 bp, Homo sapiens
ggtctgtctttacccatttgttcatttgaaattccccgtctttacttcccccataaccaggaaacagatctacacccatgtttaacttataaagagatataagtgagtttacataggtggagatcttgtacctggattcacattgtaggttttattacccagctttcccctctatcccaaagccatgattgccatagtggaatttaaagtctttggactaacactgaatcaagaactaactctacaaatgtattctctgcaggaggataagaattccaaatggcttctaattgttgcccatggcttgaaataaagttccatatagctaaagccccagcacaaaaacacttgaagacagccattaggtagaatttcttttcttttttagaggtcttatattggaaatgtaacagttgcaaagatatctaatgtttcaccttaaaatgtgagttataaattcacatttcacattgcctccttcctccttgagcaaacagactaggcaattagtaccaaatagtaactagttatatttcttaacaccgattattgtaagtaatttattaagaaaaaatctaggaagatcaaattatagcttttccagtaaatctggggctttttattcctgatctctctcaacaaggcagtttggcttctgaagattggtcctagctatacttaacaggaaacagatgacgagaagaagccaggaaaaaatacttggaatatagaacaa

SEQ ID NO: 134992 - DNA, 497 bp, Homo sapiens
tccaacaaacaacttctctttgttgtttgggttatgcttaagagccagcgttctgaaaatcctggcttcaggtttccaaactagcaggttgtgctcagagcctaatccttgctggatggtagcacatttcatcacacaaaaaccacagctcctcttggtccttggcctgatgctctgcagcttctttggccaactcaactaaaagtgcagtggggaagccccattcatggtaatttccagagaaccatttgcctcacttggggaaacgggtatagcacaatccctgatagtttctggacaaaaaggttccatgttttcccctatgcttttggcatgtcttggatgattccctttggtatgagtcatctccttaagaaatcataagatatacagcatttaactaaagtttgtaacaccagattctctccagaaggtgttttccttgatttggctttttaattcttcttgatttgaaaaatctttataccaaaaaaaaa

SEQ ID NO: 134993 - DNA, 201 bp, Homo sapiens
gtcacatttgcaaataaaactcatttatgtgatcctggtctccattgtagtgaatattatattaaaccccctcctgactttgaaaaatgctacttagttaagcaaataggacttagaatcccctctcaatttctacttagttaaggtcataagtcatttcactttctttggagtttgctgagccaacttaaagttgaagta

SEQ ID NO: 134994 - DNA, 149 bp, Homo sapiens
tacatgaggacaataggaatagtgtagttgcactagaagtggagagatcttgaatgcaagacatttctaagttagaattattaggatttgaacaatttttctgttggttttttttttttttggtatgcggaagaaggtatgaggataaa

SEQ ID NO: 134995 - DNA, 166 bp, Homo sapiens
gcgataatggggtgaactgacagagcagtgtggaaaaggcatatgggtgtgtgacctggtccctcagagactgccaagagttatttctgtaggtgggattgtggggaagaaggctggtgaggctgcagctactttggagctgagaagcgctctcccctgctctccc

SEQ ID NO: 134996 - DNA, 172 bp, Homo sapiens
gcaatgtgacagcaaaatacagagaaaacaatttgagatttgtgtctagtgtattgtgtaaccattcccttgagtagattttgttgtaaattgccattgattttagataagaaaaggaaagttttcctcatattaaaaacttggaaatgcatcattggttttgatttttttt

SEQ ID NO: 134997 - DNA, 566 bp, Homo sapiens
agttggcttaaagtacttcatgatttatgaggggtgattgctgacaaagtactgggaggagccgttttgagtcaacacgaccatttgcatctgccttcacttgctctcctctcttattaaattgagctatcctatgtgtgggtttttatagtaatactagaacactgtgagtcatacagagcagttgtgccgtcttcactacattctcaccttgctgtgagctggctacatgccaaaaaatatacattttagtaggttgctgatttttagattctttgaaggctaatgttcatagctcttactagcaatagtctgggtattagaacaaaaggagctgtctatttcagtatatttctttctgaccactccccagccccttaccacaatttcttctccagctataaaatctcctgtataactgcagatgatataaaacaaaaagaaaagtagagggaaaagtaagggcactatttatgaaatgttttaattgacactaaatattacatgtagcttaacttttcactatatatgatcagcccttaatgggtattagtgaaagccctaca

SEQ ID NO: 134998 - DNA, 116 bp, Homo sapiens
aaaaatgcatagtgttaaaaaaattaaatttagcctgaggctgtctccgtaatttgagtccctacctaaggaactgcagcctaacctaacttagtctattaaacacaccgaaagcc

SEQ ID NO: 134999 - DNA, 561 bp, Homo sapiens
tctcctcatacttcattgagaatagagaaataagtctttcatcttctcaacacgaaatcttttaagtcttcctatatctgtacctatcttcctttaacaaaaatgtaaagactgcttcctcaattataaaaggagaagtactctccttttaatcattgactaatcattaagcattggttatgtatactcaggaacttattcatatattctttctcaagtttatttcttctgtcatccccttgtgtctagtcttcccctcctctcctggatcatttctatcagcatacaaacatgatcaatttaagaaaacttttgattccgcagcctcatccagttactgcctcatttcattgttctcattttcaaattattcaagagttactgataaatgccaaatctattcccatatctccatttactcgtaagtccaattcaatcaagctccagccccatcatcatacccaaatcatttatgtcaagatcacagccactgtcactggtccttctctcatttgaactttcaacactagtaaggaattgactaatttctcctttcggaaa

SEQ ID NO: 135000 - DNA, 169 bp, Homo sapiens
cttgtatggctgtttgtccccatgtctgagcacacagactccctgggggcctgcaccaacaagctcagtggcggctgaggcctctcatatcaaggcttttgatgcctgcacatcctctgggggagggcttcagcgcagcctctgaggagctccactaggccagggactg

SEQ ID NO: 135001 - DNA, 708 bp, Homo sapiens
gactaacaaactgttaaactaagtactttgacaaatacacactcataatgactaaaagtcaaaaaaataccaaagatagttgaatttaatcattattgcccatgtctgatattctattgatgggctagtaatgtttggatgaataataaagacacacataattcacaaattattacatatgtattctataaaatttatttttcttgccttcttttcagcaaaatcatgaattgtggtcttataatccagaacacaattatattctatgtcattataaatttataattatatagctgtagtctgtttaaaataatgctctaaaagattaaaaagtatttgaattctaatgtagaaaattttgaatatatttaatagaaatataaattaaagtgagtgtaaacaattaaaaacatttttgtacatttttatgctttccaaaaggttatttttcttctaaaatattcagaattattgaagccagagaaattagtcaagaaaaagatataaaaggcatccagattggataggaagaagtaaaatgatctctatttgcagatgacatgggtcttacatgtagaaaagtctgaagattccatcaaaaaactgttagaactaataaacaaattcagcaaagttgaaggattcaaaaccaacatacaaaaaagcagttgcatttatatatactaacagcgaatatctgaaaaggaa

SEQ ID NO: 135002 - DNA, 356 bp, Homo sapiens
gctgggcgtggccactggcccttccccaggcttacagacccaggagctgcagctcagggccagaaagagcaaagcaaataggacagagccctcagaagggtgcagggagagggagaccccatcaacccaaccaaacaagtgtgggaaggaggccggccagtgcacctcagggacactctgctttatctcagatacctcacagcacctaagctatcattcatccacacacaaagtgaagattttcaaagttaggctttacccgtgaggtctggaggtccatttatcttcacagagaaaccgttttaatccgcaagaacctgctaaagatacatgtttctaaattaaagatgtgaatg

SEQ ID NO: 135003 - DNA, 267 bp, Homo sapiens
gggtgcagtccttcccattggagttggaattgggtcactaccaggagtaaattggcagttggagagcaggatgtttaagttggttattaggaaggggtataattactggtaatgacaagatttcgggatgaatatcagagtctgtgactgaggtgggatagaggacaagtttattgggggagagaaggtcaaggaaccaaatgagcaggatattgaaaacgattatctcagtgtggcccttggaacagcagcaccatcagcaccact

SEQ ID NO: 135004 - DNA, 1038 bp, Homo sapiens
ctttctgcaaaatgtgattcaactgagcacctaatctgtgttgggcttatatgtgcaacctgcttgtttccttatgaaaatagcttttacatacctcatataggctgcaggtcttggaatcctgagtcatagaatgtcagatcttagagttggaagggatttttaggctattggtactatcctcattttacagaaagaaccatcttaggcctgaagcaggtatgtgatttggtcaaggtcatagagcctaataagtgataagaataggtactctcacctagccgtgctctctttcaggccatacttttcacatgtgaggtactcagatgctctatgatgataccgctagccatacgtttctgtaaaaataatgtttacttgggccagacatggtggctcatgcctgtaatctcagcactttgggaggctgaggtgggtagatcatgaggtcaggagttcaagaccagcctggccaatatggtgaaaccctgtctctactaaaaatacaaaaaaattagctgggtgtggtggtgcgtgcctgtagtcccagctactagggagcctgaggcaggagaatcgcttgacccaggaggcagaggttgcagtgagctgagatcgcgccactgcactccagcctgggtgagagagtgaaactccatctcaaaaaagagaaaaaaaaaaaaaaagataatgtttacttaaacataggtctgggactcttgtgaacacattaacagttaacagtgaggcagctaagggattgcttatatagctaggggatagcctgaatgctgatacacctcaccatagcgaagtatttaacccctgaaatgggaaccacatcataaattgtgaaagtattgattgcctttgcacatgaattcctcaccactttctgtggtgaattaggattcctactcaaaggaaacagtaaaaacgtcttcatagaggattctccaactttggaaatttcttaaaaagaaaactgattaggccgggcgtggtggcttatgcctgtgatcccagcactttgggagg

SEQ ID NO: 135005 - DNA, 224 bp, Homo sapiens
ttcactcacacattcacacacactcatacagcccagcaagcagcggagcaagggtgaggactcagctcctgcctctagagctctccctaggctgctactctgaggacacagagctagggagaacctacaggtgactgccttccttgcagacaagccctcatctcacatggctcctttagcttttattctctctgcccagagcacaccctctgtccagcactgtt

SEQ ID NO: 135006 - DNA, 318 bp, Homo sapiens
gagaggaagaaacaacaggtgccaaagatgaatagactgttgttatccatttattgattggaaaccaatcctagatttctcttcttcctgttttaccaagtggcctctgcccgagtgtaatttttactttttagtgccgtctgcacctgtggcctttggacctaatgtttatgacagatgggccaggccgtgtttgcaccatttagtgggtactttccttctgtagtgctccatgccaccgtcgctgtggcacgggcccagtgggcatgtgtgtggggagaagcccacgtctgcagccattgttcagctgctgtcctc

SEQ ID NO: 135007 - DNA, 703 bp, Homo sapiens
gggcatggggcttggttcatttgaccttcatacactcacataaccacttctgttagtaccacccttaattaaacattatttttcatttgtcatcagatttggggagttttcagccattatttcttcaaatattctttctgtgccttcctctcctttcattgtggaactcctattatgcatatattggcataattaatggtgtcctaccagtttcttagactactcattttccttcatttctttttctttctgctcctcagattgggtaatctcaagtgacctatcttcaagtttgctgattccttctgctgttgagcccttctagtgaaattttcttttaagttattatacttctcaactccagaatttctgtttggctccctttaaaaagtcattttgatctatttgttgatcttctctgtttggtaagacatcattctcatgatttcctttagttctttgtgcacgattccctttagctctttgagtgtatttaacatggttgattaaaaatctttgattagtacatccaatgtgtgggtttcctcaggcagtttttactagttgccttttttcctgtgtatgggcaatacttcatccctttgcataccatgtagttttgttgaaaactgtaatttttaatattataatgtggcaactctggaaatgagatttcccccactccccagggtttgttgctgct

SEQ ID NO: 135008 - DNA, 261 bp, Homo sapiens
ctctcttgctttgaccgactcccctttactcagaaaactgctcattcttcacttctccaggatcacttccctgaccccaagactagattgggtcccttgcttattcatggttgtagcacgctgaacttctctttactaatacttgtcaacgctgaaattctccatttacttgagcaattatgtcactaatgtccactcctccactccatggtaaagttcaggcgagcagggctccgaatgtgctctcattgcctctccagc

SEQ ID NO: 135009 - DNA, 436 bp, Homo sapiens
aggggtcgtaacagttcagagaagacacagcaagactttatatctattgtgtcatccaggagcagagagagcagggatggggtatgtcatgagctgggtgtgatgagccccagagccattcaacagatgttgggtggggttactacagtagaacatgccctttccaatcccctagattcaggccacagaatttttggcagagaggagataaaaggagggatttctatgcaaggtcattttgaagtctatccatagtgctggcagcgtgaaccactattctatacacacaaagccatctagataacttactcatccattcatccatccacccatccatccatcctctgcttatctattagtttattctacaaatattggttgggcatatgctatgtcgcaggcaccctactacacactggagatacgattgcaggat

SEQ ID NO: 135010 - DNA, 556 bp, Homo sapiens
aaggaaaaacaaaaaaaagactcagttttcttcaagtgtgaggcaccttgtctgaggtgttcatgatccgaagggctctttatttaatgatgtcgacatcgaggtaacaaaacaggtcatagttatagagggagtttctccatgtaagagagagaggggatttggaatacactccaagcatctgtgctctccagagttggtgttcagttgctttctttcatgtgtgctctgtgcagtcatagaagacctctctctcctttgagcctgaaatgctgagtccttccaaattggagatggtcagccagtggttcctgggccagatctgatccatagatgtgtttcacctggctaacagtagtccatgtttaacttcttaaaattagttgccaacagcacaaattgcaatatcttattaaaaaaaaaaaacgttttctaacctcccttgaaaagccagaaaatctggcaataatggcctcttttttcccatatggcaaaaatcaacaacctgagtaataaatgtctccttaagactggacattcgctctcaatttattca

SEQ ID NO: 135011 - DNA, 247 bp, Homo sapiens
aaattgttcatgtattcattgagcagagatttactgagctgggcctatgccgggtgctgaggctgctgctatgaataataataataataataataataataataataataataacattggggatggtcatgataggtagcactgtactgagtgtaacaaatggattttcttatttagttcttacaggaattctcagagttcagagttaagtacagatttcatccccattttattatttgtatttatt

SEQ ID NO: 135012 - DNA, 926 bp, Homo sapiens
ttgctggtcatacaaaatcaaataagggaatatacagtctcaggcagagaaacagacaaacacataaaaacacatgcctacaacatggtggatgtcatgacagaggtatttagtcacaggcatgctaggatatgaaaaggaaaaggttatctcagttagactcgtcattctgagaagagtttccagaggaggtcttacagaaagacaatgtgatgtatagctagaagaaagcaagaagaggagaaaaggtatggaggagtggaactgcctgatgtgttcagaggtcccctggtagtatggtccctatgtgtgtgtgcctgctcacatgtatacaggttgtggagaagagagaaaactggccaagtcacaaggaagccttcagtgtgacacttaggagcttgaccattactctagaaattgtgggggccattgaacagcattgtccctgtttctttcaatgaaaccactgttctcccagtcatgtagacttgaaaccatagtgtcttctttatttattttttctctgatgttacccaaactgtttaataactacccttttaattcatcctttagggtgactctagacattccctattcttcctagtcttatgattttgcccaattttagtctcatcttctccatgctgaaaccacagctgtgtttccctgaatgttctccttccctccttctctcctgtcctccaccctgttctccccctccttgagaagttaacctacttaaaccactttagcatcagaaacttttagcagctttctgttactcacagtatttccccccaatacaataaataagtatgcatttggattggaatgcttcctttggctatccaagtccatgatctagcactaaccaattacctgacccaccgtctgatacagccaaactggtttctgctgatcctcca

SEQ ID NO: 135013 - DNA, 219 bp, Homo sapiens
ttcctaggtccattgccaccttctgaaaccttaggccccctcctcctcctcccagactgcctattttgctgccttttttgtgaagcttgttgtcttgatttcctccccaattgaatgggatttctctgtttcctttgattccccccttaacaggtgtgctctctcttggaactttttgtgagttagtctctcgcccccaaatctcattggactgtaagc

SEQ ID NO: 135014 - DNA, 685 bp, Homo sapiens
ctgtgagtatgcatcataatttttacctatgacacttacgtacatagtacctggcatagtaagtgtatagtgagtactcagagtaagctttgttattgcttgtattgttattaatcttaatattaaatatgatgacagggccgggcacggtggctcacacctctaatcccagcactttgggagacccaggcaggtggatcacctgaggtcaggagttctaaaccagcctgctaaacatggtgaaaccctgtgtctactaaaaatacaaaaattagctgggcatggtggtgggcgcctgtaatccaagctatttgagaggctgaggcatgagaatcacttgaacctgggaggcagagtttgcagtgagccaagatcccaacactgcactccagcctgggcaacaaagggagactctgtctccaaaaaccaaaaaatctgaactccaggaaggcaaagtgatctaaatttcaacagaaatcttctttcacttttatgaaccccttttgctttgttaaaggatggattctaataaaattctaataaaataaataaataatggacctggtattttttaaaagagcaaggcatcatatcatatctcagatattgccaagtaagacagccactttcatgcctatgtgtatgatagactcatacatataattatgtataactataatatttt

SEQ ID NO: 135015 - DNA, 277 bp, Homo sapiens
ttgtgatcagcccgcctcaccctcccaaagtgctgggattacaggcatgagccatcacgcctggcctagcaagtttatttttattatttttatattttactctactctcaaaaaatattcccttctacctcttctctcgtctaagctactaccgctatctttggaacaccttatctttgcttctgttgttctctctacagcttattttccgcataaagccagaatgatgtttttaaaaatatagatgataccactccccctgcttaaatttctcatt

SEQ ID NO: 135016 - DNA, 390 bp, Homo sapiens
aggacaacccaaggtaaggtgggggacttggcctttatacacttgcattgagatttgatgaaatctggctgccttgaggagaggaagtcccttcggctgactctgaaaagggctgagaggcaggacatagtggctcacacctgtagtcccagcactttgggaggccaaggtgggaggattgcttgagcccaggagtttgaggccagcctgggcaatatggcaaaaccctgtttctacataaaatacaaaagaaatagccggccattgtagtcccagctactcgggagactgaggcaggagaatggcgtgaacctgggaggcggagcttgcagtgcgccgagatcgcgccactgcactccagcctgggagacagaccgagactccgtctca

SEQ ID NO: 135017 - DNA, 425 bp, Homo sapiens
actgaagtgatacccatacagcttctgctcctatacaaccttaggctgcagggttccacccacttaatcaacactcacatctcagcttagtcattctttcccagagcaggaccccagggaatgctatctggtaccagagggttctagatttaggaacaaggggtgagggaagcagccctctctcttaaacccaaaggccctagtgttgagtcctggctttatctgccttccagaaatcttcccttgttgtctttttcctgacagcagactttggttacagccaccgtatccactccactatggactgaactgtgttcccccaaaactcatatattgaggccctaatacccaatgtgactctctttgaaggtatagcctttaaggaggtaattgtggttaaatgagatcataaggagaggactcta

SEQ ID NO: 135018 - DNA, 773 bp, Homo sapiens
gtgcactagcaactgaagttaggaaggctcgggtggacgctgccaaccagcaatccaatctgcctgatggccaaccctttgactgctgggagcctggagctttctgaatcagacaacttccagacttcacatgtgctgccaagcacaaggtatattctggaaaagaagaggaggaggaagaagatgaagaagatgaagatgaagaagaagatgatgatgatgaataagttggttctagcgcagtttttttttcttgtctataaagcatttaacccccctgtacacaactcactccttttaaagaaaaaaattgaaatgtaaggctgtgtaagatttgtttttaaactgtacagtgtcttttttggtatagttaacacactaccgaatgtgtctttagatagccctgtcctggtggtattttcaatagccactaaccttgcctggtacagtatgggggttgtaaattggcatggaaatttaaagcaggttcttgtaggtgcacagcacaaattagttatatatggggatggtagttttttcatcttcagttgtctctgatgcagcttatacgaaatactggtcgtcctggttaactgaataccactctgctaatttgcaaacacaaccgagacatcacagcagacgagaacacacttttgtggggcccatttggccccccgcggagaaagcctttaagaaaaccatgcgcttgtgagcccgggggcccaagagggaacatgaacctgggcgcagaaggggtacccacaggaatc

SEQ ID NO: 135019 - DNA, 532 bp, Homo sapiens
tgagtgctgcgtcccaacatcacctttcctaatccctgctgtgccttctcctggagggctggcaccagagagcattgcctggaaagcagagtaatctgtgctcttgagattttagagaataaggatggatattccttgttgggcgtgacttttagtcttcagagtaagaaagcactgacacagtatattgatcaggtttgttcagtggagtgtagtaaaggtcatttggtgaattccgtattttcaaatatttaggtttctaatatgatgcgaatggtgttacgtggatctgtgttgtactgacgctgacattttgactgtcgtttctaagtaacgtactactacatttggataaaaagcaccgtggcttaaccattgaagataatgttacaaacttagatagtggttgagctagcaagtaactagtgagaggaactttagctctatatgcaggagatcagagcacagggagctgcaccctggctgaccttccttgtggctacccacgccttgcaactgaagagcggtaatt

SEQ ID NO: 135020 - DNA, 428 bp, Homo sapiens
taaggagaaaggttgtcactaattttggtgctttttgagctcaaggtctttggaaagtgctccagtgggcagcccacttcatccctgcaataccttctgcaaaggtgtgacaaactttacaccctgccattaactcaattcttagggtttctcttctcaacctggacttcccaattttggctctcataatcactgctttcgctacatctcctgggaatcatagaacttaattggccagtctggcttctttgtaaacactaccctctgtaagtaagttaaaggagctagtccttgaggatcactgactactggaaaagagacgttcacttggttttctgtattcaaaagaatgttgaaagttgtcttttaagaggggaaaaacattttacccttttggcactcaaaaataataacataggattttaaca

SEQ ID NO: 135021 - DNA, 758 bp, Homo sapiens
cagagctctatgttaagctaaaggagaaacaccagggatttcaccctcttcagagtgctgtgaagtgggaaataagatcatcaactgaacataaggatgggtgaggcttaaggagagagaagcgctgaagtgggaaagtgaaggcactacggaaatgcaatttctgattagcgttaaggggccacctggggttcaacaacaagcagacttaagaacaaaagtgaagtggtggcaaagtgctggaccagatgttagaagtctccaatttgctctcgacaacaacaatccacaagtaaccctgagaaaagtcatctctgtttccccactggtaaataatgaacatctcccaaggttaattttcactggccctaaggggaggtggtggaggaccactgagtcaaaagtgatccaaaagctcataccaggagaagatttttcaattcagaacttgcaactgatgaccggtgtaaaagtttggtgaggcaaaaggatctaattatccagacgtatccacagagagaggaaccagatgaaatgcggaaagcacggttcaccttcaagagaaagaagtaggactctggggttttaagccgaggcatgaaatgtaccgattaatagcgtcattttgtaaccacaggtctcaggagttttgggaaggttagtatgagcttgtcagcattgcttattaataacagtgagattgctgctttgcacctgatctcagtcagacctcagaggctcagccactggggctggtt

SEQ ID NO: 135022 - DNA, 603 bp, Homo sapiens
gttcattaaggactctctcagaatcagcaggaatttggccctgataatttgttgatgtcagaaaaccaagaataaaattcctttagcctattccttcagttgtcaggaatttcttactaaattagctttctgcccacaatagcatgaatttattatctcatttgttatgaagccaattgatgattctgtactgaattattaaaaagtagaatatctgctgatcataagatttatttggagtttaatgggcagttagatgagaacactcatggaaagtggttattatttcaagcatcgttgccacagtcctacacttgaacctcagaggccacagaatatagaatgtttttgttctctaagttttgatatatggagaaatgggatagggtttactgagaatgctaaatacatactgaaaacaatagaatagtaatagtataccattaaaacagctggaacctccacagttacggatgaaggaggaacaaattgttagctctttcaaaactctacattagtttcttatatccaaagttcctggagttgcctgtcagctttgccttctgtctctgaggcaagctcaattatacctgtgtctggtcc

SEQ ID NO: 135023 - DNA, 392 bp, Homo sapiens
ctcatctctgttaaacatctgtgttgatcataggagaaagtgtagcaagaagagctatacttgtttaagtactgaatgtttctctttgaaacagaggcccaggtcattaagaaagaaaccattataagtttcttgaagactgatgtttattgcctcttcttaagtaattataggcatatagtgtttaaaaaaatatattggtacttaccttatacagagtcttaaaagttcaaatcttaataaagatgtttccccatcccagggttcttagttttcctctttttttttttggttattagtgtacttcagtagattatctttttgaaattgtttttgtttttatctaacttaaacatggatttacttactttgctctaatgagagtattatgg

SEQ ID NO: 135024 - DNA, 320 bp, Homo sapiens
tgggctgacagaggcatccatcacccgcctgggattccccccatccctccttttaccttcccccctctccctctccctctcttggcctataaacttgccggggtagtgggggttaatcagagaggaattatgagccaacatccccagcaggaggtgcatttaatgaaatcatgtgtgatttattttctgggggaggttggggcgagaagaatctgggacccacacctcctggcttccagtgagtggctgccttgtgcaaaaaaggagaatagtagacaaacaggaacccaggcccctgctcccatgccacagcccctgcc

SEQ ID NO: 135025 - DNA, 175 bp, Homo sapiens
tagagagactctagacatacggtcagaagtgcttagagacagcaaacgtatagacacgtagacatgaatgagaaaagtgattctaatgaacaggatgaaagtgtcccagaggaaatgccatatgcttgcaaaaataacttcatgttaaaggcactaccggagataattcacaaca

SEQ ID NO: 135026 - DNA, 104 bp, Homo sapiens
ggctctcaaggctcattcaaccctcatagcatcttggaggtgggaaagtgaggcaaaagaggttaagaaacttcccgaggccccttgagcagtgtctggttccc

SEQ ID NO: 135027 - DNA, 461 bp, Homo sapiens
gagatcgctgcactccaccctgggtgacaagatcaaaactccatctcaaaaaaaaaaaaaaaaaccaaaatgggtggtggtctttgacaagcaaaattatgccagctttacattttttttgtttgttttgtggttttagttttttaaaaataaatagtgaatattaattctgtatccacacccagtctccctcaacttcaccagctaggtcagttgctggtggagatgagctactcccccaacagggctggacacagttgggagaagagggggcagcccctgggtgtggtgcggccgttgccagccccaaccctgtcacttgtgcttttatcttggtcccctcccatcgcttccgttgttccccacaaccgtgtgtggctctgtgctggtcctgggtctcaggaaagcctcccttcagagagagaatgtgtgttcctactgcccctcccatttccctctat

SEQ ID NO: 135028 - DNA, 364 bp, Homo sapiens
tcagacaaagtaggtcattttagtgcacgtttatgagactcatcattaatttatctaaaatcaatttatacataaatagttctataagtttgttgtatagtgtgttcaactcatagttatttttacttatcctgagtttataccattgctccatatacatcttaattatttttactggaggattacttatttgggaaatctactctttgtttctgtgagtgtatttcagaagccagcaaaatttttgtaaagaaccagatagtaaacatttttggctttgtgggcaagaggcaaattcagaatattatgccagatacttctataaaaagagaggaaacaaatttccaaaatataggtctgctaa

SEQ ID NO: 135029 - DNA, 724 bp, Homo sapiens
cagggaacatcccccaacacgctcccagccccagggatctacagatcctcaaggttccactctggatcatttcagaaagatactgaacttgtcagtgggtcaaggggctcctggggggacacatactgggctactgccagatgggaaatggccccagcgagcctggggcagggaagacttctgcaaggcagtgtctcctcaacacagcctggggaagccttgtgttccctcagccataaacctccatttgctcaaagtttatgcaccatagggttgaggggggcagcagtgtgggaaggaaacacaccaaatatgctccaggagccctgggccactgtgtgacttctgagggcctctgaggacttctgacttctgtgtgacttctgagggcctcagtttactcggctgtaaactgggcattgtcaagagtccatctttctcagggtggttgtgagggccgtaggcagcgacccaacactccctgccatccaggtgggctgcggggccctggttctcaaccctaatggggcctggggctggtctaacgcgcaggggagctaaagaacttccccttgcggctgtggggaaacacctggtgttcctgggcccagggcgagcctgtgtgcattccaggaaaccacacccaggggagagggtgccaggcaccctggggcccccgcccacctgccctccaaaaggcccccaggcactgctgagggggctc

SEQ ID NO: 135030 - DNA, 340 bp, Homo sapiens
cccttcaggtctccatcccggattcattcactccacaaagccaccctgggggtctgcatgtaccacccgcagcacaacacgccagtccctctggagggagctctggagggctccaagctctgggcaaatgacccacacctgcatttaaactgggcctccctgctcccgtttaaccaccattcatcccaagtctcaagaaggcaacagaaaatgccctgtttggagctttgacagaaaaactcctctctcaagaaggtctgagttgatggttcgctttcttcgaaaacaagaacgatgctttaagttgggagcagccttcgtgtttggatgtggacaccta

SEQ ID NO: 135031 - DNA, 144 bp, Homo sapiens
gggtattatttcctggtcaagacattaggagctagtgtgccacttgcattctttccctttccctgccacagtgactttgggggccttgtgtttcagatggtggggtctccattgggctgatccaggaaggactgagtggagtag

SEQ ID NO: 135032 - DNA, 696 bp, Homo sapiens
gagagatctgattgagttgatcatagtggtttcctggcatcaatatttttctaagagttccctgaggtgatgggaatgttcagccaggggtgagaatgactgctatggaatgcttcataggaaatgttagctcagcctgtctgacttatcacacatgtgactaggcaagcttcacagatggtgaaattttattctaggactgtgggagcctcgataagtcccaggggcttgtgctcactctaaaaaggaggaatcaaccctagggaatgagtagtctggagacctaattgtatttaaaataatcagctgtgagatggtttgaacacttcaggaataaaaaaaaaaaaaaaaaaaaaccgtgtgtgtgcgggcgcgccctgggcccctggaaaaagctttttaagacccatgcgtgtgtggggcgcgcgggggccccaagtgggttaggtggaccgcgggcacaagaggcgtgttctcccagagggagaactcgggggccacggtaacaagagtggctgggagattttctcacgccccaaatataaacaacgcgccgggggggggaaaccgccagaggcgttttcttggaacaaaatctccacgaatgggcagtttccgggaggaggctaattcacgaggggactttattcacacgggggagtcaaaagcgagaggtagaatatcaaattaaccccg

SEQ ID NO: 135033 - DNA, 199 bp, Homo sapiens
tgccctcaggcctctaagtagaggggcccaaaacccatagacttagcagagttctcttggccatggtagcaggaagtaaacattgtctgggaaacggtggccctcctgccccagggagccaactgttaccaatggtgctgccctcaggggggataatgataccagctggcaggccatgcagcaggtccccaggggcctc

SEQ ID NO: 135034 - DNA, 750 bp, Homo sapiens
aaggcagtggtatcatcgcagagggcccattacggccgcaattcctttctggtaccataaataaatggcaataagaactgtaaaactgaaccagcatgcacccatacaaataagagattattttttgaggatagctactgagcacagaagacagaaaagcaattccttcatgagaagcacaagttatattacacattcttacacaagcaaaatggttttatctgtcatagtttgtacacatacacacatgcacatatacacatacatatgtgcgcacgcatgtgcacacagacaccaagttaaaagtcctgctgattcttaatgaccaaatccaactgttcgtcgtggggagtggcagataacacttcctacagttggatgcaattcttttgactttttgacttgtctgtaatgaactgcctttaatgggtgaatcatgtttttagttttataagaaacaagaagattagaagcaagtaaacaggaactctatgatcagtagtagactattatagtatattcaatagtcatatgtttttctccagttatacaatttacttgaatgatgcacaattaatcaattattattattataggagatggggtctctctatgttgcctaggctagaataaagtgtctattcattggtgcaaacatagctcactgtagccttgaactcctgggctcaagcagtcctcctacctcatcttcctgagtagctgggactacagttttgtatggttatatct

SEQ ID NO: 135035 - DNA, 313 bp, Homo sapiens
catctctactaaaaatacaaaattagccgggcatggtggtgcatgcctgtaatcccagctacacgggaggctgaggcaagcgaatcacttgaacccgggaggcggaggttgcagtgagccgagattgcgccattgcactctagcctgggcaacaagagcgaaactcagtctccaaaaaaaaaaaaaaaaagaaccaaagcagagagataagattctcatgatattcaggtagatagaaagacaaaacattatttttaataaatgaaagcagacccagagttactattataaatgtatatacatagaacatgga

SEQ ID NO: 135036 - DNA, 528 bp, Homo sapiens
tgggggtggagctggtctcaggttttctctagaatgacttggttgaatcctctcctttttgttagggataggaagtgattctttttcgttatcttcactttaattaagaaatcttgaacatatcctgaaaagtacctaccatggtaggacacatgcccaggtactcatgaaacagagccaaatgaatgttcactaaataatccatcattgccttcttcccggcctcccctgtggttaatttggggtcgcatgattagtgtgggccagtggatggtgagcaggaataatgtaggtgccattgaaatttagggcttcagtttttaccacaccagagccgagtccagctcaatgcctgtaatctagctgtcatcaatgtcaactttttccatatatgtttggaattgctctctctcaaagaaatacactatgatagcttctctcctccatcctctcacacccaccctcaccacccacctggaagtaacctctaccctgaaattggtgtgggtcatcccccttttatattaa

SEQ ID NO: 135037 - DNA, 241 bp, Homo sapiens
gactgcatcaacgccgcacctgacgatcaacgccgcactgactgcatccaacgccgcgcggacgctacgccgcgacgagtaggagggccgcggcggcgggcgtagaagcctagggcgcgagcccgggtggagcagccgtcggtgcagatcttggtggtagtagcaaatattcaaatgagaactttgaaggccgaagtggagaagggttccatgtgaacagcagttgaacatgggtcagtcg

SEQ ID NO: 135038 - DNA, 169 bp, Homo sapiens
cagccttcgggtcttgtccaagctctcccagggcaacacgtaccagagtggaaaacgccatgtctacccgccctagcaaattccgctgaaatgtcttcccagacttttacttacgagacaggcctccccttcccaagggccccctgctgatcctgtagggccattccct

SEQ ID NO: 135039 - DNA, 753 bp, Homo sapiens
atagaatgagaagagaatttattaccaacctatgggaatatcagaaattaaagcgtagacagacaaggagactacaaaggagattaagaaggaacagccagagaaagaggtcagaaaacagtaaaagtggaagagccaaagccattaggagtgagtttcaaagatagaatggtcagcagtgtcaagtgcattcagaaccttaaggaacaaagtaataacatgagcatgatgtgaccctgcagagaggaaagcagggaatactctgatctcattcttttccctctggcaaacccaagtagaggccatctagcaagggagtttattgacgtaggcaactgttggacgttgaaatgctgtcttacgttcatacccacaattatttcaccatggaaaagccagcaatacgcagagtataattagcttgtggcatgtatgtggtacattacgactgagaaatttgtgttcaccatgaccacaaagccatgccatagagaaaagatttgttggtttcgctccactgttgacaggaaaacgtggattagggttagtcttcatggatccagtcgtgtatgcaataaagaaaggcatttactacacaaagttcagaggacttcgaaaccattctacacacagtttattcacatcctgattatgatttagttgttgaaggaaataattaaaatcataagtataatcagactgtagccatcaagtgtgtgtgtttgtgtatatatatgtatatgtgtatgtata

SEQ ID NO: 135040 - DNA, 488 bp, Homo sapiens
tgtttatttctgtgttccctaccagatggtaacttccaagtgagtaggaatggtgcctgtcttatttgccaccgccctcaccccatgttttgcacagtgcatacaacaactgcaagtgttcaataagagctgctgaacaaatgaatgaaagattctttctacggtgagtgacctggagcaaaagggggcaggctctggagggccccattagtaacgatagtggcaagggagagctagctgagcatttttagcagaggagacacacagacttttattacaaaaattctccttcttcggatatgtggaaattgactttggggtagcagaaggggcagactggaggcagggagacctattagaagggttctataaacactgatatccttgctactaaaagtgtggtctgtggaccagcagcttggtcatcacctgggaaactgctagaagtacagaatgtcagacctgtcatctcagaatctgcattttaa

SEQ ID NO: 135041 - DNA, 771 bp, Homo sapiens
agtaagtactcaaaaaatgttagctataatgatttatattattaagtagtcctcatgactgtgtgattaccatctttttaagtgttttctagtcaattcctagtaactggagctgtagttcttagtagctggagttatcaacatatctgccttctgtgctagtaaatttttatacatctaaagttttaaaacctctgcataaacattccccctggaaaactagaatcaatggtattttattattcctacattgacattttaatagccaagaatggcttttaaaagaattaggaagacacatggcatctgtcagtcttgatatcatagttcctgttatgtttctgtttccatgtgaaccctgttttttcaaaagtttgtaagtcttttgctccatggtgagattcagcaacaagtttctattccaaagaacaatatttgtcctacttaaacctactctgatttccattttctttgctcaatggtttgtgcttctagaacttgagttctgtttgatgtttttgcaaatacaatttttcatatttggtaattttgaaaaacttaaaagctccaagtctagcacgttgtcctttgatttttaggtagtgagctgcttaatttggttttaatttaagataagggtttagaaaatattaggaattcactagaaatatatctctgttctacaaactaggatcctaggctgtattgggtgtttcttccttatagagaaaagagctgattctactttccttgaaaatttaaagtataggg

SEQ ID NO: 135042 - DNA, 274 bp, Homo sapiens
tattcaaaaagggtagttgttacacgtactttgaagccagtaatcacatatttgtgtttgttactgatgtcttaatgtcccaaagttgctctaagtagttacaagaacacagaataaaaatcatgagcttggggaaacatattttctaaccagtagaacatcaatatgccacaaatattttctctactgacaaactgtaatgaggtaaaaatgccttcctgcagtaaaatcttaccttgaggttagatgccatctatctgtagctaaggcatcc

SEQ ID NO: 135043 - DNA, 142 bp, Homo sapiens
tctataataatactttcctggagggattctgaagaatatctccttgaggattttaaagaagatgggaagagaagaaaaagtaacacaagaaagaagagggaacaaagatggaagacaataaaacacatcaaagagaagaaaa

SEQ ID NO: 135044 - DNA, 777 bp, Homo sapiens
gtggtgaaacaaaatggggttggagatatttaaagcaggtgtgtccaatcttttggcttctctgggccacactgaaataagaagaattgtgttgggccacacataaaatatactaatactaatgatacctgaagagctaaaaataaaatctcgtaatgtttaaagaaagtttatgatgttgtgttgggttgcattcaaagctgtcctgggccacatgcattggacaagcttgctttaaaacatcacaaccagagagttgtcactatttgaactgtccggaggttcctcggaagacaccactcacaaggttgtctttatttgacctgactcagagctcttccaatgcagaaagtattttcttcagggagagcatttgtctaaaacaattataggaagtgtttaactttgtggctgcccgaggcagtggttaagagttggggcaaacaatagactaatcaaaaagcttaaaaggaaatactgggagattagatattcatagggcctttgaaaagctccagcacattcctgaaaacctaaggaccatgtacctctctagggctatgctcctacttaaaacccatgtatgtcctaagctcccacttgtggctgaccttcaggctctgtggaagcaagaagtaaaggataaataaggcattgattgcctggctgagtgctgaaggtgtatcccaatatgcaaacagaatccctcagcgaaatcagagagacttactggttccagtcatttaaggaaaatgttgtccactcattagctgacca

SEQ ID NO: 135045 - DNA, 432 bp, Homo sapiens
tagcacttgaggcgacgccctcagcacgaactgggaccctagtgccttgggatccggagtatagtgcttgattctattgagaagaaacgaggctaatgtggactgggagacacacgggacctaatcagcctcaagttagcccttttgaagtaggttgctgcacctgcactttccccctactcgtccactagttcaagatttacaagacgttgacaatgagggctgaccagtcctggttccactcctgcagctggggggcttctcggtggacccacactttttttttgagacagggtcttgctctgttgcccaggctggagtgtagtggtgtgatcacagctcactgcagccttgacctcctgggttcaagtgatccttcctcccaagtagctgcaactatgggcatacaccaccatacctggataatttttc

SEQ ID NO: 135046 - DNA, 338 bp, Homo sapiens
gtcaaagcctgaactgaagaatccatctccttctgttccaggacagaacgttagcaaatttaggtatagactggagcagcccaaggtcctgggctagaaggaccaggatggggaagaagtggcctctgccattctggaccaagctgggtgccttggggagttctttcttgacctctccgtactaggaggataccaccctaccaactaggctggagccctgtttcagtctgtagacttgaattgggaggaaagggagtcacctgacccacctctgcaggaccctaggaagctggagaaagggagaagtgtgttgtaggcaatccaccagattctaatcc

SEQ ID NO: 135047 - DNA, 752 bp, Homo sapiens
gcttttgaacatctagactcaggtgtgggtgtgacagtgtcatgggagatcctaataggaagtacaatgatgtttcttttaatgtttgtttgtttatttgtttatttatttattgctgtttcttaaggagcagggctaacccacagaaagtgtgcccagagtcggccagcacaatgattttattcagatttatggaaatttttctctaaaaatgaatgggaatatatgatgggatagaatacaacattcgcatggctttttaagatactatgttagattttaaaaagaaatttcagacttgttcagggcagctttgaagtatgtgttcatgctggggaaaattgagaaacccagcatattgcactagtcttccttcttaatcctcgctttcactcctacctcacaatccatctaaaaaagtgattctgataaattgccttttggttttcttaaaatgtagtgtattttgttctggacccacagacttcttctgtggtcattttctaaatgtgtactaagtagcgtttctaagatcttcattctgttgatgccatgtcagtcttcctgctcaacttaataccctgtggaaaagataagaatgtctgctgtgtgatatttaccatctgaaggacagggagagagatttctcagtgatctcattcatacatgacgccagccacagaacaagggtctgacttgagccttttctgtcccagcaccttgggaatgggccacaggctacacgactgtta

SEQ ID NO: 135048 - DNA, 551 bp, Homo sapiens
cattttctcagtagttctctctctagtctgcttgctagatgtttaacttaaaaaattctacactatgtagcacttgtcaatttaaaagactcaaaagactgctggggcattaaaaacccagctttgtttctgtctgcaggtttaataaacaatgaataccttcatattccagaaaccaattaaaaatcattgtttttttttttttaacagagccatacctttcaaggtcttttctgagaaaaatcattaccagtcactttcttatttaccagtgacaaattgtagggaggagtcatcttaagagacctctgtgtcctttccttatacaggctggagggatgttaccctgtaggtttttggctagctgctagttttatgtgttcaacagggcatttagcctagccttgctagatggccttactgaagtgcagtgcttcgtttaattgtgtgaccttaggtgatctatttcatctaaatttggtctatttgtgaggcagagataacatctgaatggcttatctcacaggatggttttgaagattaaatgagat

SEQ ID NO: 135049 - DNA, 282 bp, Homo sapiens
acccacctagctttccgtcacctgccctcttacctaaccatgacctgagacattttctcctctaactccatggctcctgagaggagtctttagactcgtagtttgctttgcattttccacttgttagaaaaatgctttgtggtgcccatcctcgtgtgcataactttgctttcttttactttagttccttagattcccaaaagtggtcaaagggttgggattttttcctagctcttgatattgccagattaatttccaaaggggccgtaccaatatataacc

SEQ ID NO: 135050 - DNA, 1008 bp, Homo sapiens
cggtacccctctatccttaatctctctacccttaatctctctatccttaatctctctatccttaatccctagtaaagctccccacccactggatacctggaattccacccaggtaagacttgctattccggaatgagaatgcttttccttctctctcgtctgctttcaaactgcaattgaccctaaaagctctatatatgtaaccataatctttagtgtgaatgtgtttataaatacacgttttttccctcactgtggttgtcattaggttaataccagtagctgagggggcctccagaatgagggagagtggagtgggtgaaagattcctgatgggagtagggagacctggattcagatcttgatcatgtggtttgaagccagtgtttgggcatcttggatcttccatatgctcctctgggaatgtggggaaatgatatctgtcttacagttattatgtagatttaaggagatagtatgcagaaaagcatcatacaacaaattagtttccttcctataaatgtatctcagagaacttagccacatgcaggaccatcaaaaatctataaacattacaataaggcaaagcttgagctaaaatgtggaggaattagtgaattttcctgtgcacatgataattcacatgagatagcaagatgttttcaaatatagctgccatacaatgattgttttttgttttttgtttcttctgtgcagtgacaaatgagatcctctattgggctttatgtctaaagcttgcatttcaagcaatttcctcactcgaggtcaggagttcaagaccagcctggccaacatggtgaaaccccatctctactaaaaatacaaaattatccagtcatggtggcaggcacctgtaatcccagctacttgggaggctgaggcaggagaatggcttgagcccgggaggcacaggttgcaatgggctgagatcatgccactgcacttcagcctggacaacagagcgaccctccatctcaaaaaaaaaaa

SEQ ID NO: 135051 - DNA, 154 bp, Homo sapiens
ggtatctgttggaaacatatttgctaaatggcatactaaaaataaaaaagaatttataaaatgaaagaaacttagatacaaaaacttaacataagacttggttttttttcaggatcatacaaaatacatgttgaacataatctgttagttatct

SEQ ID NO: 135052 - DNA, 198 bp, Homo sapiens
gggtgcgggtttatacttcactgctcttcaggacatggaattaaaccagataataactttaaaacagataatgaaagaaatctaagaacttaaaatatataaatttccagaaacaggtgaagaagacaacaagcttgttaaaaagaagaaggaccatttacctcttgcttaggtaggtagtaatactatatcattgaa

SEQ ID NO: 135053 - DNA, 461 bp, Homo sapiens
cagaacgaggattcgatcacttagaaatcctgctgagagctgggtatacgatgattaagatgacctttggccgcgcccgagctgcggttatttgtatcagacattgtgctgggtactttacataaattcatttattcctcactacaaactttgaggtaatttttgcaacccctattttataaatgaggaaattaggttgtaaaagttgcagtaatttacacaaaaaaggtcccccagttaggaagtggcagaaaggtatgtgaacctaggtttacttatcctgaaattcctgccccagcatgacaacgctgagaggcagtatcttaataaccagcgcacctgggtagttctgccacaccatcatttcctctgtccttagggagtttgcaatttaaaagggtaaataagacaggtgtagaaatatgaagcatttacacaggatgccaatgttgcagtatgaa

SEQ ID NO: 135054 - DNA, 752 bp, Homo sapiens
gggctcatgtgatcctcccacctcagtctcctgagtgccaccaattgtgtgccaccaagcctaattttaaaatttttttgaagagaccaggtttcactatgttgctaagggtgatcttgaacttctgggctcaagcaatcttcctgccttagcctcctcaaatgttggcccatagttttaagtagtaaatccttttctgtacttctgaagtttttatcatcgtatgtaaaatttagtgatgtcacatcaatttgcttaaagtatagattattttcataattctaggaaaccagatattaaacaataaacttattctaggagtttagttattttatatgtatatatatatatgacaaagccccatctctatatatttataaaacataaaggccatgggtggggaatggatggcaggcaccatgtctggcagcaaaggtggcaagaagaaggccctgaaacagcccaagaagcaggccaaggagaaggacgaggaagataaggctttcaagcagaaataaaaagaggagcagaagaaactcgaggagctaaacatgaaggccgtggggaagtggcccctggccacaggtggaattaagaaattggccaaaaagtgagctgttgcttgtgcctgaggaaatggtaaccctttatttcatccatattgaaacatctgtattaactgccataacaccttttgccacctatagctggaattaagtgttgtcttggagctgttgtacatttaagaataa

SEQ ID NO: 135055 - DNA, 464 bp, Homo sapiens
aatccaactcttaactatatcatgaggaggtttcttttcccatcagttctcacattttcctgtcaatctgctgtataataattttactaaatctgcagatcaacactgccacccttttcaaagcttaagggagaaacaacactcaatctggacatattccatagccctgctgtttctggtaatgcctccaaatgggtgaacacaaatattggagaaaaggactgtgcccaaccaagtgcctggcagtgtgagtgccatggtcaatactgtaaaactgctcattgggatttctttcccagtgaccacgtaaacagctggatgcaatatcattaggctgcaggcaaaacggggtgggaaggagggatggagacaatgcctccccactgctatgcacaccttatggatttatcaagccaattttctgacccatgagaagaacctggcttatgtcaatatgtgcctta

SEQ ID NO: 135056 - DNA, 175 bp, Homo sapiens
caaacagggcacaagaaggactcctagaccaggagtcaggggcctgggtttttcagaagcagctactgcataacaggggacactgggtaaatcttcccccctctgaggactctggctgctgtctgtacaggctgaaactgatgctctctgacctcccttttctgagactgtcctg

SEQ ID NO: 135057 - DNA, 338 bp, Homo sapiens
catttaaatatcctgttactcggtcatcgtgtattttcttagtgtatgcagtgtgcagggtccttgccaggcactggggatagagtggtgcactggtggtccctgactctggtaaacttgcagtaagtctgtgacatttttgaattctcagtattcaatactcaggatccagatggtaattaagccagcagagtgcagaatgaggataaaagagttggaacaggactgtgatttacttgtactatattggatctagccttctatcaaaaactgaggttagtatgcatactggaaatgaaattttctaaggagttagagattttaggatcctaaggact

SEQ ID NO: 135058 - DNA, 307 bp, Homo sapiens
attacatccttctagaactggaatccttaggggtgtgaatgtgtctataccagaaatcttatgaatgggtctctcacagaattttaaataagaattcttagttcagataaattgggtctaagaagaaagcacctatcatgacatatttggtgtcagcgtgagttcttagggcatagtaaactttggcttgagttggtcttcttcacagagagtgaagagaagatgcagaagcctgttaaatattttagagccaggaccctggagagtttattaaaagcatactcccaaacctttcgttctctgaact

SEQ ID NO: 135059 - DNA, 894 bp, Homo sapiens
cactctaagtcacctcaccagcataaatttaggtgtaatcaaaaggaacttcttatgactaacaaaacactctcctaacactcaggaaactccatgagttcaaggaactctgtgccaggaacagagacaaagaccaaacataaaatttactacacctcagccaggatgttaagttcctctccaggtgggcctttccacaggactatacagacgtcctctgggtacagtggaacagctggcttcctccagaaagaacaacacaagtatcaaggcagaagtttgtaattcttctcatgacccagcctcagaaagcacaaatcatcaccatccactgtattctattgctgacacagagtcaaccagctataattcaatgtggaaggggactacactagcatgtaaacaccaggagccttggatcattggaggccattttggagttaaagtggctggagtggagtcttggatacatcgcactcgagtcaaaccctggatactgccaaaggaacccaaaaatccaggcgacagtgctagctattcctgtgaatctctagaggatctgcgcctgctcttcaagcaacaaccttgaggaaagtaactagaatcgtagatcctcgtggccctcccttgttgtatttttctttttactgttctcttaccccctttcactctcactgcacctcctccatgctgctgtactaccagtagctccccttaccaagagctcctatggagaatgcagcttcccggaaatattgacgccccatcgtataggggtttttctaaaggaaaccccactttcaccacctacacccatatgcccctgcactttaggccatacatttcaatccctgtatctttaacctccttgttaagtttgtctcttccagaatc

SEQ ID NO: 135060 - DNA, 414 bp, Homo sapiens
cagtgtctgagcccaccaccccttatctctccatctcccatgcgctgcatgtcacacagcccgttatcacaccattgtagagttgtggctggtttcttgtgaccatgtttcctggttcccatcctggtacattgacatgcctgtatctgcatctgcttgctctcctccttaaattgtaaatttcctaaaagcaggaatgaaattttattccccagctcactgcacctccatagaaccacactcaagtcaagcagtactgttggaaaacatcaccattccttaggtttaaacgttgaaggggaaagtcgtgattacaaagtggaacttggcttaaggctaaaagtaggaccatataatttattgtcacatcttgacacttttgagagtgaagggggtgctattcataaccaccag

SEQ ID NO: 135061 - DNA, 343 bp, Homo sapiens
aaagagagagaacgcccctattacatagcacatgcaccacctggagtctgcagtgtactagacccgtttatccatccaccaacccatcttatccttctgatgcatttcatagtaaaatgcaaacaccagtatgcttccttatcagggtttttaactaaagtagtgcacattcgaacgctacagaaatacataaaaggatttttctccaagtcctcctttcctctaccactgtgaaagtgtgtgcatccttccagactttgatctgtgcctacacatgcatttgaatatgtatggtagctagtgctttcaagcagggggatcacacccatgtgttcatccacta

SEQ ID NO: 135062 - DNA, 195 bp, Homo sapiens
cacaaaggccctatcccacaggcactagcatcatttacatttcaaagaggctataaggcaagggccaggcttccactgcccggccaggatctgaacctccctccaggccctctgtcctacaaagtacctttcaaatgccccctcctccaagaagtcttctctgactcctccctgcggccagaagtggcaaccctg

SEQ ID NO: 135063 - DNA, 394 bp, Homo sapiens
atggtagataataaactagattaggacttcatttctgctggacttccctagcacttaaaaaattcaacatatccaagataatagtcagttctctttttaacttccttaattctataaataaaggcattatcatttagtcatacaggatcaaaacacacattctctctctctcttttcttttttcttttttctttttgctccctatttctcctggatctcacccacacaaaacctctgctttctttctttttttggagacagggtcttgctctgttgcccaggctggagtgccatgatcgtagctcactgcagccttgacctcctgggatcaggcagtcctccccccttagcctcctgggtagctgggactacgggcatgtgccaccacacttgg

SEQ ID NO: 135064 - DNA, 423 bp, Homo sapiens
agtcttatatttctggaaggttttatttgttcctttttattcttatttctctaatcttgtcttcatgctttattttattaagttgatctttagtctctgatatcctttcttctgcttgattgattggctgttgatacttgtgcatgattcacaaagttctcatgctgcgtttttcagctccatcaagtcatttatgttcttctccaaactggttattctagttagcaattcctctaaccattttttaaggttcttagcttccttgctttgcgttagaacaggctcctttagctcagaggagtttgttattacccacttgctttccattatcttatttaagcaatgcaacaacattttgagataagaatttatattagtgtatgggacatatagatcaagtgcttagcacacatgcccatatac

SEQ ID NO: 135065 - DNA, 496 bp, Homo sapiens
accctgtaatagctgtgtggagtacatattctacaactcagtaatcccacctctacatatatgccctagagaaactcttgatcttttgctctaagacagtgctactattcaaagtacaagtccagaaggcaataaagagtttctgccagttaaatcaacactatgcttctttcattgagaaagccttgctgtgattttttaaagtcatttgaaacagtgtgattagtgaggaaattaacttgtatttgggcgcaaactccttatctcaaagaatgttcatagcatcattgaaaatgtccatcagtgaaagaatgtatatgtaaattgtttatatttatataatggaatgttgtacacaatgaaaatgtaaaaacaggccaggcgcagtggctgacacctataatcccaacactttgggaggctgaggtgggtggatcacctgagttcaagaccagcctgaccaacatggtgaaaccttgtctctactggaaaaaaa

SEQ ID NO: 135066 - DNA, 541 bp, Homo sapiens
gcagtgaatgcgttgggaacaatatggaaaactgggagctgccttggaatctacagggccgggacccactcgagccatccacactttccccagcctcctccaaaacagcacactttccggctgaagaaaagaagaatggtattcatgcagttcccattttacagatgaaaacaagaggactttttctgtgaagtcaagaaagtggttacaatggtactttcagcctgtccgaattatgtattgcccctcccctttttattaataacattgaagtgtgatgggacaaccactgaagccgtctgttgaaacctgctgggactttttagccattctcttcaacataaagaatgggtgtttttggagggggtgagaggaatggggaaatgttgtcaaagagtacaatgttttagttgagacaggaggaatatattttgttgagatctacagcacagcatggtgactgtagttaacaatgaagtattgtgtatttcaaaattgctaagacaataaatttcaaatgttctcaccacaaaaaagatag

SEQ ID NO: 135067 - DNA, 629 bp, Homo sapiens
acccacgcgtgcgcggacgcgtgggtcgacccacgcgtgggggacagttcatctcccacgggtctacagcttgaaacttggcattcattataatgtttcgtggctgctgataacctacagttcacaatcttcggcctggtattcattgtccaccaaaatctggcccacataggaatttactggacagctagactaatgcaatcaatttccgcaagctcttttccagtctccatgcatttactctatgcttgaccccttcggcccttcttcctcctccttgactaactgaagcctatctttcccttaacggccagctcagctcctctattagccttccccattttctgaatttctgtagccattggtttagtaagagcttaggacttagagtcagttcattttgagttcaaatgtcagttctgtcatttacaagtcgtatgacctttggcatcccgttttacatgtttgaacttaagtgttctcatctgtaaaatggagataatcatagcacctacctcacaggatgacttaagatcaagaggatgaatataaagcatttagcacaagcctggctagtagaaaaatacttaataaatcatagctaatttcgttgtcacttggccacaatg

SEQ ID NO: 135068 - DNA, 468 bp, Homo sapiens
tgagacagagtttcattcttttgcccaggctggagtgaaatgatgcgatctcagctcactgcaacctctgccccccaggttcaagtgattctcctgcctcaggcttccgagtagctgggattatagccattatttttctttaagaagacactttattctacaggcttctgctacatggaactctcatggatgtttctcctagctcttgagccactcttcttctatcagatttcaaaatgttagagttaggctttatcctgggccctctactcactttagatgaggtaattactcctatagtattgaaaaatacttatatgaaaataagtcccaagtgtatatttccagccaagattaattatctcagttccaggactacccaaatgccaacataccatctccattggattgtctcacaggtgttgcaaatacgtttaaacttctgttggtacccatttcccttgctgc

SEQ ID NO: 135069 - DNA, 227 bp, Homo sapiens
aagacccctgtctctatttttttaaatatattggatacattaaaaacattttaatgtaatagatcatactcttgccttcagaaaaaaaagtattatctgtattaacaaggagagagagtaatttgattcaatccaatcttcttacagatgaagagattaaaaccttgtaagacattacaaggtttatcaagctcatatagctttggtatggcaaaattgaagtaggg

SEQ ID NO: 135070 - DNA, 358 bp, Homo sapiens
agcttcttttccttccctacccctggttatcattgtcctgtgccccttatcaaaccctctttagagtaaatgtatgcttttgatgctctatggccgtggaaaggttttcctaattccaaaatgtctatgattttcaggacatttctgagcatctttctaaatgctcagaagcatttagaaacaagaccttgtttcctctatattagactgttttaaaaaattttgttatcaatcatattttggattggtggtatttagtccaaattccaaatattcgagcccattgtcagaccatgtgtctcatttttctattcttttttttttttttttgagatggagtcttgagtctctgttgccc

SEQ ID NO: 135071 - DNA, 468 bp, Homo sapiens
ggagggagttgctgtcgcacgactgctgtggaccttcccagaggaaggcagcacgtcacagaccctggggagtgcgtgatcccgaggtgtcctccagagctgcagagcgggcgtccacaggagggacagtggaactgcggcggggaggggacccggaataggctctgatgctgccagtcacacactgagcctcctaggcctggagcccctggcacccagctcagctcccaccctgggccctgggtgctgctggctttatttggcttagggggtccttggcccaatgatggcagtgggcaaggcctcgcttggctccactctgcccggggctggacatgcgtgcctgcggggcagctggctccaagggtctgaggggcctcacgcccagccccaggagggcctgcccatctcagccctcgccacgtcctggtgctcattggtacggcggggtttcctgggctgcacccg

SEQ ID NO: 135072 - DNA, 682 bp, Homo sapiens
catttttcccccatcatttcatacctactctagttacaagtcatttcttccttgaagcaaactatctcttcacaatttgtgaatattcattgccttctgatagttctgttctagaggcacacagttatttgaaactttttgctatttaactccttacaaaagggtttcagttggctttgaaagcataaccacacataagacatctttgtacctacccagcgtcttgctatgagttgtttagtgaatgtttatcttaggtaaacaatgtttccgatgaggattaatttaaatgaccacaatcatgatagaaaaggctgatttattttgccaaatagaacacctacacataacattactcacgtaaaaatatataaaactttgctttaaagattagtccctggctgggtgcggtggctcacatctgtaatcccagcactttgggaggccgaggcgggcagatcacctgaggtcaggggtttgagaccagcctggccaacatgggtgaaacctcgtctctactaaaaatacaaaaaattagccagacattgtggtgggcacctgtaatcccagctattcgggaggctgaggcaggagaatcgcttgaactcaggaggtagaggttgcagtgagccgagatcgcgccacagcactccagcctgggcaacagagtgagactccatct

SEQ ID NO: 135073 - DNA, 448 bp, Homo sapiens
cagaaacgctccccttcccaagttgccttctttttttaggctgttaaaacataatttgcctgacagcccacctggccattcacacgtggttacccaggatgctgtgcacagcaggccactctaggtatctgaggtcccggctcacccgaggggtgctcgacgttccttcttgtatagactccacctgccagcactgagagcccctggaaggactgagctgcaggccgccctcaatgagggtccttctagcataggaacagacgcatcttacagaggccctgccctgtgcatgaagctttggcccaaggccacacttctccaaaggcctgctcagctgctctctgctccagtcctacggagtctcgggctatttgaggggtaggaaccctgttctttccaaaatcagcagaaggagaggtgggaagcaacagctcagcctctagcatct

SEQ ID NO: 135074 - DNA, 129 bp, Homo sapiens
tttttttggtcttctcttttttaaatcttggttagcctaggaaatggtttttcaatgttgtttatttttttttgaaaaaaactttttatttaatgaaacctatgcattattctcttaatctctattttt

SEQ ID NO: 135075 - DNA, 403 bp, Homo sapiens
actgcaccgcatgctaggcctgggctgacgaaccacagccagtcatttcttcattccttcattcactcagaaccagtggattcagcccctgctctgtaccagtgtctgggccgggcattagagggatggcagtgagtgagagacatggctctcgccctggtgtaacttccagtccagcagagaagacagacttacagagtcattacaatgacactcaatgacagatggagtttcactcttgtcgcccaggctggagtgcaatggcaggatctcggtcactgcaaactctgccttccaggttcaagtgattctcctgcctcagcctcccgagtagctgggactacagatatgcaccactacacttggtaatttgtatttttagtagagtcaggggtttgccatt

SEQ ID NO: 135076 - DNA, 121 bp, Homo sapiens
ctccctcagtgccaaccccaatgctggtacttgcttgactgccatttacatagtcaaatgatttacttgaggaagcactggctgtccggattagacttaagctattgatttttggcaccac

SEQ ID NO: 135077 - DNA, 194 bp, Homo sapiens
agtaaatagtggtaaggtgggaaatggacaaagctatgtagctagaatcagaagtctttgaaatcaaaacatcaagattcaaactatttaggggcagtggggctgacgtggtgaccgtgggcctgatcagataaaacctttacaaagaaacagtagctctcagactcacctcctgagacagagttgttctgagg

SEQ ID NO: 135078 - DNA, 407 bp, Homo sapiens
aaaaagtttaaaaattagcggggcatagtggagtgcacatgcatggttcagagataagctatagatttaggctgttaaaatacagaatataggggttcctttctgtggccctctcctttctagagtcccccatcactctccggcgtcatcccgcattatcctggccttctttccgggttcttctagttcctctggccagaaagatgtcagtctttctactgaagttgtagctggtcctgtgccttggtgatggcgaccacagccaggttggggcaaagctgcaaaagtggggatctcaatctacatggatcacttactcccagttggattctcttctaaaatgcatctgtatttcagtctccagagtcctcaggtagttgttttttgtgtgtgttttatccacagag

SEQ ID NO: 135079 - DNA, 563 bp, Homo sapiens
tgcggcagggcgttgggcggaaggggttcgcacgccaagaaccgccatgcctggggatcaccgccgcatccgcggccctgaagaatcgcagccgccgcagctgtacgcggccgacgaggaggaggcgcccggcacccgcgacccaacgcggctacggcccgtgtacgcgcgcgccgggctgctgagccaggccaagggctcggcctacctggaggcgggaggcaccaaggtgctgtgtgccgtgtcgggcccgcgacaggccgagggcggcgagcgcggcggcggcccggccggagcaggcggcgaggccccggccgcgctgcgcggtcgcctgctctgcgacttccgccgcgcacccttcgcgggccgccggcgccgcgctcccccgggcggctgcgaggagcgtgagctggcgctggcgctgcaggaggcgctggagccggctgtgcgcctgggccgctacccgcgcgcgcagctcgaggtgggcgccgccgcccagccctgaaccagaagcctgagcaactacggacgcaagccgaggaccgtgctgccgccgtccacga

SEQ ID NO: 135080 - DNA, 720 bp, Homo sapiens
tgcggcagggcgttgggcggaaggggttcgcacgccaagaaccgccatgcctggggatcaccgccgcatccgcggccctgaagaatcgcagccgccgcagctgtacgcggccgacgaggaggaggcgcccggcacccgcgacccaacgcggctacggcccgtgtacgcgcgcgccgggctgctgagccaggccaagggctcggcctacctggaggcgggaggcaccaaggtgctgtgtgccgtgtcgggcccgcgacaggccgagggcggcgagcgcggcggcggcccggccggagcaggcggcgaggccccggccgcgctgcgcggtcgcctgctctgcgacttccgccgcgcacccttcgcgggccgccggcgccgcgctcccccgggcggctgcgaggagcgtgagctggcgctggcgctgcaggaggcgctggagccggctgtgcgcctgggccgctacccgcgcgcgcagctcgaggtgtcggcgctgctgctggaggacggtggctcggccctggccgccgcgctcaccgccgccgcgctcgccctggccgacgcgggcgtggagatgtacgacctggtggtgggctgcggcctcagcctcgcgccggggcccgcgcccacctggctcctggaccccacgcggctcgaggaagagcgcgccgccgccggcctcaccgtggcgctcatgcctgtgctgaatcaggtggccgggct

SEQ ID NO: 135081 - DNA, 690 bp, Homo sapiens
gacagttctggattccaatcttgatcaaattactaattttgtacatatgtagcatttaaaacgattttttttgttaaacattttcggttgcattttcatatttcataaatcttattgcctgtgggccttcttaccctttgaagcaatgaatttcagagcttggggagaagcacaacaccctcctacaagaacagacctattgttcgttttgactctaaaattagatatttgtttgaatctataagttaagggcttaaagctgagcaaaataatatattaattaggatttgcatttggttgtatgtaatggaaacctggctactacatcttaatagcatttgtttttctctggaaaacaaacagagcaccacgtagctctggactacaaagacaaaggcaggtagtccagagctactgtggtggcaactcgatgctattgggaccctgtggtggtcaattttgtgtgtcacgctggctaggcaagagtgcccagttattcaatcaaacactaatccaggttgctgtgaaggtaatttgtagatatgattgaattcactttaaggaaggaaattatcctagataagctgggtgggattgttttaaaccatctaaaggtcttaagagcagaactgatgctttgctgaagaagcctcattccacctatggactacagttttatcctgtgcccct

SEQ ID NO: 135082 - DNA, 262 bp, Homo sapiens
tgttggaattacaggcgtgagccaccacacctggccccaaatgctttttaaaaaatgtattttcctttaaaatataaggagaggttatctgttctagtcacttgtaaagtgtacccaggcagtctgtgttttaaaagtaactgaagcagctgtagggagaagggtctcctcagactgtggcaagacctggatctgagaaattgaaactgtcccctcacatgcaacatgtgaactgaagagtcagaagacagccctgagattc

SEQ ID NO: 135083 - DNA, 392 bp, Homo sapiens
aaacaagcactacctaggcaagtaatgctgcaggcaagcatttgaacagtcgtggcctcataaagggcagacacacccctggcagccagccaggctcattaacagcaacccagagacttgccgaggtccttctaagaatctgatttcatgagtcacgctccatgggcacaccccaaatttctgtttgttttggaaaactcagttaccctttacaaagaataactcctataaatgataatgagaataattaaagctacatgtgcaaaaacaattaacttattactgatgctatcagcggatgttgtcaactaataaatctgtcaagttggcaagtgaagaaaggtggcatgctttcaaacataaatataaaatgtttaaggaagaaaaactgg

SEQ ID NO: 135084 - DNA, 227 bp, Homo sapiens
actcacccctgatgaagagtaactcacattaaatgccttccacaatatatttactcagggcctggaagactgaatggtttcccaagaacatttagagtggtgatttgaaggactaccagacaacccatttaatacagatcttaggaggagggaactctctgaggagcctctaccagtttacttccagagctgccttctttcttagaagcagattgttaaacttcctt

SEQ ID NO: 135085 - DNA, 153 bp, Homo sapiens
gagagatgaactgcccatgtggagatgataaacatcacatggcattttaagtgaatacagcacttgagctcacagcaacagcaacaggaggtagctctgaaattatggtagtagtgcagtatgtactatagttaatcttatccagttgtaatt

SEQ ID NO: 135086 - DNA, 540 bp, Homo sapiens
aaacatcagaaccatcccctacttctttctctccctcataagctctgtgcctctacctttatactcaatcactactcagtttttctgaccttgatcattctgatttctcatacctttcgctcttctctcagtttccttgaaggatttacctcctgctaaatacgaggcttcatctgtagcctgtgttcatcttggatgtagctcttctcttacagaacttactacttctttgctttcggctctcagctctcatccctacagaggtgactccatcacctatatatatatgtagcttccacatttccaagacagagatgtccatcctccagctttaaatacaccatgggcatctttatggcatgttccagagtcactcaaattcaagcacatctttaagaaacaacttttgcttctctatttctcttgtagactctgcccctaataagctgcccccttcctccccccccctgatataaactctgggacctgcatctccaatgggactctaaggacctcaaacctgatttcacttctccaaac

SEQ ID NO: 135087 - DNA, 717 bp, Homo sapiens
gccttgatactaagcaattaaatgtcaatgattaatatggtgacttacatttgctcaaatacaaaatagactataaccttgagttaaatgtgctgtccatggctcatctgatgagcataggtcactaattatgtttgtaaatttactgtggttatagagttaacattggaacaggtcataactaatgttaatatcagcataaataacaaaaagtaagataatatagcccataataagaccaaattcatgggaatacattgttctagatgtatgaagttgaggtttatggactattcaagatattaaaactagaaaaatggaaaaaagaaccatactgggttgaaaactcttgaagtgtattagaatttcaaggtcttaaagtaatatatttaataaaatacacaaccttttcttaaaggaatcaggtcatcattttcagtacccactttgtacctctgccctaggtgattgtccagacatgtaatggccacagagtattttcctttctgactatttggaaaggccatgtgtccttgtagagctaaccagggattttgaatcagaaagggcttggtgaaaattcttgcccacaactaccaaatataagaccatggttttgtttaatctttctgagtctcagttaattcatgtgtaagatagggaacagtaataactaatctgaaggcttttgtgaagaataaaaactataatgtatgt

SEQ ID NO: 135088 - DNA, 271 bp, Homo sapiens
tgatgctgttctcagcaagcagcagataaatattggacctgatcagtttgtaaataagttgaagaactgacattctcaaatctgtccattttagacacagctgggataccgaggattgaatctgaaatgccaacctagggctcttccctgtgaggcctcactggattataagattatggggtttttctatccaaagttgttcgagtctcataggtcttctagactaaaaatagcttccctcttctcaatttatttcaatactttcaactgt

SEQ ID NO: 135089 - DNA, 808 bp, Homo sapiens
gttcctgattctgtaggtgacagagagaagtggttttctcatttttttgtgtgtgaaattattcgcatatgaggaaaagatagctcaaaaatagaagctctttcattatctctccacaatgtagtgtggccccaagtgactattttgtggagacacggtaatttggggtggctaaatcattaccccgaggtgtgtcagatgctgccaagacctccttcattcatgtggccaagactgtgggcttcctggctggggaggcagaggccctgctcttctgctgctaaccttggggtcagcgagccctgatccacacttcctctgggcaacatcaatggggctgctgaacatattgagccagacttgtttccaagagatagaaggaactagagcattggggaaagtcccaagtaactctagccctcagccacctgctgtggctgaagatgaagtctctgcagcttcaagaatccaactggctggtgcacattgttctcattggctagatcattcctccatgtagcacttcactaaactcattaacaaatatttacaaatgacattgctttttggggtcatgtatatttcagtcttcagaatccatcaggcactcaaatcccttggcagttctagttctctcccctagacatgcctctgccccctactactcagttccttttatttctaccattcgtttttattttctatttcatttctttacttttttagagacaaggtctctgtcacccaggttggagtgcagtgagctgagatcgcgccactgcactccagcctggtcgactttgtctca

SEQ ID NO: 135090 - DNA, 294 bp, Homo sapiens
gcctgggcgacaagagcaaaactctgtctcaaaaaaaaacccgaaaatgctgggtttaactgccaattaatgtcaacattctgaatataaattcagtaatgcaacaatggcctcgggagccgttgaggcatgtaagactatttttgtctttctgctaaatggcctcagctattgtgcttttcgaacctaaatctcctttgtgtgtgtgcatgtgtggatgggtgcatgcgtgcatgtgtgtgtgtattttgtatttcttcctttgccaacttagctctattgatgcagcccatt

SEQ ID NO: 135091 - DNA, 375 bp, Homo sapiens
ggacaaaaagcgaagccctggatcaggaagcacaatgcggctggtatttagccgcttctcaatagtgcctcattcaatccccggggcctcattgatgcccgccgcgtgctggagagcctctgagggtcagtcggcgacgggcaccgtctggaggggtctcgccgctaacccggggtggctctgtctttcgggagcaagaggggcccagctattctcggtctcccctggggcagaggcagggaggtgggcagatgggcaaggtcaggcgtcagagaggctggaggaagcagtgagggtctgggcaggccccttgcaccatcgggctcccaggagtcgaatccaattcagtaaacactcagcggagtagcttagcgg

SEQ ID NO: 135092 - DNA, 323 bp, Homo sapiens
ggggaattttatatgaaaacgaattatttcaaacccaaactatttatttatttatttatttgtttatgacagacagggtcttgctctgtagcccaggctggggtgccctgatcatggctcactgcagccacaacctcccaggctcaagcagtctgcccacctcagtctcccaagtagcacgcactaccacacccagccaggggcagtttttaaaacaggtttgggctatccaaattgttcttccagagttcttccaaaatgctaggattacaggcttgagccaccgcactcggcccaaacttttgttttaaccgtagattaaa

SEQ ID NO: 135093 - DNA, 253 bp, Homo sapiens
caagtgatccacccaccttggcttcccaaagtgctgggattacaggtgtgaaccaccccacccagccaggggcagtttttaaaacaggtttgggctatccaaattgttcttccagagttcttataaatgctaagagaatatacagaattactgttaattagatgttagaatttattatagctagtatgtgttttggggggtaacttaattttcatataatttcaaacttgcagaaaagttgtaagagtagtac

SEQ ID NO: 135094 - DNA, 600 bp, Homo sapiens
cagcaacttaacacaacatccatttttgtgggtcagaaattgagcatggctttgctgggtcatctgcttaagggtcttcacaaatttgtaatcaaggtgttgactggggcctcagaaatgccaaggttcaactggggcagaatttgccaccaacctcattcagtagtcagcagggttcagttcttcaagggttgttgggctgagggccttagctccttgttggctaatggccagaggccactctcaattcttacccagtagtcctcttcatcaggacaagcaagtatgaagagccagagaggaaatctcagtaagataaaagtcagtgtcttttgtaacctaatcatagaagtaatattctgtcacttttactgtgtttgtttcattaaaaaccaatcatggaaacaactgaattgtccattgatggatgaatgaataaagaggctgtggtatacatatacaatggaatattatcagtctttaaaaagaagcagtaggctgaggcaggagaatcgcttgaacctgggaggcagaggttgcggtgagccaagatcatgccattgcactctagcctgggcaacaagaatgaaactccatctc

SEQ ID NO: 135095 - DNA, 181 bp, Homo sapiens
taactaagattagaataaatttggattatccaccttggattggctggttaattcttcactgaaattttccaggtctttgttataattctaattttgttaatcactccaattttaggttgaatttttccctttctcctcatcatttttctccagcaaacactcagggaaaaattcaaggatg

SEQ ID NO: 135096 - DNA, 341 bp, Homo sapiens
cccaggattggtccttggtgccttctttggttcatttggttaggtcatggatggtgtggatgccagtagatattgaagagttaggtatttattgtagtcttcactgtctgggcttatctgtacccatccttcttgggctttccagatattttaaaggacttgggtattatgatctaaactgtatctacgttgtggttcttgcagcctcatagaggtaccaccttgatggtcttggacaagatctgggagaattctctggattatcaggcagagactcttgttctcttcccttactttctcccaaacagactgtgtgtgtgtgtgtgtgtgtgtgtgtgtgt

SEQ ID NO: 135097 - DNA, 454 bp, Homo sapiens
ataaaacaaaggaagtcataaaaacgcagaataagggatgtgatttggttatggtgaataatcatttccaaagcaaatgttgtcccatctgaatcacatagcccatcctattggccatcaaattcttctcaaccttctttccctcttctgcactctaacaaagagactacggtggagtttatagaagcttctacaacgtggttttgttgtatatagatgtgtatgtatgtctatgaatatgtctcccccctatctagttttagaaaccggtattcctaagttatggctttattttcttcactattgatgttcttggaagagtaaaattgctagttcattctcattagtcactgttttttcatttctctttcaattctctgaagctcttctgaatgtcaaaaacatgagggctccattttagtatccctagttgttgattgcctgtgtctcgtga

SEQ ID NO: 135098 - DNA, 320 bp, Homo sapiens
tgtgagattggcaagagaagccaagatatccaagctatttcccacctaataagtacctgggagctcaagcttcctctgtggctctgatggcactctacctgggagaagatatagcaaggagaacctgacagatcatccatatggtgccatctgtggtaagagattagtcactgcatacttctcattagaaaaaatataaagaaagccagggaatcccatgataagtcccagccaggcaaagcagaagaccttctgctcttcccatctgattcaccattacctacaaatacaagatcaaagataaggaacgtaagatctga

SEQ ID NO: 135099 - DNA, 366 bp, Homo sapiens
  misc_feature (29)..(30): n is a, c, g, or t
  misc_feature (32)..(32): n is a, c, g, or t
aggatcccagttcgacggagactctccanncnatctctcccaatctccccatcaagcagcctgtcaattattcacttctatccttctcgctgtgggaggggattgctggagaggacttttcagctggagctaaaaggtttacagctccagggctcatttagggatcagctttgtgacagcaaggaggttttgggcactgtggtggtctgtacatccctagaaggtgcccagaaaacacttactgagaatgcatacatttgcacagcatggggtaatatgctaggcagtttccaaaggtaaccaccctcagttccttccctctctgtgcttatagcctctcattgacatacagagagtctccgtcga

SEQ ID NO: 135100 - DNA, 257 bp, Homo sapiens
acaccagttggttgaatgaatgaatgatgaatgctttgggcaatttctctcttctgaagaaagggctcttatttgtcactcagagaaggcagagcagattagattaggatgacttcattttagaaatgggaaaatgaaaaaacagataggaaggatctcctgaaataagatagttttgttttgtttttttgatatggagttttgctcttgttgcccaggctggagtgcaatggcacgatctcagctcactgcaacct

SEQ ID NO: 135101 - DNA, 341 bp, Homo sapiens
ccatcagtgtcatctgatagttcacctctctccccctctttcctgcctagaaactctacttggctttcagattatctccctctacatttttatcctagcccacgggctgtaccttctcagcatcctttgctggagagtacagtatagatagtggtcaaaagcacaggctcctgttggagtggggctaccttgaattctaacacggctacttgtagctatgtgacccttggaaggttatttcatctccaagtgcttcagtctccccatctataaaatgaagataaccctgagggctgcaagggttaaatgattaatatacacaaactgcttaagagtttctg

SEQ ID NO: 135102 - DNA, 203 bp, Homo sapiens
tgaccttttattgaggtttcaaggacgcttttgacaattctgtgctctttttacggtggaatttagaagcctatgcatttgtgtgtgtgtgtgtgtgtgtgtgtgtgtgtgtgtgtgtaatactggaacaggcctaatgttacaagttaaaggtagatatttggtctagtttgtacttgaaagggaacatcattcaggaaata

SEQ ID NO: 135103 - DNA, 424 bp, Homo sapiens
tcagttatcagtggtgtgagaaaaacacaacggtggattcagaaggagaaaccaagtcatctgcatttggcctcagtgtgtggactgtcctgaaatttgagtacagatgtgttcatgtcctgggattagataaaaagagaggaaacacacagtgaattcttatggtctgtcatttcagttggccatcttctgcccctctgttctggaagcttctccactaaaatagagcacccaacttggttttctacttgctttctggcccatcttgagttggaggaatcatgtgtttcagaactcttgctggtggtgggtgggagatcaacaaatgatttcattaagctgtgtgttcttaataaactttgggaagatttgtcgcagagaaactcagatagggaccttgtgatctcagcagtcatgggtttat

SEQ ID NO: 135104 - DNA, 212 bp, Homo sapiens
actttgtatatactagatatttaataacccttggttaagtgaaagaatgagtaaataaaattttaaaacaaatagtctacatagttgcttggaaatacttatttaatggtctgtacctcttagctaaatcagcccattttaatggaaatacaggcaagagggaataagaagtagatgaacagcatgttccaaagtgggtaggatatgatttg

SEQ ID NO: 135105 - DNA, 426 bp, Homo sapiens
aaccagagagaacagaagaggtattatatagtgaaccgttaataaaaactctgtaaatgaatacagtatcacctaacagttcaaggctttatagaagtataattggttttaatacttgaaccctaatgtgaaggaatgtgagaacattagtagaggacagaaatacggactttgaaaggaaagcaaaaacagtacaaggaaatcagacagaaacagtacatgatgcagaaagaggtgaagaatgagtcaaagagatgcagaggggtaatggaagtgataaaaccatagaaattaaagcagaagattgagtctataatatggcagagaaaaatcgaaatgttctctgttggattaacttggcctagctggggttttgtggttattttcaagagtcaatatgtcatcaccaactcttgaaatcacttc

SEQ ID NO: 135106 - DNA, 1460 bp, Homo sapiens
agtagctgggactacagacgaccgccaccacgcctggctaatttttctatgtttagtagagacggggtttcaccgtgttagccaggatggtctcgatctcctgacctcgtgatccgcccgcctcagcctcccaaagtgctgggattacaggcgtcagccactgcgcccggccaaaaatgccatccaatctttaccgtgtctgggcctttgaaaggtgcatttcacctctcttagaggataacaggagccttccgaggcagcctcggaccgggagctcccatagcctcgcctgtctggatgcctgacaaatcagcaggcaaggggccttgctccagatcagctgagcctagtttggtttgagtttggggaccctggaaagtatcacaaaagcaaggttgtaggaggggggtgggggagggaaccaagagtgatcaacaagtatcgaccataaacatatcttagaatcctatattgaattgactggatgactcaaaataatgtcagaattattttaaaatgttacttttgtgtttgttcacatatctggctcctccccaatgtcatcccaaggaaagctgagagtccttttgtttttttatttttcctaaaacaaaggcctaaaggccctaatacacttaatacctaatggggccacaaagaccatgatgcatagtaaatatttgatgataataaaatgtatttttgtctcaataaatgtatggtcctttgccacacctctcattacttgaagagttttaaagagtccattagtttagccatctgcatggttatggaaactgccaagcccaagagttggaaagtctttatgattttatattttactgagaaaaaaaattattctttatagaaacagttaaaagggatctctcttctagcaaatgagatgtcaaataaaaatattcagcccagtatgaatttctaaaaagtgaggcttattttgggctcctattgcaattgaaggagactgaagtgtaaaaatttggtgcccacatataatttatctgtttttgcaccattctaatttcttaaatttatacgttattctagaatctagatgcagtagcaccatataaattcgcgattatacccttaacagtgggtgcactgggtccataaagtcagatccacccaaaacctccaaatatcagtttatttggaaataatgtttttgcagctttaatcaagttaacctgaggtcatataagattaatccagtgtctgctgtacttctgaaaaggggggaatttggacacagacacccagaaagaacactgtgtgaccactgagacagatcctgcttatgctgactcaagccaaggaatggcaaggttgctgaccaccaccagaagctaggagagaggaacggaacaggctccctttgaacccctaagaagaagctagccctgccaacatcttcatttcagacttctggcctccag

SEQ ID NO: 135107 - DNA, 777 bp, Homo sapiens
caccccgagcctggctccttccatgcaaagcctggcgaggaaggcgaggaagcctggcagggatggttttttcaccacctcgaagaccagcacgcgattccgcctctagtttgactgtttttgttgtttaaatctgagtctagcaatcagcatcgacatagaatctgccagcagcaaaactgtgaccaggcagagaaacgggtgggggacagttcccaggcctcctctccagcccgctgtgcagcgagttcagttgcttcacgccctaagccagcgagtacccatcaacaaggctgtcagtgactgcagtgacttccaggcgccttatcctctctaagcgtcctgataaccctgagagatgttattacggccattccctttttgtcatggaggtggggggtgcggtgtcttctgagctgatactccactccgttgtgagtatctgtgggatatgaccattccctttttgtcatggaggttgggactggggggcctttctgagctgatattctgttgtgaatatctgtgggataatttcacgtcgtcgcctcccctggctctaaggagcttggacgtgtctggaggttcatggaagccacctgcaggagtgcctggcttggctttgcctttttgtcttcttcctgctcttctcactcaccttcacatgcccccacgtctgccctaccgcatccaccccatatcccttaaacaggtatttgggaaattgtgtggggcagaaggaaaatccaggagccttgttttccacatgtttccatc

SEQ ID NO: 135108 - DNA, 170 bp, Homo sapiens
ggacaatttgaaaatcttctttaggcacattcactaagtaatgtgtccgtcagcaagtgtggctctgtgtctgtggtgagcccctttctctgtcgggaccttgtcccagtgcctggagagcaccttctcaaactgtagacctcactggcactgggactgatctgagtgcc

SEQ ID NO: 135109 - DNA, 438 bp, Homo sapiens
ggcatggcaggggccaggggccagtgagggcaggggagggactggggaggagagcagaggaagacaggtgcagccagatgggagggtcctgaatgccacttctgattctgcctccctcccaccacttaccaacctgcaaaatcctccatgatcttttctttccttttttttttgagacaggatctcactctgttgcccaggctggtgtacagtggcgccatttcggctcactgcaacctccgcctcccaggttcgagtgactctcccacctcagcctcctgagtagctgggactacaggttcgcaccaccacgcctggctaatttttggatttttttggtagagacggggtttcaccatgttggccaggtgtgcaatatatttttccttttttatgcccatatttaccaatcttttcttttctttgagtcatggttag

SEQ ID NO: 135110 - DNA, 512 bp, Homo sapiens
ctttataaacattgtacagttaggctacatttttttaaaaaataaagtaactgcactacaactttacgacaatgtcactaggcaataggaatttttgagccccatgatattcttatgggacctctgtcatatacgctatcactcacaaaaacaatgtcatgtgatgcatgacagtacatatgtatctcaactgaaaatcctaaatgtcagtagtgttctctgactcactatttactagtaagtttcctcagaactgtctttgcctgagagtttcacaaccaagcgtctctctgcacagttgattctagggacaagaagtgctaagaatccatgttggcttcaagtgcaaaatggaaaacaccttagtgtcccaccaaccatgttagccaccttcctggagggcaagctcccacgccctttccccatcgctgtgaagagctcacgtcatctgtggcatttccataactctccgatgccagccatcagtctctcagcacgtgttgaaaattagc

SEQ ID NO: 135111 - DNA, 256 bp, Homo sapiens
gagaatccgagtggaaacttttaaaaccttaaacagactctcctacagcaaatagattctctatgtgcagcatgaggaatcactgcatagttctgctccaccaataatatgattggtacagcaccaaaccatggcaaagttagatgttaaagaacataatgttgcaataatgatgttatattggatcttatgcatgaacaaacaacggagatttttactcaaacagaaacaaaccatgagggggcatcctcaaaat

SEQ ID NO: 135112 - DNA, 338 bp, Homo sapiens
tccatgatatggcgactcctcctgtatttgtaatacccattcctgaggctggcacatggctgacacttagtaagtactcacctgactcataactagaattagcaaaaacaatacctgatgtttatgccagtggttgtcaaagtagtggcagggggggccgggcgcggtggctcacgaggtcaggagatcgagaccaccctggctaacacggtgaaaccccatctccactaaaaatacaaaaaattagccgggcatggtggcaggcgcctgtagtcccagctactcgggcggctgaggcaggagaatggcgtgaacccgggaggcggacgttgcagtga

SEQ ID NO: 135113 - DNA, 398 bp, Homo sapiens
taaaatggaccagggagacagcagcagggaggtaagaagcgtgaaggttcaactctgagaagcacttatggggcagacagaagaacttatgaaagagatcaatgaggaccatctaacatgaaatgtcacagaataaaaccagatgtcacagaagtcaaggtaagatgatcctgaagaagagagtgtgtaacaataaaagacacagcaaaagacaacgtggagatgaaggggcccgttggagatccatggtaacctttactagataagcttcagcaatctgctaaaattgggacctgaatggaaaaggcagacaccacatgtagcccactcttctgagaagcaggaaaagtagggaaagagggaaacgaggcagaatacatggccaagggaggactttc

SEQ ID NO: 135114 - DNA, 393 bp, Homo sapiens
gtctggaccctgccatttctcacccgtttggccttgggcactacttaaaggtctccgtgcctcaggttttccatctgtaaaatggggataaccctagtgtctcctgtacagggctgttgggaggatgaaatgggatgatacgtgtgaagcacttgaaatattgcttaccacactgtacatgggccaacaggtgtgtgtaatgagcaccatttttgtctgtgaagtgtggataacgcttcctgcatctgcatttgagagagggtgtgaccagcagctggcaggacctgtcaggtggtatgcctgggctgtcattaggattgggtgtggctcccaggtcttctgtttctagctgtgggcttggattaaggttcgctggctctgtctgcctcaatt

SEQ ID NO: 135115 - DNA, 871 bp, Homo sapiens
gctggagtcagctggagttgcccaggccctgtgagcaagtggcaggcgtgcccagctgcattggggagagggctgttctcaaggccaaggtcatttttggagggagaactggacgcctgatcaaatctggtaagttctgtaccaaactgtcctgtgcagctcagagcaggaccagggtccagtggaggcctgtgcccactctgtctcgcttgacatctgcaggggcacgactgggaaacctagcaggcaaagcctcccaggtgccctccgcatcacacccgctccctctcacttcccgagggggccgggaagaacctccttcctcctctcagaagggcttagacagaggcagcagctcacaggggcatctactctgcctgcttgccccgggcccacctcagctctggctcctccaggcccacaatggactcagcagccaaggatgagatgcagccggcgttgtcccctggacctgagtggccagagcaggagcgggcagagcagctggcccggggtgcagcgctcaagtgggcctcaggcatcttctaccggccggagcagctggccaggctaggccagtaccgcagccgcgaggtgcagcgtacctgctccctggaatcgcgcctcaaggcaggaaatgatggggagcctggagttggggcctgaggctgatgtgtcccagctggagccccttctgaccttggagaacattgagcagctggaggcaacatttgtggccaacatccaggcaagtgtgtctcagtggctgcagaatgcactggatggggaggtagctgagtggggccgggagcatgggcccaacacagacccgtctggctcctattactcaccaatgccagccattgtgctg

SEQ ID NO: 135116 - DNA, 815 bp, Homo sapiens
gctggagtcagctggagttgcccaggccctgtgagcaagtggcaggcgtgcccagctgcattggggagagggctgttctcaaggccaaggtcatttttggagggagaactggacgcctgatcaaatctggcccacaatggactcagcagccaaggatgagatgcagccggcgttgtcccctggacctgagtggccagagcaggagcgggcagagcagctggcccggggtgcagcgctcaagtgggcctcaggcatcttctaccggccggagcagctggccaggctaggccagtaccgcagccgcgaggtgcagcgtacctgctccctggaatcgcgcctcaagtcagtgatgcagtcatacctggaaggcgtgcagactggtgtgtggcagctggcccaggccattgaggtggtgcagggaacccgggaggccctgagccaggcccgtgggttgctccagggcatgtcccaggccttacagactctagagcccctacgggagcgggttgcccagcacaagcaactgcaggccctgtctcacctgctgcctcggctgcgggcagtgccggctgcagtgtcccacacacagactctgattgatggccaacagttcttggaggcatatgtgagccttcgggagctggagcagctgcgagaggatacgtgggcacccctggggggcctggagttgccagtcttccaggggctggaccttctgttcgaggcactgggccaggctgtggaagcagctgcaggggccgcagggaagctggcacgggaggacccagccctgttggtggctgctgtgcgtgtgg

SEQ ID NO: 135117 - DNA, 411 bp, Homo sapiens
tctaacagtgccaggtcggaacatcctggtgttggaactgcagcattctgaggagctgcaaattgtattggatttctgaaaggaaaagggggtaccaaaaaacagagaatttgttgattaagtagtgtttaagagcagaaatgtctgatgttcagtttaaagatgcctgcactgctgtgatgtaacctctgcttgcctgatactgaactctaaccatgtgtatcacatcctagacaggggagggaatggaggataattgacaagaacagcttttgatgttaaaactaggagccaaatgcaggcagggaatactgtgggaagagagcaactagagttgaaaggatggaattttccataagcaatacaaagatttttgatacctgactcctacttaaaattaattcgactaga

SEQ ID NO: 135118 - DNA, 574 bp, Homo sapiens
tttttttttggtttgttttttgagacacagtcttgctctgttgcccaggttggagtatagtggtgcaatcatagctcaatgcaagctcaaactcctgggctcaagggataagggatcctcccatctcagcctcctcggtagctgggactacaggcatgcgccatcatgcctggctactttttaaaaattttagtagagatgagatcttgctatgttacccagactggtctcaaactcctgggctcaagggatcctcctgccttggcctttcaaactgctgggattataggtgtgagccactgcatctggcccaaaaatatttcttaaactaaaaaatacatgggtgaatgaatgaattaatgttaaatccatctttaatgaatataatgaagaaacagtctgtgtacagtacagtctgtgtacagtaagttgaatgggttactattatcctcattagacaaatgaaatagatgagtcccagaaaggttaggagccaaaattaaagctactatacatagcttaaacaggtttgctactctttttcaattcactattgaaaggaacagacaattct

SEQ ID NO: 135119 - DNA, 788 bp, Homo sapiens
agctgtgtggctttgggtaaatgcccatctctgagtgtctgttcactcctgtatcaaagggagacaaatggtaacactcacctctcggggagtcctgaggatgaaaaaagatcgtccgtgtgaaaacagactatgtaagttatggctatgtaacttataggaccaaatgcaaaatgaaatcatggggcccattcgaaagttataaaagagttttgagaaggtgacagtagagtatgagacagtatgaaagcaagcataggcccttctgagcacagggcctgtgtgagtgcacaggctgcctgcttatgaagctgctctggatcagtcaggtaccaagcacagtgcctgacacagaggaggtgcccaagaaatgttcattcttttctttccttcaatggagccaaacaacaattctgacagtttagtaacactagatgctcccctctgtcaggagcagcacactttcactcggagctttgctggtaacctagctgcctcctgaagggtccagcagaactgagctgcccagttactgggggtttgcttccctccatgatgcccaaattgtgacaccaagataaggacaggacctctgggttaacagagctcctcctcacctccatctctggttcatccagatgatgtagttttcccagcaggactagcccttcaattcctgcctgacttgggttatgaactggcaaccctggtttgacaccccttccaagtagttattttttaattgtgacatagctaccaacatttaataagcaaaggaattcagataa

SEQ ID NO: 135120 - DNA, 105 bp, Homo sapiens
agaagagctaacaggggaaactgaaaagaaactgacaagggtgggtggggtactagaagagactggtatctctgaatccaacagaaggagtggcctcccccttct

SEQ ID NO: 135121 - DNA, 335 bp, Homo sapiens
acaggcaccagcagtgaggggcagggtgatgctgacgagctgtgccttcagctcactctgatgggcattgggagggtcggtcttagctgtcagcttggtcaggcgatgagcccaggtatccagtcgaacatgaatccaggtgttgctccgaaggtatttgtgggtgtgattaaagtccataatcagctgtgggtgtgattaaagtccacaatcagctgcctttaaaggaaattgtcctagatcacccgggtgggcttgatccggccagttgaaaggcctaagagtggaatcaatcctgggggcagcagctgcagcccatctgaacttcctgccag

SEQ ID NO: 135122 - DNA, 346 bp, Homo sapiens
ctgggaccctctagttgcaggaaaacaagctcagggctcccactgattctacgttatggtgagttgtagaatttttttcattatatattacaatgcagtaatgatagaaataaggtgcacaataaatgtaatgcatttgaatcatcatgaaaccatccccctgcctcccttcagtgggaaaattgtcttccacgaaaccggtccctgatgccaagaaggttagggaccactgcagtaaaggaccccttctttgactggcttcattcagtcagcatgatgatttttagggtcattcaagttgttacatatatccatagctttttctttttcattgctgagtaatgtt

SEQ ID NO: 135123 - DNA, 1360 bp, Homo sapiens
cggaaatgcacaagcctcttgatgcataaaaacagctgggctcccttggagacagagcgccatgggaaaccgggtctgctgcggaggaagctggtgagtaggctggaagggcaaaggggaacatctatctctgttggtggatgtagaggccccgaaaatcagaggacctggagatagttgtctgccagcctcccactgccaccttcctctgcctggtacctccttgttccaacaccagagcagcacctcctttcaggaggccttagaagacagagccaagtggctgggcgcggtggctcacgcctctactcccagcactttgggaggccgaggccggcggatcacgaggagctgcccatcaactttccagaagaaaaagaaaagaggaagccaaacaagacggacactgaagccgcagccacaacagctgcagcagaatctcccaaagggccatgaaacaacaggacatacgtatgaacgggtgttacagcagcaagggtctcaagagaggagtccaggcctcatgtcggaagacagcaacttacattatgctgacattcaagtgtgcagccgtccccatgcccgggaagtgaaacacgtgcatttagaaaacgctacagagtatgcgacccttcgcttcccccaggccacacctcgctatgacagcaagaacgggaccctggtgtgagcgcttgggaggaaggcccagtccatcgttaaccactacacctgtgggggagaacctactgctttggggaattgggtggcaacccagggatgttgtccacgttttaagcttaaagaactccaaagcccctggaattgtgggcgtcccattttctcccctggcctcttacttgccactgttaggttggagttaatagttggtttagctatgggtggatagctaaacttagctatccacatgaggttaggtggagtgtgcagggaggtaggtcttcgaccccaccattgttgctcctgctcttgcaaagtgcagaaagagcaggtaaaaagttagcccataagcacgtgggctgatcttgttggactttaattaatggtatcctttttcacacaccttaaactccaaagctgaaggggaggtgctccggaaaagcattctgagcttttacattcagacactagggctggcttgggccatttcctcagtggctgagtcaggttccagaccttaacagacaaatgggggaagggggctgaggcgtggaggaaacgctttcaggacctcaagtcagtgataaccgacagcacagtgaggcctggaaacttccctcggagggactgttggctctcgcaggtgcggggccgctaggatcaataaacggcctgagaaaca

SEQ ID NO: 135124 - DNA, 1105 bp, Homo sapiens
cggaaatgcacaagcctcttgatgcataaaaacagctgggctcccttggagacagagcgccatgggaaaccgggtctgctgcggaggaagctggagctgcccatcaactttccagaagaaaaagaaaagaggaagccaaacaagacggacactgaagccgcagccacaacagctgcagcagaatctcccaaagggccatgaaacaacaggacatacgtatgaacgggtgttacagcagcaagggtctcaagagaggagtccaggcctcatgtcggaagacagcaacttacattatgctgacattcaagtgtgcagccgtccccatgcccgggaagtgaaacacgtgcatttagaaaacgctacagagtatgcgacccttcgcttcccccaggccacacctcgctatgacagcaagaacgggaccctggtgtgagcgcttgggaggaaggcccagtccatcgttaaccactacacctgtgggggagaacctactgctttggggaattgggtggcaacccagggatgttgtccacgttttaagcttaaagaactccaaagcccctggaattgtgggcgtcccattttctcccctggcctcttacttgccactgttaggttggagttaatagttggtttagctatgggtggatagctaaacttagctatccacatgaggttaggtggagtgtgcagggaggtaggtcttcgaccccaccattgttgctcctgctcttgcaaagtgcagaaagagcaggtaaaaagttagcccataagcacgtgggctgatcttgttggactttaattaatggtatcctttttcacacaccttaaactccaaagctgaaggggaggtgctccggaaaagcattctgagcttttacattcagacactagggctggcttgggccatttcctcagtggctgagtcaggttccagaccttaacagacaaatgggggaagggggctgaggcgtggaggaaacgctttcaggacctcaagtcagtgataaccgacagcacagtgaggcctggaaacttccctcggagggactgttggctctcgcaggtgcggggccgctaggatcaataaacggcctgagaaaca

SEQ ID NO: 135125 - DNA, 216 bp, Homo sapiens
ggcagcaaaccaaacaaaaccagagtaatctggggaaaggtaactcgggccccatgggaacagtagcatggttcatgccaaattcctaaacaatcttcctgctaaaggtattagacacagaatctgagtgatgctatacccctcaaggatttaaactaatgaaaagtcaataaataaaagtggatttgttaaaaaggaaaaaaaaaaaaaaagaaa

SEQ ID NO: 135126 - DNA, 1030 bp, Homo sapiens
cactctgttgccaggctggagtgcaatggcgcgatcttggctcactacaacctccatctcccaggttcaagcaattctcctgcctcagcctcccgagtagttgggactataggtgggcaccataacacctggctaatttctgtatttttggtagagacagggtttcaccatgttggccaggctggtctgaaactcctgacctcaagtgatctacccgcttcagcctcccaaagtgctgggattacaggcttcagccaccgcacctggccagtaccacagtcttttaaattaccataatgagaatgtgcttattaccatggggatgggaccaagccattcataaggaatccactgccattacccaaacacctcccactaggccctatctccaacattaagggtcacatgttaacatgagacttggaggggcaacatatccaaaacatatcagaattgtatttcccagttccttccagaggcatgggcttctcacacctagagagcatggaagcagtaaaagaaaagctattccatgtccctcactcttcagtggtaggagcttttgcctacaaggcccttccagcatcaaaggcagaggcagtgtaggaagcaaagcatggcccaagtccctcttggggcttttattattctggcctctttttagaggaaaaaaaaatgattttttgtgctgcagacaccatgtccaattaggtttgtatactcattttaaacatcaaaatttaggccaggctctgtggcttacacctgtaatcccagctctttgggagactgaggtgggtggatcacgaggttaggagatcaagaccatcctggctaacacagtgtaactctgtctctactaaaaatacaaaaaacaattagctaggcatggtggcatgtgcctgtactcccagctaatcaggaggctaaggctgaagaattggttgaacctgggaggcagaggttgcagtgagctgagatcccgccactgcactcgagcctaggtgacagagtgagactccatctcaaa

SEQ ID NO: 135127 - DNA, 320 bp, Homo sapiens
ggtggtaccctagtttgagaagtttcaatagcatcctgacccccataggctggtaaaagctgaagaaagagaatcccacagcgttgtctgtgaccggtgggtcctcctctccctcccaccttttcttttccaacaggaaagggaggcggcgagggagatggtaggaggaagagggaagaaagaatgggggaggtgaatcctaatatgccttgctgtacttgcgataaatgccatttttttttctttgtgaagaaaaggagtggtagcttctcttgtgcaatcacagagcagcagatgcgcttctttctgcccccaaactg

SEQ ID NO: 135128 - DNA, 305 bp, Homo sapiens
taactcagactgagtttgtgcagggtaattataaatatacacaccaaatgagtttaaaataagatgactaacatattcttaactatactgattaagaatactcaaacatgttttaataacttaatccatattaactacaaaagttattgagaagtttccctccccaagtgggagacacattttcagttaattttgaaacagaaatagcagtgttactctaacatacaaatattctcaacgtcctatttgaagtacagtaacacaagcaaacatgggtggcattcccttgatgagatgaaataaat

SEQ ID NO: 135129 - DNA, 534 bp, Homo sapiens
atgtatgttatgggaaaacaaaaagtaggatttaaggttgtaaatatgtacttataataacagaagactagataaccaaatgttcaacaccaggaggtactccttaaccaatctatggtacaaaagactaccgtgagctaactgaaagcatgaagcagatggccacttgctactacagaaagactgccaagataggtcaacaactgagaagactgaggtgtgcaacagcatggatcatgattacaaggtaacaaaaagaaagagagaagggtggaagaagaagagactcttttttttttgaaaagaagtctcactctttttgcctaggctagagtgcaatggcacaatctcagctcactgcaacctccgcctcccaggttcaagtgattctcctgcctcagcctcccaagtagctgggattacaggtgtgcactaccatgcccggctaattttttatatttttaatagagatggggtttcaccatgttggtcaggctggtctcgaactcctgacctcaggtgatccgcccacct

SEQ ID NO: 135130 - DNA, 567 bp, Homo sapiens
ctcaaataaaaagaattatcctaattttcaggataagttctagtttcatatgtagtgcctgaattgaatgtattatcccagaagtgatctaatcagagctaagtacagcagggctatttatttttgtaacttggatattgtttccattactgcatccattcgcttttttgctgtcaaagcgtgtttcagagcatggtaatttagcatagaaatatgcagaattaagactgccctaattgcaggaaactatctaactatctaaaccgtatgtttgttcaggcaaagcactgtacctcacgcctgtaatcccagcactttgggaagctgaggcgggcggatcacttgaggtctggagttggagaccagcctggccaacatggtgaaaccacgtctctacgaaaaattcaaacattagctgggtgtggtggtgcacgcttgtagtctcagccactcggaaggctcaggcgggagaatcgcttgaacctgggaggtggaggtagcagtgagccgagatcacgccactgcactccagcctgggcaacagagggagactctgtctcaaaaaaa

SEQ ID NO: 135131 - DNA, 388 bp, Homo sapiens
ctaaaggtcgccttctggaagtggaggctgcctgctgggaaaacttgaagggagtttgaggacctggcccctctgtgtgcctccaagactctggggcagctctcgcccctttccttcctctccagtggggcagaaggcagctaagcccaagtcctggggccagaggcctgactccaagccatgggtttatgaaaagcaaatagatatcctgccctggctgaaagacgcacctcccttcacattggacgagagccctggcatttcattagtgccctctttgaagcctgccctttgcaaaactgaaaaagaagagaagggaggaaggaatggaagctgattcaaaaagcttcctgtattgtatctggaatttctgatgtccctctgtgtg

SEQ ID NO: 135132 - DNA, 434 bp, Homo sapiens
gctgcagtgagctgtgattgcaccactgcactccagcctgggcaacagagcaagaccctgtctcaaaaaaatcccaaaaagatatggagaccaatggaatagaatagtgagcccaaaaataaaccctcgcatatatggtcaaatgatatttgacaggaatgcaaaaatcattcagtgaggagagggacagtcttttcaacaaatgatgctggataaactggatatccacatgccaaagaatcaagttagacccttacctaacaccatatacaaaaactaactcaaagtagatcaaggacttctgaatataagacctaaactcttagaagaaagcacagggcaaaaacttcatgacaaaggatttggcagtggtttcttggccatgacacctaaggcacaggaaacaaaagaaaaaatagataaattggacttta

SEQ ID NO: 135133 - DNA, 192 bp, Homo sapiens
acatacatagggttcagagcagggcttcgagtcagagctctgagtgtctggcagtaactcccacaggaagctctaatgattcccagggatgctaaaggagcagccacacctaaaactcaccacactgctatgaaaggggctggacgcattggctcatgcctgtaatcccagaactttgggaggccaacctgg

SEQ ID NO: 135134 - DNA, 284 bp, Homo sapiens
ttgccttctgccatgactgtaaattttctaaggcctattcagccacgcagaactatgagtcagttaaacctcttttgtttataaattacccagcctctggtagtagctttatagtactgtgaaaacagacaaataaaacatttttaaatggcctcatgtattatgagtccttatatacatggaggcaagacatgtacataggaaaggatgatgggaaattttttcaaatttagtatgaggtataagtcagccaagtgaccttgaattaagagagggtaagaact

SEQ ID NO: 135135 - DNA, 743 bp, Homo sapiens
tatcggcgcatgccaccacgcccagctaatttttgtatttttagtagagacggggtttcaccatgttggccaggatggtctcgatttcttgacttcgtgatccgcccgcctcggcttcccaaagtgctgggattacaggcatgagccactgcacccggccgatgtcttttaaaagtgtgatgcatttaaatgagtcttataaattcagatggttgagaaaaaggagcaggaatattcaaaatggtcacattaggttgaaccaaaagaaaggtttatcttctcttctcatttggacctgcaaaaacagcattttcctacggctcaacctacactttccctagctgttcccacctctgcaaatttgattagtgtgtcttctgtgagttcatcctgatctccaagaagtatattttactaggcaaagagtaatccaggagtgcgccaaagtctatcttccaagttcatcaatttagcaaaaatatattgaacacctaggtatcaggcattttgcaaggcactagggaagcagtagtgaaaaggttagtttcactgctcttatggtgcttagagtatagtgggtggggaagccaacattaattacatagtaacacaaataaacatacatttaccagagccattatggaatcctaacctctttcatggtacacctttaatgtagtttctctaatggatttcattttgggaactatatctccatgactttaacagatgttagccataaa

SEQ ID NO: 135136 - DNA, 800 bp, Homo sapiens
catcccatctctatgttatgccacaatgcttctctatagcacacaacttggctctgaaattttgaaagtcaaaatactaatctactatgtgtctctgataaattgcctgaaccttacctgactttgaagtgctgcactcctaagactttttcttggaatgagttaaaagttttattccaagaatcctctactgagctagaaagcagagctgtgcatctctgtttcagtaaaaggaggtcaatatagggaactgtggtttctgagaatgcaagatctgcactaataaaaggattagccacagtgctacccaagagaaccagctaccaggagaaaagagggtctgtaaactgcaagatgatgacttcacttgatttccactgaggaaagctggcggctcagacttaaatttctccttcctagatggtaaacatctatggaaggttctatgaattataatgagttagtaaaacataatgcactgaatattagactatgtcagcagatcctgtaaccaaaacttactgaaaatataactatagtgggaggcaatggaaaagagactaaaggcttgaatggagaaaaaaagaaattaagtgtgtcttgtaagcctggcgtctgatcatgtcttagaggaagtaaggtataagctggccagagactcctttgtgacacaaaaggtgaagttacagacattccactaaatttaatttttattatgacataagacaactggtaatatgcaacatgattgaaaaaaacttctcattcaattcgattgggccttgacataagaatagaca

SEQ ID NO: 135137 - DNA, 742 bp, Homo sapiens
gtttcactgtgtcacccaggctggagtgcagtggcacgatctcaactcaatgcaacctctgtctcctgggttcaagcaaatctcctgcctcagcctcttgagtagcctgagtagctgggactaaagagtcttgctctgttgcccaggctggagtgcagcaacatgatcatcatggctcactgaaacatctgtctcccaggttcaagcaattctcgtgcctcagcctcccaagaagctgggattacaggcatgtgccaccacacctggctaatttttgtaatttttagtagagacagggttttgctatgttggccaggctggtctcgaactcctgtgctcaagtgatccagctgcctcggcctcccgaagtgctgggattacaggcgtaacacaaaatctctactagcttgttcatgtaataacaattgctgctggatgcccctaacattacagaaattgtgtcaatggcttgctgtgctttctctctgagtataacatcatcactaattttgtggctgttattagcctttttagctatagagtgacctgcacctgttttttgctaagagggttgcaactttgaataatatttcttatagttttttcttttctctgtctttagggttaaaataatgctttcttcctagaaggcagtatttgcccttgttatgaaaacaattcaccggtgtttggagattgttggaaaagttttgatgacctcatgccactagttggtagaatt

SEQ ID NO: 135138 - DNA, 123 bp, Homo sapiens
tgatcaagaaaacctgtgttgttccaaacctaagcaagaccttgcatttgaaagtgcagatagttatttccggaatgtttaaactctgcctttcaattatccaaatatgttctctttcaattc

SEQ ID NO: 135139 - DNA, 294 bp, Homo sapiens
tatgatatttaagtatgtcccttctatgctgatttgccgagcgttttaattataaacagatgctgaatttgtcaaattttttttaatctattgagatgatcatgtgatttttgtttgtaattctgtttatatggtttatcacatttattgacttgtgtatgttaaaccatccccgttaagtgatcacgatcagttttttcatctggatgatgggctgtaataactcctgcctcttaggattgttctgaggatcaaatgagttgatgcacgtgatgtgcttagaacagtgccagg

SEQ ID NO: 135140 - DNA, 750 bp, Homo sapiens
actgaattacagaattcactagagactcttgtagtagaaatccaaacatttatacaagtaacttcttttggagttaaagtaatattttcccctttgctctaattccgtccaaataatttggaattagggagtttgcttttgccagttggaagataaagacaaatgtggagactgaattagctctgtatatcctactttagatttctgatgtctgatttttaccttttttgttttataacttaaatagtattttaaaagtttattctgtatgtagaatatatggtatgttcagtgcacgagaactcaggatacaaattcctgttttagaaagcaattcacattttttttgataacgtttaatgtaacagctttttgaaaagcccaaagaaccgtagacggattgtaaacttctgaaggcaaggactatggcttattcatctttgtattttccctagaacttggcatactaccctgagcacaaaaggcaatgaacagttactttataatgaattgttttactacgcaatttatccaattacttttctgttacttttcaaaaaactaaaaatatctaaatgtatgtgttttcttatagtaataatatttctgaaatgtgaagaataggaatcagttaaagattaatgtcacttagcatttcagaattcagatttactaaaacatatattacaggataattactcatttttgcataaagatcccttttgaagtttatttgtaatctgataactc

SEQ ID NO: 135141 - DNA, 224 bp, Homo sapiens
ctcactcaaagcatggataaccctcaggcaataaaacattcaacatgcagatctactccaattccctctgggacctcgaactgtgcaggatcccagaacattgtaaatttcaccttggagttaattatttaatttttattatccatcctccctctcagatcaggtgcccaagtctcaatcacatgagcagcattttagactcttgtccagttagatccactctt

SEQ ID NO: 135142 - DNA, 159 bp, Homo sapiens
aaactatgtattctctcccattatagcctatcattacagatacttactgaaagcaattgacagcacagtcataagaaaactgtctctcatagggcttccacaaatccacataggaaatcaatttctacagtgacaggagagaaaaacacagacgtctgg

SEQ ID NO: 135143 - DNA, 152 bp, Homo sapiens
actgtagtgcagtggttaagaactttgtttctgaagtaagaatgttttaacttaaatacaagtttgttgtccctgtggtcttttgcaaattatttaacttctctaaactagtgggcttcaaacatggattcctgaatgtacagagagagttt

SEQ ID NO: 135144 - DNA, 837 bp, Homo sapiens
gtccttctttccagaatgtcttcccagagtaacccaacccttcctccaaactgccagtacagcctgacttctgtgcttctctcagctggaattctactgcacacacatctggctggttggcttgtttccctggtaatttagaagctgcttgaaaaaatctgacttttaaacatgcctattggtcagtggtctccaatgctttgccttgtgagtgttcattttaaaactgtggcttcctatacataatacctgtgaaaaaatgctggtatctactgggcaagaagttattgtgttctctctaaaccctctcaaaactatggctatcatatagacttggaggtagtgaggcttgtggggaacagaaggtaaaagagaaaaagatgctttatcatttaaatggtcctaagaaactaatttacacgctctgtttttaatctctcatataactataacctgtatacaactaggcccagtcactcttgctttgaagccaggtgcaaccaagggtaacagttaaatcgcatcactctgactcagaaagctttcaagaatttactagatctttgttgtaatttccttaaaactttctaaacatcctttttagacatgttttcttctgcctaagttttatgttgccatcagcaccttccctcaaattttagcagataaagtccctcgacctagttatatatcaaagaacacgttgatggaatgaaggggagccatgtaaattatttcattgtttagcttaattaacatttattgagcaccagctgtgtaccactcactgttttaagcttcatggttacaaagataaataagacataagacacaatc

SEQ ID NO: 135145 - DNA, 285 bp, Homo sapiens
tctgcaggatcccaactcaggcgttgagctgcttaactcaggagcgacgctgcttctcaggggcgagctgcagctcagggtgactcccatcttgtcactagccaggtgaccccttcattctggagccttagctctgaaagccgcaggtgggggtgccgtttcagatgccccttttccatttcaaaggctctgattctagatcttgaagccggatgcggcactggcacttggcttcagtttccactgtgacggacggaggtctcccaggcccagcccaggcagcca

SEQ ID NO: 135146 - DNA, 279 bp, Homo sapiens
ctggcctcaagtgatctgcctgcgttggcctcccaaagtgctgtgattacagacgtgagccactgtgtctgtcttgtctctgatatttatatgccattatgtggcctctactgccttaggattctaatgttcccactaagatcagctaactcagttccactacagggtttaccaccatcatctctcgcaaacaaagacagccacttcagagctcctaggaaatagtggtgctcccatcatcattgcattccttaatgacatggtgaaaattaacaatgg

SEQ ID NO: 135147 - DNA, 824 bp, Homo sapiens
ctttgaagcatacacagatgtacactatctggggaagcaagtcaaagccggaacaggtggaatgtcaaggactagacaaaagtatgatgtaacgtgaagcagagcttagaaagggctactagagaatgttacagaaagcgataatagtactcattgaataaaaattttattgtgaatgatcctgtgccagacactatgtgtattatacaatttacatgtgtaatttaatcattacaataattctatggcatatgcatgctcaatatttttttcagatgtgagaactaaaatgtagggagttaagtacttcacaccataaatatgtaagctgcagagatttgaaaccagttttccattgttccaaagcccatgtactcttaaccatagaagaacgaaagtcatttccactgcctccagaagccttttctctcttgcttactggaaaacatttcagtctggaaatacaggaattcactaatttgatacaaaagggccagtgagaagattctagctctatctgtattgccatccttgttaggcctctgagaaagctgagtttcatcaagatgtcattcctttctccaggcctgacctattcctactttaatgcactggggaagaggtaagtgattctaacctaatcacatatctccgtgctatgaatggagggtgtttggcggcatctccttgtgtccatgacaattcctttctctctcttcatgtgtatagcctttagttcatcctactctttgctcccatattacttccagggggccttcttttgtcacttgtctgctattctgttttaggtgggggaaggggcg

SEQ ID NO: 135148 - DNA, 548 bp, Homo sapiens
gttccatcagagttaagcaactataattctcatgtcagttcatcagtagacacttgtgaaaaaatgagtggatatgtatgactgaaagactgaaccaacaaacagataaggaccctgtttagacatcaggtctgtatgtaagtttccttcagttgcttgagagtacacacacatatacccgagtatgtcccctatatgtttattctctcttggaagactgagagagacgaaagaatggagacaattcttatataatcctctttccacattggcaaagggaagatacaatcacatattaatttccctctgggttctgccatgctgttggggcctaggtaaatagctatttggaaaatctggatagtcaatgttggatcattgaatactgcctcattttccagatgacaaaactaatgctaggcaccattaggtaacttgcccaaggccatacagctggtgagtgagaaatcaggaattgggtcttctgagtgcccttctccaccacccacctattgcgagcaatagaacatctagaacctgttctttct

SEQ ID NO: 135149 - DNA, 418 bp, Homo sapiens
ctccattgctgttctgttcccagcagtttttcttagtagaaggaggctttggctggctagtttcaagagcccttcagccttagactgctgcagtcccttcggacctggctgtgatcacttgcatccacctatagatggaagtgtgcaaagacccttctagttttggctgctattctcagctggctccctgagttttcctgtgaggtgcctgttgacagtgtcagggttcttctgctcccatccatcagacaccctgttgctatcctctgcttcctctgcacagatcctcatccacctggtcctgcagcttttgcccatttatcatccctttccagtcacttagttttctcttggctattatctcaagatttgagggattgggcaatttttgcacctcctctgctgtccccattctcct

SEQ ID NO: 135150 - DNA, 653 bp, Homo sapiens
gtctgaggccatagcccgtgattttggcactgatcatgccctccctgggggtagcaggagccattagttcaatcctagcattaacttgaccatatttggataaaacatcagtattgatcttaagtactattagcgagacctgcctatattaccagtagccaaggcagcagaagcagaaacagctggaaaaactacaaattggggccatcaggggcagatgtatcttggcactcagggctacagaacatgtggaaagaggcagcaacagcacctcctgtgatttttatgcaaagattgaggagggactcagagctagcatgtcagtttgttacccttgtgattttcgtccatgctcttgattattttttttttttgaggttatatgtccaggagactcaagagttatggaagaaaataatggagcaagaaaagatggagcagaagaaagggagaatggcccattattgggaaaattctgtctatagaaagaacactgtgattggttaaaacaaaagcagcaacaataaaattaccaaacgcctctgtgttctggacagtgtgctggacagaagggacatagagacagtgggacaaagtcatataactctattcatatctttatcttagctcttatattataatcatctacttac

SEQ ID NO: 135151 - DNA, 324 bp, Homo sapiens
gagcatgcctcactggccccacaagaagaaacaggcctaaggctcagtggtgtgctggagcctgctcacagatggcacatacccaatcctatgacctcatattagtaccttgcacaggccacagtgggagtgtttacaccacagaaatcagcagatgctgcaaattgagtcttctgttttgtttcctgagagcccattgttaaagcttaccagcacaccattgctctgtagacctgccaccttctcccaagcaaacgtttctgtgctgaggccttgtaagaacaatgtcctctgccatagagggcagaacccagaagagcgcat

SEQ ID NO: 135152 - DNA, 654 bp, Homo sapiens
cgccaggcaaaacctgcatctgggggcctcttccataggcacagttttattggatggtgtcaagttgcagggccacacagacacttcactttagaaatggaggacggatgctgtttttgttataatcttttatttcctctcttctgcatgattcttaatagtcccctgccggatctcccagcttccttttcatgctgtcatctcctgcctgccattgtcacctcacccttggacactccagtggccgtcatctccaggacagcccgtaaccctttagcttccaattcacgctatcctagcacatcccctgccggccggcccagtgctttcctgctgctgcattgggtatgcgttgcacgtctcccatagaaagtcctcacctccatgtgtttaattcctgtctccatggcacagcccaggtgtggtgctctccataaagcatgttccaatgccctgaattctttctttagggcctccattcttccatggagtttcgtggagcttggaggggaggaagttgggctgaaatcctgccatttccatcagctgtggattgatagttcttttcactgaacgccgttatcagaaagcatttcatattgtcctgtaagctgcaatacgtatttattccgaaaaggagaattgttggctcac

SEQ ID NO: 135153 - DNA, 301 bp, Homo sapiens
ttttctcggaacattgtctagattggaaggagccagctttgggctttaaagtgctgccaggtgtcagtgagagcagctttgctgcagagctgggtttagacagtctaagccctccttcccgctcaaagatggagaggttgcccttaaaaaactacgcaaacagtattagaaatttagctctccgggccaggcgtggtggctcacacctgtaatcccagcacttcgggaggctgaggtgggtggatcacctgaggttaggagttcaagaccagcctagccaacatggtgaaactccgtctcc

SEQ ID NO: 135154 - DNA, 746 bp, Homo sapiens
atccttatatgaattaactaaaatagtcacctctgtagacacagaaagtaaaatagttgttgccagggcttgggggatagaggaattggatattgctgttcattgggtaaaattttagttagcagtctgtctcttataactcacatgctttcagtgtgagagagaatagtttcaaaatggatggggagcagtaaagaaggaagaaaatgacctaagacacacacacacacacacacacacacacacacacacatatatatatatggatttatccatatataataagttacatatggatttatccatatataataagatacatatggatttatccatatataataagatacatatggatttatccatatataataagatacatatggatttatccatatataataagatacatatggatttatccatatataataagatacatatggatttatccatatataataagatacatatggatttatccatatataataagatacatatggatttatccatatataataagatacatatggatttatccatatataataagatacatatggatttatccatatataataagatacatatggatttatccatatataataagatacatatggatttatccatatataataagatacatatggatttatccatatataataagatacatatggatttatccatatataataagatacatatggatttatccatatataataagatacatatgg

SEQ ID NO: 135155 - DNA, 881 bp, Homo sapiens
caattctgtggagtacaaatgtgaacaaggatatgggatggtgttaatatataatacacaaaatggctcaagaagcctggaggctgttttgaacaaagttgtgaaaatgaacaaggtaggaacagcatgacagacaaaatgaaaatcaaaacctaggtcacgtaaaaaagaggtagaacccctagtttctagtccaaacaatgtcagcctcttaataccttcccaactacttacaccaggtctgaaatcacctcctccagggaagcgcctcctctcttacgtgtgccacgccatcagtgggatccaacaaaacactcaatttactcttctctctttgccatctgaaggctgtgggctctcctatgccaattctcacttgtctttacatccctggcccttataacaggacctgactggtatagactagcacatggcacacacacatgaaataacaatgaagaaataaacacctcttcagcaattaaaaaaaatacatcttaggtatgtgagaaatttgatactgagaataaaactggcatgggaatcaagatttgaaaatgtttatcattttaaactgagccggataaagcatagctgtgtcataaatttccacacatgtttgacaaagataccaaagagaaaccaatgtaaagagtattagatgttaacccctttgaagataggctgtcttatttatcaagcctaataagaagtagttattccataattatatgttgaaggaatgaataccaaggaatcaatcattacaagtgccaggaggaggactaacgtttaattgataattatttatttaaactaaatgaaaagtcgaattggcttcatttgatggctcatgcctgtagtcacagcattctgggagg

SEQ ID NO: 135156 - DNA, 384 bp, Homo sapiens
caaataaaaatgaacctgagtaggcatggagggactattatacttagcattaaaaataaacttatctaggagagaaaaaagaatagcattccacttacatttgaagtaagggcatctcaaggatgatgaaggatcactatttttcaaagccagaggattccaggctaggttgcagtaattaataggatgtaatatatgaaatggacaaaacatgatcaatgtttaatttccaagtcctaattcaaagttgtgttcctggacaattcggtggctgtcttccatgtggtgattcagggatccaggcttcttccccactgtggttccactgcccctgtggcctcattgactgcacctagttggcacaagtggaaagatagcatgagg

SEQ ID NO: 135157 - DNA, 570 bp, Homo sapiens
tcttcatttggttggaaaatagagttgatatgaaccagttcagagatacgaagtggagaccgggtacagttggaaggacagatgtaacttggctgtgaacccataaggagaatagcagccatcagtaaaatgaaaaattccttatttggttagaagcagctggcatgagcccatgaagagggaggagatggtagagtttgtgaatcatacatgaaaatgatcaaggataaggccttgattcagttctcctggactgtcaggtgactttaatctacagggaactataaagaggcatgaaccctggcagccatggtgggaagaggtacagggcattgggcaggtataatttctgtaccttgctagggatatatcccaagggagtgtggaaaatggctgagggcaaacctcaactcccaccaccgaggaacattaaaaccagagacataaacagaagaatagctctttctgcccaaagaaatgaggggtttatttgtgttttctccattttttaaacatcgtctttaggctcctgaagaggacagcagccattggttaaatgttaactttaaa

SEQ ID NO: 135158 - DNA, 202 bp, Homo sapiens
tttctaaactctcaaaagtggagcctggcaagcccactcaaagcttcagatccacaactggcacagcttcccttccacagattctataggttaaaacaatcaccggaccagcccagattcaaaagaaggagaaacaaactccacccctccatggaggaagtagcaaaaataatgtagacagtttttaccctttacatctgga

SEQ ID NO: 135159 - DNA, 234 bp, Homo sapiens
aggatgtggaggaaaggtaacacccctacgctactggtagggatgcaagttagcaaagctactatggagaacagtttggaggtttcttgaaaaactaaaaatagatctgccatatgatccaccaatcccactgcttggtatatatctcaaagaaaggaaataagtatatcagagatatctgcactctcttgttttattgcagcagtattcatgatagccaaaatttggaagcaa

SEQ ID NO: 135160 - DNA, 218 bp, Homo sapiens
tagctgaccgacgactaggcgactccaggcccacgaacagcaaagaaacaacctctggggtgggcttggagacctgggcctgcacagcttccttggtaaactgaggaggtgtgtaccagaggactgtcagctcattcctctccacacccaatactgtgggattctaggatacagtttgtcactgttgatggctcaatcttatgcactggacaaagata

SEQ ID NO: 135161 - DNA, 349 bp, Homo sapiens
catgcttgtatttgttggtatttgttgtcattttgcacattttcgtgaagtacatgtacgtattgttgcacgtactgcatacatcctggtagcctagaaaatgtaatatatttatgagctctatattttaaaaggaaaaacacttctcaaacacacagacttttcttcccaagctagacttgaaacagggttaatacatggcaggctaggttagataggtcaacaggattgatggaagggcacaagaggaagaagcctgggcttatcagtatcaaactagaccgttcgatactggatttcacagactgtggttggtttgggaacatgcaatcctagagacatggagcag

SEQ ID NO: 135162 - DNA, 424 bp, Homo sapiens
ttttatctttatatttcatagagtcaggagtcttgctgtgttccccaggctggtcttgaatgcctggccttaagtgatcctcctgcctcagactctcaaattgctatgataataggtgtgagccctctgcctggcctagaaacctttaaatgtatgctgtggaggaagtttactctaatttgtatcttaagtagggatgtaatctaaatgtctcttcatgataaaagtcaaatcatgagctaaatccccttttaaatgactcatttgcagagtagctccatttctacatttgcttaccttacctagagagatgttattagatgagttcagaatttttctctgaactaacagtggcaatgcagagtacaaataatatcaagacattaaagacctaactttgcatgattccagtataatgttacat

SEQ ID NO: 135163 - DNA, 419 bp, Homo sapiens
ctgtctgcccataattaggtccttatttcatgtgattaggtactttttgctgaatagcctgggcaggcccttttactatggctttggtctcaccccttggatgaccattttggtgctgtgctctccattctgaactttttttagagagggggtctgggtcttgctatgttgcccaggctggtctcaaactcctgggctcaggagtcctcccacctcagcctccgagtagcattctgaacattttgctcccagttcctagggcttgccaggctcctgctcacctttgctcacctttgtgtgtactgtttctctcctggaacgctcttgcccctttctacggcatcctgggagccctccttttcctcaacttcatcaggttcctggagagccactggtttgtgtgggcacacattatggag

SEQ ID NO: 135164 - DNA, 310 bp, Homo sapiens
cacttgtgagtggcaagagggtcagtagaaggcataggccagagatttcccccaccgttctttgcatcatcatcatcaccagccacatttcctttgtggtttactccctctgaacaaacctgctgtgactccagcttccctggtgacccaggcctctgggcatcaatagcaccatctcttcccattgtcctttcagcatagggacatagagacacagtccttcacctaaaagagtccactgactattagggaaggatggatgtgtaacacagatgtctgtaatgcagcaagaaacagagaggaaacagat

SEQ ID NO: 135165 - DNA, 389 bp, Homo sapiens
tccttacagggcatattaaaggaatcattctagagagctgcattcactgagcgtaatacaaatttcaggtgtaaatttgtgtccttggatacaaaaacagcttattctccaagtcagaagacatcacctaacttagttgacattcctaaattgtagaagacaaaaacactacctttgatgcatagcatacattaatcttccactgtgaaattttagaaaggaagagtggctaggtgtttctcataacctttgcagattacactaaggttgaagctgccagcctgtttggttgtgtatctacaaaccccggttccaatagagacccattatttaagtttgaagattgctgtttaacaggcctgttacttcagcagcagaagagccatttt

SEQ ID NO: 135166 - DNA, 319 bp, Homo sapiens
tgcatggatggatggaaggaaggaaggaaaatggagagaaggatgaatgaactgatggatggatggatggatggatggaaaatggaggaaaggatgaatgaacagatggatgaatggaggcatggatgcatggattcatgtatggatggatagatgggtggatggatggacaattagatgtttcactgaataaatagaagattagatgaaggatggatgctagatgaatcttggccctgctgacctctccagatttatctcccactatttccaccagacatgctaaaagctcacaaaattgaaaaatgtcatggctgtg

SEQ ID NO: 135167 - DNA, 745 bp, Homo sapiens
ggacaaagctcagggtcactccaaattttgtaagtcttcatttggagatggaacatcctaatatttttaagataccgacttaatatttgcacccaagttaaagattcctcttgatcagaatgaacaggaagctttaagctaagcacagtgctaccaagaagcaccatgttgaccttgaggactctggcaggaagctgtttgtggttgtcacacctagtttcctctgtgaaactactgctgcctgtgggtgatgtggttatatgctgctggctgctgttgattctcctgtttgtgtacaaggtgtttttccctcccagtgcctcccaatgtaggcatcggttcatgcacagtgaagtagttggctgcaagaaaccttgtaaggcagggagcagccttttgaatgcaataatctacccaaatcattttattgacttaattatagaatgaatttctttgaaacaaagtgaaagtcttagttgtattacactttaagacatagagaaaacatgtaggtttgtttctgtatacagtaaatttctgtgcttttctatatcttatgaaacttgaatagttggctctgttgccaggtgaaagttttgctaggttttttaaaaaattagaataagtacatttaatacacagggaaattttatcttgaatattaaaagacattgttaagctatcttaacctttcagagtttatttgaaaaatcagaaagatgttttactggctcctttgacacca

SEQ ID NO: 135168 - DNA, 785 bp, Homo sapiens
ctgtattcacctatattttaaaatagttgtttaagctttagttttttttaaataacaaacctttaacttgttaattcattgtaatttcttttagtgtatgacatgcagtttttacctaatttaaaatcatttaaaaatagttaactgatgctttggcatcatttggtcttcacatttattttgatggcacatttattgtatattaggttctgatatatactagggtgtgtttttggctaaactgttcagtttctgtttacatgtttttgattattgtagatgtataattttcctatgtattatggaaaattctttgttatactgtatttttagaatcttcttcttgggtagtataatccatttatcttctagattaacttaggatctctttttttattttaccagagtgggttttgattggcactgaattaaaatgataaattaatttgtggagaatttacttctgtcttatctaagacagaatatctgtacagtttttcaaaactgcttttgtgtctctatgtttttacttttctttgtaagtgtattatactttacattgtaagattgcttgttagtattttatgttttgggctacaattatcaatgatgagcaggatttatctcccattttctttttttttaagctggctattgttaacatgtaaaactttattcttatggtcttatttttcatccaattattttgaaagttgtataattttttgttggattcatgttcattgctttgttttgctctaattctctgtttttagtagatatac

SEQ ID NO: 135169 - DNA, 405 bp, Homo sapiens
attcaggccacagcatactgcttaaggatacattatagtataaaacataaagaatatttttaatagaaatcattgtgtcaacccacaagtaaggactaggcatgcacaacacattaattctgagatggatacactgtaatttgagtagcaattcataggtagactccaggggtttagaaacatcctcccacccgctgcagaagaatctgttctcataacaagcatggcctagagtagaaagccctacaaaaaatacgtttctcaaaggacagagctagtgattttcatgaaaatatactttgaatcaggatttccctaaagaaatattgatgaagtcctgtaatttcctccattaaaatgccactctttaccaagatgtattggataaggaaacacaaactgttt

SEQ ID NO: 135170 - DNA, 274 bp, Homo sapiens
agaaggagtatcttataagttacctagtcaacgttctggcttctgggcagaaaactatctaaactcagccagataatcagtttcaactaaatcaggaaaacatggaatcatctttatctaggtagtgttatagttacattgcctcatttatctacacatcaataaattctttctcattgctaatatttatcattcttatcatagtataagcaaatgttttaattctattatggtaaagataaagcttctgtaattaaaacactttaatctggaa

SEQ ID NO: 135171 - DNA, 475 bp, Homo sapiens
agtcaaataacaattgcaacagtgtgttctgctctgggtaacacactctgcaagcagccctgacaaattaacacttccccgtaaattctctccaccacctccacacaaagaaatgagtagttatgggattaaagtgcgaaataagtggggtgggactggggttgtttttgtaattctggggtttgcaaaatcttctgacattgcataactctcctaaaatacaatatgcaaaatgaccaataatatctatctctaatggcctctgcctctactcttatttaagttacccaagaatgccaaaagctatcaaacagggttctgatcttcatagcatggtttatacaaattacagagtgttatactttaacttaaagaaatctttctcttgcgtgaacccgggaggcggagcttgcagtgagccgagatcgcgccactgcactccagcctgggcgacagagcgagacttcgtctcaaa

SEQ ID NO: 135172 - DNA, 201 bp, Homo sapiens
cttacggcttgttccccctgtcctggaggtgctggctgccaagctggcagtgacagttttattggcaggcaggcccgctagaaggattgtaggctatttacagtgttgaggccatggctttgcaaggagacagttaacataaattcacatgatggatccgttatcacttcattgaacttgtggcggacccatcgaaggccg

SEQ ID NO: 135173 - DNA, 459 bp, Homo sapiens
ggatggagttgtaaacaaccagacctccaccctaggtccccatctcttggctctgtgcccacagccctggctccagctctcacgcccccttcacatgcctcatccagttcagccaggcatgtgtctccatcactcctctgagactaccctggttacaggcaccaacaacctccaggccgccaagtcctgaggtcacttgcttccttcccagctgctctcctccttctggggcccactccccctgggctttggaatggttcttctctctgtcctacttcattggctgacctgtctctgtcttagccatgctttcttcttttctaccgactgggaagatagacgggcctgggctcaggtttctttctttcctgcacctgccctctctcccttagtgatttaactcagactcagactttgtataccgtctatttgcagactctcaaatttttatgtcctgcc

SEQ ID NO: 135174 - DNA, 685 bp, Homo sapiens
aagtctagtggtagaatttcctcttcctctcagttttactattaagcccttacaactgactgggtgaggcgtactcagattatttaggacagaatagtcttctctactaagtcaaatttttgcgtatgctaatgacatttataaaatacatttacagcacacctagattaatactgaattaaaaaactggatactacagcctagtcaagttgacacataaaactagccaagttgatacataaaactagccatcatactaacaaaccatttatggggaagtagtattgatagactgaaatttgggttctagagttactcattgctattagttggttactgtttataggtccttttagcagacagagttagaaaatacatattttttaaaagataaaataggtttaaactgatacttcatattcaaattcagaaccgtatgcttctatttaaccttacaaattttactgtacattttatcttctttctgttacaatggtcatcccaattactgcattagcatggagaaatattcatttccttcatccacaaatacacacttagctttagaatcactatcccaaacctaccaccaagaatgtgattactgaatctatttacaaatatttattgcagtgctttaggtccttggaatatatctcattatggatgtgcagtcaaaacactg

SEQ ID NO: 135175 - DNA, 747 bp, Homo sapiens
gtctcaaaaaaaaaaacaaaataaacgtatatgttttgtacttttctgtaagtatggcatattttatatttaaaaaagaaaaagcatggaattagtaaaatgatagatatatgccttaaatatgtttaatctaaagctcaccaatatacttgtacctgccaatcttttaatattatgatttatctttttgttctttgtttttactatgcattatatacttttaatgatttatctgttgtacagagttcagagtaatctttctttacacaaatcactttcgttgtgtatcatttataatttctagttttgagggttttttcatgaagaaaaaatattctggacatgtacaacgttttcacaatcttgcacagttgttatacctttgcctcacctaatagcaattttgtttactcctgagtctttccaacaattttttagacttattttatcagtttatttcataggtaattaaattatagttataaatataaatggcacaaatattgtacagtctgttcttggaggcatacagatgaattgttggagcagaaatgtagaggagtattagagagcacctactggctgtgtgtgttcacattgcctttggcattggtcactatgcttgagagcaagggtggataaacattttctgtaaggggccagatggtaaatattttagggtttgtgagcccatattgtctgtgtcacagctactcaactctagtgcaaaagtagccatagataata

SEQ ID NO: 135176 - DNA, 616 bp, Homo sapiens
ccacatactttatataaaagttcaaagaagaagaaactatcaagtaccttaaagccaaagagctagaattaaagtattatcctgatcctaatgatataatacataataaaggcatcatcaccaatcaccaccagcatcaaaaaagcagtcatcaatcagtacttgtatggcactatacagcatgagtcagccagccatgattcctggcttcaaggagtttataatctaaagacagacatacagacattaagagacaaacagaagaccataaccataaaatcaaatagtctgcagtatgtaattacatcaagcacaagtccaaagtaagcacatctagaaatacgagggcaaatatgaagtgataataagtgtcttttttttaaatttcctatactgctcatctgcaagataagtgtctcttgaaagctaatttggatatagaattcttatgactaacaaatttttcaagtggcagaatacatctgttcaactgacacagaactgctatagattcactaccacaccaccaacgtgacattcaacttatcactggctcaacattaactaatattctcctttcttcaaggtcactattcacactatttcctgcttttat

SEQ ID NO: 135177 - DNA, 345 bp, Homo sapiens
ggttactaagaatgcagttccctcgttatgtaacatgggcaaaaatagtgttttgggccaaaatagggctgagaaagaggaatgtgaacaaacagcatggacaagtcattatttactcaaatcgtcctgtggctgggggggctttggaagagctttgatggtgtcccatctggccacagccgaggccacctttctgaagcaaagtttaatggaagcaaaggtgtctgtagaggaggctgttttaaggcaagccctggcccagcacacaggcaggctgggagactcctggatgagtgagggacggagactgcctcctgggacaccatcccattttggggcacatgc

SEQ ID NO: 135178 - DNA, 483 bp, Homo sapiens
ctgtaccctaattgataaagttctttcccacagggcatgggttaacaattctgatcttgtaattcatgtatactgaaatggaatgattacttacatcacacataggtaaaaacgatggcaaaaaaatgaatatgaactttagataataactgtgttaatattggttcattaatcataacaaatgtaccatattgatgtaagatgctaatactagagtagactgcatacattgtatgtgggagctctgtgctatcttcacaatttttctgtaaatctcaaactgttctaaaatgaaaactttattttaaatacacatcaaagttttaaaaattacattattttctagcaaatattgcctatcagcagtctagctttaataaacaaaacacactgatttgaaattagctatcaacatccccatctatggaatactgaccttcacatgtgttgatattgtgctatttgaatataaacccaactttc

SEQ ID NO: 135179 - DNA, 482 bp, Homo sapiens
gcagggctggaagagcagtcaagggtaaagaaagcagatgctggcactagtctggattagtctcatccatttggaagcctggaagcacactcaatcccatgtgcctgctgttaatggtgcctgtgagtcctagagatgcagtggctgctcccagctcccttgggtgacctttgagaggccactaggcctgctacactgaccatcaggcagcctagccccttctcactgcttgggggtagggggtggttagcctgggtgttgtgtggcagccaagaaagaacaaaaggcttgttcactgacttagttcctctcctaagggagtggagtggtgttgacttacagtttttccctcccctttttatcagaaaataagacctccctctgaagctagtgcagacagtacacttagctcctcagtcacagactggccatttgaacctcgtggcctagactaccaggacaaagacccggccaggctgagc

SEQ ID NO: 135180 - DNA, 318 bp, Homo sapiens
cagatttcagactcctttgcttaacacaagcccctctgactgtacatgcatagaaactacctatctctccagcgcttccttccatatcgtcacatgaaacacttgcttctgccacactgcatgtttgtcagcggcaggttttacccatgatgcctacatatactagggttccctctgcattcatgagcttctcttagtccttccgcacgtagcctgaggctcccctgcacctcctagtggctatgcagccctctgcacccccaagacacaaggcaacacatgcttagcctgccatagacctcccgggaaccccgcacc

SEQ ID NO: 135181 - DNA, 1155 bp, Homo sapiens
tctggaggggacacggtcacactgcagcatcagcacccggtgaatgtggttctcttcccatgtcagaattttgtgagctccacacgggcagggttgcatctgttttattctctgattgattctaagccccatgtccctggcacaggatggctgcttggcagtagggagtggatgaaccagtagtacccagggctgccaggcagggccctgcaggggacagacccaagggctgatatggggacacctgctgaggggggaatttaccacggtaagggcagggctgggaggctgggcagccagtttcaccctcgcacaggctgcctggcaagaccagcggctggaggtgatgtcctcagtagagaacggtggccactggaaacgtgtggccagaaggggaaacgctcgggcctctggtgggggccagcctggggtggggtcggccagggtcagctgcctttccttcatgctggggaggagatgttgtgtgcatgtgagaaagcatttgatagcatgccaaaagtttcctccattatgtgcgtgtcaagtgtttgaccaggtcagaactcttgttctatgcgaatgtgctcacgcagacagaagcggaggggctccgtcgctctgccctcacgccgctgaaccgcgagggtctcccgctcctcaggcttgcggctcggccgcgaagtgtgtcaggtgtgcatcctggggtgctcctttgtgctctgtcctacggtgacacaggcggcgtggggttagacaggtaccggtcagactacggtgacacaggcggcgtgcggttagacaggtaccggtcagattacggtggcacaggcggcgtggggttagacaggtaccggtcagattacggtggcacaggcggtgtggggttagacaggtaccggtcagattacggtggcacaggcggcgtggggttagacaggtaccggtcagattacggtggcacaggcggcgtggggttagacaggtaccggtcagattacggtggcacaggcagcgtggggttagacaggtaccggtcagattacggtggcacaggcggcgtggggttagacaggtaccggtcagattacggtggcacaggcggcgtggggttagacaggtaccggtcagattacggtgacacaggcggcgtggggt

SEQ ID NO: 135182 - DNA, 903 bp, Homo sapiens
tctggaggggacacggtcacactgcagcatcagcacccggtgaatgtggttctcttcccatgtcagaattttgtgagctccacacgggcagggttgcatctgttttattctctgattgattctaagccccatgtccctggcacaggatggctgcttggcagtagggagtggatgaaccagtagtacccagggctgccaggcagggccctgcaggggacagacccaagggctgatatggggacacctgctgaggggggaatttaccacggtaagggcagggctgggaggctgggcagccagtttcaccctcgcacaggctgcctggcaagaccagcggctggaggtgatgtcctcagtagagaacggtggccactggaaacgtgtggccagaaggggaaacgctcgggcctctggtgggggccagcctggggtggggtcggccagggtcagctgcctttccttcatgctggggaggagatgttgtgtgcatgtgagaaagcatttgatagcatgccaaaagtttcctccattatgtgcgtgtcaagtgtttgaccaggtcagaactcttgttctatgcgaatgtgctcacgcagacagaagcggaggggctccgtcgctctgccctcacgccgctgaaccgcgagggtctcccgctcctcaggcttgcggctcggccgcgaagtgtgtcaggtgtgcatcctggggtgctcctttgtgctctgtcctacggtgacacaggcggcgtggggttagacaggtaccggtcagactacggtgacacaggcggcgtgcggttagacaggtaccggtcagattacggtggcacaggcggcgtggggttagacaggtaccggtcagattacggtgtcaaactcccggttgggatcctctagatctgacctg

SEQ ID NO: 135183 - DNA, 266 bp, Homo sapiens
accctcagtgggctcaactttggccagtctctcttcctagacttagatacccctacgggtgttcagtacccactcacgatgttcttcctccctcaaaactctctctccatcctgtcctcctctctccatctccatgtcatggcctgagttccagccatcatcatccttcacctgaattattttaatagcttgtaactcattcttcctccaacctaccccccacagagcactctcagagtgatctttcccagatttaagcctgattt

SEQ ID NO: 135184 - DNA, 245 bp, Homo sapiens
gtcggagggaatttcagggagaggcttggccagacctgattggggaaggcgactgggatcggtccagggggctcctatagtgggttggccgggcttggctggctctcattcgaagaggcagcagagacctacctggggactgctttgggcctgattaaggggaatccttagaatttggctaggccacagagggggatatctggcatccactgagcttgaagggcaggaacaggggacaggagaga

SEQ ID NO: 135185 - DNA, 326 bp, Homo sapiens
agccgccccaagtggctgggactaaaagtgcatgccaccatgcccagctaaattttaaatttttttttgagagacagggtcttgatatgttgcccaggctggtctcaaactacggagcttaggtgatccacctgcctgggcctcccaaagtgttgggactacaggtgtgaggacttcatctggccaggctagtctggagctcctgacctcaggtgatcctcccgcctcggcctcccaaactgctggaattacaggcatgagccaccgctcggccacctctggagttctgattgttcccacagaagagacagatctgacaagtgggg

SEQ ID NO: 135186 - DNA, 483 bp, Homo sapiens
tgcccaggccgatctcaagctcctgggcttgagcgatctgcctgccttgttgttccaaagtgctgggatttacaggagtgagccactgtgcccggccctcataattttgtagatattgttattcgcatttgatgagtgaaaaatgttgatgctcataccgcttaagtgatgtggtcaagggccagcttggttggtaagaatgtcagttcacccagttccaatttgaatgttctttctgccagagagaaagacctccgcactatcacgtgatcttaccttctgtgtctgtgatgttcagtctgagtggtccaggtagggggagcctacgtattataggaagatccgagggtgcaaagggctgagaagccacctaccaagatttcagcctgaaacactaaagccaggggttctcagaagcctgtggaaagctgctgtgaagctccctctgcactgggggctggataaagccaccaatgcaggata

SEQ ID NO: 135187 - DNA, 781 bp, Homo sapiens
tctcagtggtccacagaggctcagggcaggagcaagatcagggttcgggtgctggcgccacccctcgtttagcccctacctgggatctgagtgagcacccatccttggaatgcaggataatagggttgctgtgaggatggaaggagactgtgcccatgaacacttgacacagctccctgccctggggaaagcacccaggaaatgcgggctgtttgtcttagtgatgttccacttaatagcacttgcggtggctccctggcccccgaggagcccaccttgccagttcttggccacaggagtacgagcccctctgtcaggacggtgggtctcgttgaggccatccttatcctgagcaacctaaagaactcacatggaacttagcaaacaggcagacccttgccttgttctcagggctgtgtgatcccgggtgagcaactcggcctctctgaacctggttctcctctgcaaaacagagatgatggcctgggaccctctcccactacagggaagtagcattggagggggaagagacagggggagcgtcccagcactgcccaaaattggacaggtgactttggacaagtctgaatgagactgaataagacaaaacggagtaacattagagcttgctggctactctctgccctgggccggtgctagatgttttacatgcactgttaatcactgttactcgtggagggagattttattattaactttcttttccagatgaggtaactgaggctcagagaggttgattcactttctcaaggacacacag

SEQ ID NO: 135188 - DNA, 103 bp, Homo sapiens
tcgtccagagtctgtgctcttatcattatgctgcactgttgtgttgcatggtatggaaggaaatagggtctaaattctagatctaccacgtactcactttgac

SEQ ID NO: 135189 - DNA, 378 bp, Homo sapiens
ctaaaaaaatgtggcaatgggttgatctaagtgactaatgcatgggaaatttttttctttaaagaagtaaggccaggaagcagaaattgccatctacagccaacaacagagatgcagattcttactttggtcactgaataaggtatttttcaaatattctccagtatttggcaagtttggcatatagtaaacgcacaataaatatttgttgcatgaagaaaaattttggtatttttgactgcttatactgaaaacaataacatgaatgtttatggagcatttaccacatgccatgcagtgtactaagcactttactttcattgtctcccttaatttcaacatcaacaccatgagggtattatctgcattttacaaatg

SEQ ID NO: 135190 - DNA, 629 bp, Homo sapiens
attgtggtctctgctggcaggacaaggtactgagggggagactgaccttacatcatgggcagctgctgtgccttagaaggacagcagatttgttgttttgtagacaccatgcggaagcagagaagaaggtagtgacatgcaaaatggtgtcttccctacggcaggatccgcagatgcatggagctgcacccagggttgagtggagacatgaaaggcttgggcttatgtgggaagctgtgcatgcaagaggtggcgggggtttctcagagcagaaaagcccagggcagacgttgaattcgctgcacttcctggacagaaacactattgggatgggcaaggcaggattcaaggcagaggtgtgaaggctcgccatagaggagggcttgttgagtgtcactcctggagcctacggagtcgcagggaggcctggcatggtcaggtagacttggtaaggcctgactgctggggaatgtatcctgccaatagattcctgggcctggaacagctcttctttggacacatgccatccatttttggaataagacaatctggcatttatgtacctggtgggttaccctctgggcctttttccaagaaactaaaagtttggagacactttgcatccagag

SEQ ID NO: 135191 - DNA, 159 bp, Homo sapiens
agctgcttcctcccagcactgcctcaaaactcccaaccaccattagaaacccccagggagccaccaaggtctaagaaggaaagaagggaagggttccccccaccaaacagaccaagtgggggaggacagggtggaatgaaagagagaatgcaaaagctc

SEQ ID NO: 135192 - DNA, 274 bp, Homo sapiens
ctcaacaggagtagggaatttgaaataaggagttgagaggtcaaaggtaaggggctgaatgcaggaccagagagcttcagtagcatcttgatgggcagagtatgagatgaacagtggcaacgaggaggatagggaaaaatcacattttctgtttgtgttttgtttttgtctggtggttttcaacctctctctgtttcacttgactatgcttgattatgaaatcttttttttttctttttttaatttaaagatctcaactggctttgttgtgatt

SEQ ID NO: 135193 - DNA, 813 bp, Homo sapiens
tgctttaaaaatagtatgaaatgaatatgatttttttttctaaaattaggtttactgagatacattttataaaagcaaaattcacagtttgggtgtgcagttacatgacttttggtagacaaaatcacttatgcaaccaccagcagaatgaagatatagagtattttcgtcacccccaaatctcccatgtgtacctatgtagtcagtcccctcccctgatctccagcaaatggcaatcactgttctgatttctgcccctaaaatttgtccatttacaaatgtcctataaatggaatcctaaagtatgtaacattttgtttcaggcttctttcactaagaataattcttttgaagttcatccatgttgtagcaggtatagtatttcttttttaaaattcttgagtagaaattcatcatgtagatgtgccagttggttgacctattcatcagttgttgtacatttggcttgtttacagtgtttagtgattctgaatcaggtcattataaatattctcttatgggttttgtatagacatatgttttaatttctcttgaataaataagtagtgttagattgctaggtcatatagtaagtgtaggtaggattttaaaatcctcttttgtaaaaacttgttttaaaaaatattttgtttcataatttaaaaaaatatttgttttaaaaaagatttacaggaatttggaagatggtacaacaatgttctgtgtacactttacccagtttcctccaatagttaagtctttttttctttagattttctttgtttctaattcatttgactcacaaaataaatg

SEQ ID NO: 135194 - DNA, 160 bp, Homo sapiens
gcagatgctaccttgatcctctccccttaactcaaagggatgccctcaggaagacccacaacaaaggaccaaccattcttctgccaggtgtccacatcctgtctccctgctgcccactgcctgcttgcttggaaatatttgctgctaaaatgtggtccct

SEQ ID NO: 135195 - DNA, 400 bp, Homo sapiens
tttatttgtgagcaataaagctttttaatcacctgggtgcaggcggactgagtctgaaaaaggagtcagcccttttcatccttctttaccccctgtggaaccataattctgagtcccgtgatcttctccatgtacatctttcacactgtgctcagcttccaatgcctggggtacactcttgtgtattcctttcatttacataacagatgatcctagagtacagtctcttagccaagaatgagaaatttttgtcttgttttttcctttttcattgtataagtgataaattccttcccaaagttagctctcttgcttctctaagcaggataattgctaaggaacattgtggattgaatgaggaaagtcctttcctcttatcaatgctctttcctcattgtcg

SEQ ID NO: 135196 - DNA, 271 bp, Homo sapiens
aaagaaacacagggcaacaaaacaggcctaagtgggcacggtggctcacacttgtaatcccagccacttgggaggctgaggcaggaggactgcttgaggctaggagttcaaggccagcctgggcagcatagcgagaccctatatctaaacacagaaaataaaacaacaggcccaggtcagcagaagaggccagagatccccgaacactgtggaatctcagtccccagaaaatctgaacactgtggaatctcagtccccagaaacccccaaa

SEQ ID NO: 135197 - DNA, 892 bp, Homo sapiens
aataattattggaagaaagaagagggaaaaatagtaggcaatcttcatgacactttaatgtgtatgtttactgcttaaaatgttcaaacacatctttgttttgtatagttaattttggtggtataatatttgaaaaggtgatagataaaaagtgcaggatgcaattcttgaagctgtaatttgcaggacactaataatacaagtccattttcttttctgagtgtgctatttatacaatttatatttttaacaaatcttagaactggaatgaaaatagtaattcatcttaagggtaagaaaggttgcagctgtgccaaatttggaaactttaatcagtcctcttagtgcttaagcacagactatggaatattctaatttgtatgtcacagagcacagtgctcagcagaaagcatgcactatcttaaattaatgttaattaattaatgttaaatgattgagtcaatttggcagtacttcttttcgtctctgaaaagaaatcatatttaatttagaagtggcaggtcaattttaaagccaagctaaaataagtaggtcaagtgaaattgtgcacagggcagggatagtggtgttatatgtacgaagaaaaaagactgaaaggaaaaatatcaaaatgtttacctgtgaagatgatgaataatttgttttttatatatttttgtttgcctttagtttaccacagtgggcaaatacattcttcggagcagtatactttcatgacatatgttaagctttacataactctttgttaaatctcccgttgatgaattaatagtaaacatgatacctatcaaatatgaagtgagcggtgtcctctgtagttgggcagcatagtagctttgagtggaacttacattctagcaaaattcatttt

SEQ ID NO: 135198 - DNA, 764 bp, Homo sapiens
gtaaattattattttttctttgttttctttgtttgagacagagtctcactctgttgcccaggctggacttgaactcctgggctcaagtgatcctcttggccaggcacggtggctcatacctgtaatcccagcactttgggaggccaaggcaggtagctcacttgagctcaggagttcaagaccagcctggataacatagtgagaccccatctctttttaaatttaaaaaaaataagtgatcctcccgcctcaccctccagagtagctgggattacagtcacgtgcctggctgggcaaattatttaaccctctgtcctttcatttcttatacatgcaaaaatgaaatagtaataatagattatagaattttgtggggattaaaaaagataatgcagtaaaggtatttataactgtgttaacatataattagtggtcaatttatgttagctctttttacctggagaaagaattatgtcatttacatgggattacatttatctaggattacactttcatgggatttactaactatggtttgaaagaagaatgcattttgttttatcattactgttactattttatacattactggaccccaaacttgttttttctgctgaaccatgaagcttataatttgctgtattccattatctggagccccagacacaaaactgataagcttcctggaaatagacatatggctagacttaaaatcctcaaattggagcgaaccttagttgcctagtcatttagataaaatattg

SEQ ID NO: 135199 - DNA, 325 bp, Homo sapiens
cacagaaaaaaaatgagtgatttaaaaaaaatatcgactctgtacaatcaatgtattagtatcaaaggaaaaaagcttatgatacatgaatctaaatgatgagaatcaaactctcaatttagttttttcttgttttcatcaattaaagagaaaaaaattaagtctaaaatcctctaaaaaatgtaaaccatatgaggacacaattggaaagagaacatagctcttagtgactgtttgagttgttttggatggagtcattacattgctagttctttcggttttttttttggtgtttttttttttttgagatggagtttcgctcttg

SEQ ID NO: 135200 - DNA, 1454 bp, Homo sapiens
  misc_feature (1)..(2): n is a, c, g, or t
  misc_feature (6)..(6): n is a, c, g, or t
  misc_feature (1212)..(1212): n is a, c, g, or t
  misc_feature (1227)..(1229): n is a, c, g, or t
nncacnaggctgggtctgacctctgtagcttcccatccagggggcctgaccctgcctcctgggctcacagagccagcctgtgccttccaggatggaaccatgacggggccctatcccggtaggatgaactgacatccattttgcctgagggttccagttgacatctattcctagtgcctcctttcactccccaaagtgagatcagccatgtatcatcagttatccagtctgtgcagtaaagagggtgctggggcccagaccccagccctgaaccctgctgcatggactcctggcaactgtccttaggctctctcgaggcccagcttcctgttggggagaacagtgcccacccgatttgtgggtgaaggtgtgagcgctctgtatggccctctccttcccacagtcctggctggcggcttcggaagcccactgggccctatggaatggagacacacagggcatttgagccccagcctcccagaaggggcaggaagtgtgggaaagagatgtcattggtgtgaagcccacagctgcgcctagcatgtctgtagagggaaccagtgacttcaagagtggaagcttgtcatcaagatggaaaaggatgcgaccagcatttggggtggccaaatgaagacggccaaatgccaccatgtatctcaggaggaggcccagcactgtcctgtccaacccacctataccccaaaccaacccttccaagacccctgggaagggctgtcctggagcgtgggtggggcaggaggtggctggcagacacaccctgggttgtggtgatggctagcaggctgtagaccatgacaagaagtggctcctcctcggggtggctctgaagagcactcagcagggtggaggtgatggcttggttgcagggagccttggcttccgggtggtgcaccagcgctgctcaagccagaggaagacgcctggggttagccccacagctcaggcatggggccagacacacaaggctcacaggctgggggatagcatctccactttgcatgaaggaaaccgaggtctgccttgttctgacccagagcaggcctccatgaatccctgtggcctaatggagtgaaggaccggaagggagccctgcccggccaggccacgcatcctggtccctgggagccagtcaggcagcactgaacacaatttcaacattgcatggaatcctgatctcaagtgatctgcccncctcagcccctcccnnngtgctgggattacaggcatgagccactgcgctgggctgcaagcccatttctaagcaaggcgtggagggaggtgtggctccgggtggtgggaaagacctaccctttgggatggggcccaacagcttccctagtttccccagggaggcaaagtctctcttcccagggactctgtcctggtcacagctgagctacaaaaggggtcgaagaggaggaggggagggaggg

SEQ ID NO: 135201 - DNA, 183 bp, Homo sapiens
gtatctagaggatcccgcacccaggcgcactgctgagggagacaacgcagagtccgcctccaagctacgcccgcgccccctcggacggcagcggcactccacaacacgccagcgtggacatttgcacgggtacaccgccacgtcggacacactggaccaggcgctccagaagtggaactggag

SEQ ID NO: 135202 - DNA, 322 bp, Homo sapiens
gaacaggtgtcatcaggaagctctgtgtttaagtggcaaagcactaacgtagacagcctgcgtctttgtatatgagatatagctctcaaaaaatatgtcagctaactcaaaaatatttggcaaactacagtgcatttagagattaagatagacaaagtcatcattcactatcatttatccctgttgcttaagctccgagaggggaggtaagaactatctgtaagtgcagttatgcaagtggtcagtgcacatgtgagcctccctgcaaggttcagactccttacataaacgggaataaactgcctcaccttgtccaaaaaca

SEQ ID NO: 135203 - DNA, 621 bp, Homo sapiens
gttccttgcctccatttccacaggtaacactacaatatacttcagagggtgattgtgagggttacagagataatactaattgttattattgctatagtgttccaaccactgttccaagcatgtcccatgtattaacttactatgccctcatagcagccctatgggttcatatctgggaaggtgctcaggacagagcctggcacccactaaatgctcagcaggtgtcagccattgttatggcctctctagtcctgtgccttccacttttttctctttttttggttccacactgaactctgcaccggccaacaggacacagatttgccaaactttggggcagcaccctgcaggggtggtgcatggggatgctactgctcaaagggcacagcttccgggatggtgggcagctgggcaggggtgccccagaggggtctggggctgggctgctaggagggctccatgacacagcctccagctttgtgcccagctctcagaggcccttcttatgggactctcatatcctgaacctattatggccctgggaccccacagtgggaggcccatgaggcatcctggaagcttctccttggcttctgcctgtggtacacgggcccctcctga

SEQ ID NO: 135204 - DNA, 279 bp, Homo sapiens
agcaagttctgtttgagtcaacagcttgatagaacctctaccctgagccttaccctgtgccatcccctggggacctggaaatggctcctgacagtccctgactttgaggagtcatgctggagacacagaaggaaactctccacagaactgctgaagtggacggggctgcactgcagacggcgggagcaggaacactgggagagatgcgggaggaagggcaggagggcctgggggcagccaacatcggaggtgacctgagaggagagcacaaaggctcgt

SEQ ID NO: 135205 - DNA, 236 bp, Homo sapiens
cagaatgtgcttggggggtgttggtggatggtagccaagctgagtgctgggggcagggtctggtgggcactcaggacaggcatcagacctggtgttggtatgtatgtatgcatgtaggtaggtgtgtatgcatgtagtaggtatgtatgcatgtagtaggtatgtatacatgcatccatgttttttttgttttttttttttgagacggagtcttgttctgttgcccaggctggagt

SEQ ID NO: 135206 - DNA, 751 bp, Homo sapiens
ggagccattgcccaccaaagcgagcatgtggtgtttcccgggtgtggagctgcagcatatgtttgtggagatggtggcaggcaggcaggcggggtggagctgggagagcgggatggccgtgctgtggcacctggcacacttgggagactgtgtgctgttgggccctaagtgatatgagaggacccagctgttggaggccccagccccaccacctgcctttgggactctccctacagctccgtgaggacagggcagggatggagtccacctgaccagctggtctgtgctgatctgctcggaaggggcatgatggggctccagccctactgaggcttccataccggtccctgacacagggctgcgttctttctgcacccccagtacccccaagtaggttggagtcccatccggagaccctccttcagatggctgttctcattcctcccaactcccacccaaaggtcatggttaagaattttggtattggccgggcgcagtggctcacgcctgtaatcccagcactttgggaggccgaggcaggcggatcacgaggtcaggagattgagaccatcctggttaacatggagaaaccctgtctctactaaaaatacaaaaaaaaaaaaagctgagtgtgatggcgtgcgtctgtagtcccagctacttgggaggctgaggcaggagaatggcgtgaactcgggaggcaaagcttgcagtgagccgagatcatgccactgcactccagcctgggtga

SEQ ID NO: 135207 - DNA, 187 bp, Homo sapiens
gactctgtctccccccacccagccaggctccttgtcacgactgcctcaccactaccactgcgagacagaaaatatcccagcaagaataaatggacaggcacagaccacccagagaaaggctggcaaaaaaaaaatagccgtccctgacctgtccctgaaaatgacacctggtcctttgggctgctgt

SEQ ID NO: 135208 - DNA, 355 bp, Homo sapiens
tgtcaaaaggccactgcagccctagttatggccagaaactctgttttccagttttggagcaattgtggcagtgagatcattccaactcgtggatcacagatacagcagcgagttcctgaatcccagacccagtggtggtcctctaactgaatgattatagcaaatgttgcagcatccctccaggataacttcagattcctggcatcattctagaaggcttagcccataattcattcctttggcccttccaataatcaggtaagcatctaattccctctattaaatattttctgttaaaaggcccaggatggtctgtttcctttactgaagctagcatgattcagtgtctcagtat

SEQ ID NO: 135209 - DNA, 324 bp, Homo sapiens
ccaatcagaatttccagaaatgaaagacagatttagggaactacgaaatgcagtggaaagttttaacaacagactagacaaagtagaggaaagaagttttgagctggaagacaaggttttcaaattaacctaatcagacaaaatttaaaaagaatgaaaagaaatgagcaaagtctccaagaaatgtgggattgtggatgggcacggtggctcacgcttttaatcctagcactttgggatgctgaggtgggcagatcacaaagtcaagagattgagaccaccctggcctacattatgaaacctcgtctctactaaaatacaaaa

SEQ ID NO: 135210 - DNA, 472 bp, Homo sapiens
cccatagcacctggccagaatttccttcctttataaggctgagtaatactccgttgtaaaaaaaaaaaaaaaattccattgtgtatatgtagtacattttgtttgttcattgaaaaattatttttttttcccaaggcagaagaatttttcttagtacagaacaaaatggagtctcctatgtctacttctttctacacagacacagcaacaatctgatttctctatcttttccccacatttcccccttttctattcaacaaaaccgccatcgtcatcatggtctgttctcaatgagctgttgtgtacacctcccagacggggtggcggccgggcagaagggctcctcacttcccagaaggggtggccgggcagaggcgccccccacctcctggacggggcggctggccgggcgggggctgccccctactccctcccggacggggcggctggccgggcgggggctgaccccccc

SEQ ID NO: 135211 - DNA, 430 bp, Homo sapiens
agggggtgtcaaagacagtgtatctctgtgccattccagggttcatgtcgaagcagtcctacctccaaagaccacggacctattgccagagaactgaatcagaaatttcaatgcatgggcgaaatccctctctgaatacatagaggtcagaggcagaggttggcagaaatgtggctcctgggtcaggtgaccgaaatgcattacctaatgaaaatgacaccaaagtgctgcagacaagagtctcgaaacggaggtcactggcgaggatgatggtgatgagaagcaggagggcacattttaaatggtgtcgaaggacaaatggcacggaacaaagagacccagctccaggagtttaggattctgctctgtcatggactggacaggaaggctgatcagacagctggcttccctggggagatattttttgtat

SEQ ID NO: 135212 - DNA, 117 bp, Homo sapiens
tgaggttttaatttatagcaaataagagattcgagtatgaagattttgatttgcaagatgcatattttttcttgacagaagaaagttcccttgagtctcaggggaaggcacagaagg

SEQ ID NO: 135213 - DNA, 740 bp, Homo sapiens
atattaaaacatattagcatgccacattaataagtcattttaagtcaacagcttattgtagttaataaaaatataagtattttcctagatcattgatatgatatcaccacataaagaaatcataatataaagtccccccttattgagatatatatatacattatgactacagtattatctatattatgcatacctaatagaattgtggttagtgttactttcagtattttaataggttgctagaatagtatactagattttaatataattgcatattttcaatgaattatttcacttgaatcttcttaatggatctttacatctttttcgtttttaaaaaatcgaatctaaaatggaatatttttgttaaaacactaaacatatcagcaatatagcacagggcgtaactacttcataattaatttcttcatatgcaaccagatgaatatgctctttttccttatctcccaaataaggtcaaaggtgattttatctcattatataatagataagagaaatcactttaaaagaataaatgtgtaaactttggaaagggaagatgcttatggcagaaaggatagcattcatgctgggcaggtgaacaggttttcatagttaaatagttatactgttattaaaggccataaagttataaaaataagttctacttatttggctatggatctttaaataaaatactcaaatgttctgatgccttatactctctattaaaaatttta

SEQ ID NO: 135214 - DNA, 463 bp, Homo sapiens
ctgattcgagtttgtgctttcaactactatgcaataatttacctgtatgaccttgatttaattctcacagcaacccatgaggtagattctacctttatcttatagaagacgaaactgagacccacagtttatgcaatttacccaagattgcacacttagtaactgaattgtagagctgggatttgaaccagggacaatctgactccaaagctagtctttctattctaccacagcctcattctcaagaattctatcacttgcaagaccaagatcttctgttcattatccaaataatatgttgctgggatcatgagcccctcatttatgtctcagatgcatcatctttcccaaattaacctcctcacctatactttacagtcccaaaccctccacaatacactaagacagcagatctcaaaacactaccgtctcgggacccttttgcagtcttaaaaattaacta

SEQ ID NO: 135215 - DNA, 220 bp, Homo sapiens
caagtaaagaaatcaagcacattatcttttcaaataaagttgaaatctctgctaggataaaggttcctttttcctgctttagcataatatgtgaatttggcaaaatgctgttcagaaactgacaatgggaaaaggagttactcctttatttagagtaggtgcaactctattttattaggctagatgcaacagggcattaatagggagaggctgaggtctg

SEQ ID NO: 135216 - DNA, 967 bp, Homo sapiens
agctgggactacagtcatgtgccaccatgtctgggtaatttttgtatttttagtgcagatggagtttcactttgttggccaggatggtctcgatctcttgaccttgtgatccgcctgcgtcgccctcccaaagtgctgggattgaaggcgtgagccacgcacctggccacgtccttattttgtatgcagcagacacacgccttctctgccgtgtggttggatccagccctttctctgagaattctggttctttttagtgaggaatggaatttagaagttaagatgtgggtgggagatgtgctcattgctcatgggccatcagaacctccacacccttctacctctgctgcaacccagccccacggcacttccttgcctgcctcattcctgtgcatcccgtcttgcatggtgacgaccccggctcacaacagcagagacagcatcacgcatggctcaaacacgctgtaacacagagcaggtttggaatggctccacccacagggccacaagaaacaaacccatggagagttccagatctgtttgcagcttttttctttagtctgagggtatgcagtcaaagtgctgtctccaaaaattacttaaatttgttttgtcccgactccccttcagatgatggctaatcatttgacagacacttgggttcctttgttggcattctgttgtagcattttccccgattcttgataattttattatttgaatatgtaaaatgtcatgattccaaaagttaaaactattcaaaaagctgtgcccagagaaatgtcttctcctctctatttctcctgccctgttttctccaaaaggaaccagttcgtttattttaacagctttcctgaactataattcatataccataaaattcacccgtttaaagtgtatttagtgttttttagtattcatggaattgtgaaaccaccgcaatcaattttagaacatttttatcacc

SEQ ID NO: 135217 - DNA, 264 bp, Homo sapiens
ggcagaggcaactcttacgactcctctatgcctgcaggaaattaattcccaatggaacatatggaactggactgaggggatgggtcaatgttgaggagttgtctccattgcatagtcctcctattactttgattttaaaagtcagctaatcttatgggctatgccacccaatcaagcaccagaggactgactattctgacactggtatggacacagtaagcccactgcacaccacaatggtcaaatcaaaaccagtcatgtatg

SEQ ID NO: 135218 - DNA, 256 bp, Homo sapiens
agctgggactacaggcgcctgccaccacacccggctaatttttgatatttttagtagagatggggtttcaccttgttggccagaatggtctcgatttccagaccttgtgatccacccgtcacagcctcccaaagtgctgggattacaggtgtgagccgtcatgcccggcccataaagtgtggtttctaaagctggttgtcccaacttcatgaggacagtaggaaggtttacatactaaagcacttggggcgatgtg

SEQ ID NO: 135219 - DNA, 419 bp, Homo sapiens
gaggaaatcacagagaacactgaccctatgccgaagaagtcatagaaagatcacacgactgcaggcatccaaaatcaaagtcaaagcatcttaacaacatgcatatatcctcaggaaaaaattctcccttataaaagcaatttcaaaaaattggaacaagcaactgctacaccagacgcaaagaaatcaatggaaggatacaggaaacatgtaaaagcagagaaacatgacaccattgtattagtccattttcacactgctgataaagacatacctgagactgggaagaaaaagaggtttaattggacttacagttccacatggctagggaggcctcagaatcctggcaggaggtgaaacacacttcttatatggtggtggcaagagaaaatgaggaggaagcaaaagcagaaaccctg

SEQ ID NO: 135220 - DNA, 320 bp, Homo sapiens
ggctacactggcatcataacattctactagaggttaagtcaataattcaaagttaaaacctccaacatttgagacttggtattattaaataaatcacctccattttggcaaatttacatctgtaaccaattcatttaagataagagctctctatattatggagagtcagtaaaatattggtgataaactctatgatcttggggaggtccttaatctccctaaattttaagctccctcatcagtaaaacaggaaaagggaaaatacatctgcccagggctgatgtgagggacaaacagggcatttgctgcccatagatgct

SEQ ID NO: 135221 - DNA, 439 bp, Homo sapiens
tctagaaggaggggcagacacccccaggaagaagttggaagtgaagaggatatcacaggtgattgagagcatgtgtgtcaggtgatagacgggaacctcttggtgccaggagacgcgtggaatttgacagtgggctgttggagagcaggtaagttgcatggattcctgctggtggttcatctgacagcaggaactttgctgaactgtctttcagctgaagcatcgcagtctccaagagagctgtcaagacctaggcagaaccccagcctgcaaggatcagtaggggtctaaatcagatgcttcctagagcttccctgggccagggatgacatatgggtttcacttgctgtgccagctctgccactcattgttcaaggcggtcaggctttggccggcatcgagccacctggagatcccatttcagtgcagatcctgactc

SEQ ID NO: 135222 - DNA, 305 bp, Homo sapiens
ttgtctgttttaatgaactgcatttaattgttatgtcttttttgtctcctttaatctagaacagtcctttttgctttttatttcttttgtaacattaacatttttgaagagtttaggatagttctgcagaatgtgtctcaatttgtatttgattgttttctcatagttacacttagattaaccattactggcagagatatgccataggtcatgagttctcagtacataagggcacatgacgtcaattatcctattgatgatgtacctaagtttggacttggttaaggtgggttgcaccagatttt

SEQ ID NO: 135223 - DNA, 497 bp, Homo sapiens
gctctgatatacacatgaagctcccctgaatcattcttatacatggttactgatttccatatcactatagtttcacagctaataggcgtatctctaaactctaatatcaagatacatggcctaataaagaatgtttccaccacattctctagttgcaagaaccactccagaacatggtttttctccacaaatattggaatttcagtgtttacaggaacaatgggaagaacatcagtaatgggaactggcccccagatggccctaactgtatttcaggcacaggatgagttaaataggctctgtgtgcctgaagacttcacatgcatagctttatgtctaacaaggaaagaatccactccaaaatgtttttcaaatgaacttttgggaaaaaaaaccctggcttaagtggaagattgcctgcatataacatctgttgtatatatgcatggctttactgactgaatcctgatttgttctcagtctttctctataaaaaa

SEQ ID NO: 135224 - DNA, 532 bp, Homo sapiens
caaattattatcattgacagtttacacaaagaacagtggaaacgcctcagttaaaggaacagaaccaacggtatttcttttaacgtgcatttggagtttgagcacttcctgtttaaatttgcagcaatagaggaagatgagctcaaggaggggaccccaaattcacaacagataatgagagctgtcactgagtttctactacatgcctcagtcacccagggtaaagatggagatattaacattctcatcttgcagacaaggccctgcgaagttaagcggcttgctgaagttcatgcagttagtcaccagccaaactagtgttctagctaaggtctgttggatcctaatgttcacggcccggtctccttggccgctggagcactgatcaccaaagctcaccacaaacaagcttcacttcagcaataatctctcctgctaacggatcagatggatgatttctgcaacttttgcttttatactgtattttcagttttgcagatgactttgcatttcaaatcacagcatcaacaag

SEQ ID NO: 135225 - DNA, 204 bp, Homo sapiens
actttctgctgtcaccttggagatttgtgaccaaatgttagctggtgtgcacacgtgtgtatgggcatgagcacctgctgatggtctccagagcacaggggcaggtctgtgtgcaagtgtaggtctaaatggagcctctcagagctggatgcagtggctcacacctgtaatcccagaactttgggaggcagaggtgggaggatt

SEQ ID NO: 135226 - DNA, 140 bp, Homo sapiens
caggaaaaaggaagtagaaagtataggcagtgatcatacatgagaagatatatgtgtgtgtgactgtttttgaggccattcgatagaggtgatatttgaatatggatgtgaataatatgaaggagttgggcatgaaaaga

SEQ ID NO: 135227 - DNA, 313 bp, Homo sapiens
gagactaaggccttcaatgtgtagtgtggagtgggaaaggtgtcccttcctccagatggtcacacagctgggcgagaggaacatgggccaaaagctcagctgcactcacccctcccaggtgcctttatgtcacacacaccttaagaggtacccctgaaaatctttcaaaagagtaaagtatccttggccaggtgcggtggctcacacctgtaatcgcagcactttgggaggccgaggcaggtggatcacttaaggtcaggagttcaagaccagcctggccaacatggtaaaactctgtctctactactcaaaa

SEQ ID NO: 135228 - DNA, 235 bp, Homo sapiens
cagctggtccactcctgcctgggcataagagctgtgactcaaacgcaggagttctgattccaactctagcactccttctagtgcacaccattcacaaaaacgcagaaaagtacaagagggagccagcagtggcctaaaatagcaacatgcattagtaggaatttttttttttttctgagacagagttttgctcttgttgcccaggctggagagctcttattgcccaggctggagt

SEQ ID NO: 135229 - DNA, 508 bp, Homo sapiens
acgcatcacgttgctgagtactcctgggatgatgtggtcatttcactgttggtgcatgaagaggtgcaagctagaaatggccggctgtgaccagaaccccaccaaggaaccgggacttgactttatggagtcagaagtaaaagaatccaacctgagtgtttaaagatgagaatcacagcagctgagggagacaaacaagactctggaggcagagagactggtaaggagatgagatgacatgaatggggtgccggacagaggcagtggaaagagagcacaagagaggatgcaagtatggtgtgaagccaggctctgcagggctcacataccaggggctcccgttaaggggttctacattttaacctgcgatcttgaagaaatgcctcactaaggggatcctgatgtatcaaggcagaaataggttaagttcccctatggcttcaggtgtagccagttaccacttgcaacttaaaattactctcagatgtagacctaattcctgaaaact

SEQ ID NO: 135230 - DNA, 843 bp, Homo sapiens
tgttctggagatagataactcatttacagtggtttctattaactaattaaagtacccatgattttttccttttctgctcagggatgatggagatttccttttaccttttttaatggggtaaattttttaatggggaaaataggccttttaaatattattgccagggtctgcaatataacttaaaattcctgtacatactgcaaatatttctttaaattgcacaggaaaatgagcaaactttttatttcttaatatctttggcaaaaaactttaaccagtaagcaattttataaccctgagggatcatcaaagatactatcctgattcctgtaaggaaaaatatattatttccttataacaaggcaaggagaaatgctattttattcctgataatttatataactagaataatttttttcctttcttttatggacctaaatctgccaattgggaattttgtgcatgaaatatgaagttactttttatagataatcagtgcttttaagtccctaaaaggctcctgctgaagtaatgatgatgttaataataaaagcctttgaaaggctgaaaacctacatagtggtaccatagtatttggagcttctataggagtggagaggggcagctcattgttgagagttgcatgctgcaacctaatggtcagcaatgaaagaaatacttgtagaatgttgaaaaaaaaaaaaaaaaaaaatttgggggtgggcggaaatttaaacatgttggggggggcaaataagaaggaatgtccaaaacgggggaggggggttcccaaaacgggggggtgaaacagttgtctggtcaggataacagcggggggggggg

SEQ ID NO: 135231 - DNA, 305 bp, Homo sapiens
cctgagagcctttcatggtgtctatgaggtccttgtttttccaactatgtatctgtgtcaggtcaggttttcttcatgtacttcaaccagtataacatgtcataacagactgaatgtaaaaacagatgtaagaatcggcctgtcttctattaagccaaacaaaggtatttgcaaaaagtgtaaaacttggtcactcttctcagaaaatttgtattttattttggaaaaatagtttttgtgtttttttttttaattttaaaaatatggtatttaatttcaggtgaggctatttatcatagagctct

SEQ ID NO: 135232 - DNA, 295 bp, Homo sapiens
gaaagtgctgataataaaatactcaattagaaaatacagtggtagaaaatatcctctttatagtagtaaccaaaaaatctgcaagaaaattttaaagaagtaaacagtacttatttgaagaaaactatacaagtctattcagagacatatatgaagattgaataaatggagagtcataacgtgttcctgggtataacttgccgtactggatattaaaacattataagaatgttttaattaacacagtgcagtactagtacaggaatagacaaaacaatggaacagtgtagagtcc

SEQ ID NO: 135233 - DNA, 1174 bp, Homo sapiens
acaggtgtgagccaccatgccttgccaaagttggctgtttctttagattcagaggaattattatctggcttgatctgaagaatgttaaaagtactatgatctgataattgcctaatatgtatgttacaatcttcttaactagggacatttattaaaatagaacaaactagtaaaagtattttgtacgatgctggattattgttaaagtctctaaagtctagttttgctgtatttaaaccaatgcaaatttaattgagaactgcacattttgaaagcaacttggaggaggcaggtcaagtgttgggacagtaaagtatgaatagattattatgggacaggaagcagcaatgtgacatgcctaattttggcctgatgagcaacagaaaaggggaatgggttgaatagataaagtgaaggaagttcattagagggacttgatgaaatcacctagagaggaattctaagaggccatttaatccagtacctctgtctctcatgtcagttgcaaataaaccatctcagaagatagtcattcatctagtgtatcgtacttacaatgccaccatctttacttgaggggcatctgtacttctctatacaagtaaggtgatcaaggcaaaattcacttacatgactctatagttcaatgagagtttcacataaatgcatagttagtgaccaccccaaagattctctctgtatacttaggtaagtccatcctccagcctaagcccacagcccctgaaaaaccactgatcgtatacgaactggtccacatatagtacaggcatgagaccaagaaaagctccatcatacaataggcattcaccccaggcactgtacgccaactgaaacccaggctacacaccacacacaacgacgcacacgccatgcaccacgagacgaaagacgcacagcgacatcaggaacatacaaagcccataaaacaaatacggacagacagagtgagaacatagcacgaaataagaaatgaaaatgatcgtaaacatgacgtcgatgaaaaacaccataccagacagagaatggacacggaacaaacactaagatgggttaacagaagtatgagagcgcacagaacaagacactagagaagagcaaaaaacgagcgaaagaaatagaaaagaaaagagtcaaacagcagagaaaaggagaa

SEQ ID NO: 135234 - DNA, 593 bp, Homo sapiens
tgggaaatcttgacatgtatttccctagagtgtagggacattagaaactagcgcttgcctcttctctggagaattctaaagcagcctttaataacagggcaaggaagaagtgcaggaatacatggttatcttagaccagtgattttcaaccagcggtaatttttttacctctgggagtcatttcacaaagtctggaaacatttttacttgtcacaactgaggggatactactggcatctagtgggtataggccaggatattgttaaacattctacaatgcaccagaacttctccctacccccagcccccacaccaaccagaattatgtagtccaaaatgtcaacagtgcagaaactgagaaatcctgacagacatagtaggggtttccaagctagagccatcttgaaagatctccacccaaaaatggcagaacaagggaatcccagaagtatactacttagagcaggagcttaaggaatggttgtaagaggtcagctggcaagagccaatgaatggtgcaatatagaggttcctgttggggtactctgaaatctccagcaatatactttatggatacctgccatgacagaggg

SEQ ID NO: 135235 - DNA, 473 bp, Homo sapiens
actctccacacacccctcacacctctcaaacacttgtccaatgctataaacagttcagtcaaaattcagaccttcccagtaagtgttagaataataatctaaaaagagttgagcatttccattttaaaaaccttctatgaggccgggcgcggtggctcacgcctgtaattccagcacttttggaggccaagatgggcggatcaagaggtcaggagatcaagaccatcctgactaacacggtgaaaccctgtctctgctaaaaatacaaaaaaaagttagccgggcatggtggcacgcaactgtagtcccagctactcgggaggctgaggcaggagaatcgcttgaacctgggaggcggaggttgcagtgagccgagattgcgccactacactccagcctgggtgacagagcaagactccatctcaaaaacaaacaaacagaaaacactcatttttccaccagtgccagtacaa

SEQ ID NO: 135236 - DNA, 209 bp, Homo sapiens
aagaaccctaacccaactggataaggaaattgagcattctgggtgggagagaatgatgttatacaagggagtgttgatgatgctgacccacctatgaggaagcacaaagcgatgggatgcatggatatggagagatttttcttctctgttagccaagactatccagcttagttttaccatccggcacccacagcaccacatggtaagcc

SEQ ID NO: 135237 - DNA, 622 bp, Homo sapiens
gggctgactgcttcaaaaacatctaattatttataagtttttccttgttcatttttgaattattgtctttgggttgatgcagagaagggaaagatcattcctagtggccctgctcctgttaatgtctgtgaaattgctttgaaagaagtgaaaatcggccgggcgcggtggctcacacctgtaatcccagcactttgggaggcctaggcgggcggatcacaaggtcaggagtttaaaccagcctggtcaacatagtgaaaccctgtctctactaaaaatacaaaaaaaaaaaaaaaaaaaaacgttgttgtgcgcgcgcggccctggggccccgcgagaaaacgtcttcttcataaaccacattcgcgtgtgggccgcgcgcgggcgccccaggcggcgatatggtggaaacacgtgtgggcacaataacgatggtggttctcccacagagggagaaatccgcgcggcgaccgaagagcaaccagagggcgccgagcgagatatctccccaaccgcatatacaacaaaagcccccgcgagggggaaaccacccagagagggcgcttcttgtggacacccaaacactgccccagacatcggagagctcctcgaagagggatca

SEQ ID NO: 135238 - DNA, 686 bp, Homo sapiens
agctttgctggagaaagttgtacaggccagcatatttagcatcactctaaattcatcattaccagctgacagcactccagcgaacatggtgaatgttccccaaacccaccagactttctgtaagaagtatcacaagcaccaactccacaaagtgacatagtccaagaagggcaaggattctctgtgtgtctagggaaagcagcattatgacaggaagcacagtggctatggtgggcagagtaagccgattttccagaaaaaagctaaaactacagagaagattgtgctaaggcttgagtgtgttgagctcaatttcagatctgagaaaatgtggctattaagagatgcaagcactttgaactgggaggagataagtgaaaaggccaagtgatccagttttaagtgtcatcttttgttttgttatgaagacaataaaatcttgagtttatgttccaaaaaatttaaaaataaattcatcattaccgaagttaatattggcagcagtcttactatatttctctaacaagtatcctactctactctttgcaacaaatgtttcatcccttcattactctcttctacctctcaccctccctgtttccttccctatgctgttggtagtcttgactcatacctcagaaggaaaaaggaagccatcatatgtgagctctcttacttcctaccac

SEQ ID NO: 135239 - DNA, 317 bp, Homo sapiens
cccacctcggcctcccaaagtgctgggattacaagcgtgagccacggcagccggccactgtttgattttttacttttcctagaagttaattttgacacatggccaaaattaacatgaaataataaaagtggtctgtttcccatttggagtctttttgatgaccgtaaatgaaaagattaaatttttaccagattaatccagaacagaagtcttccttactggtgtgacctgttagtttagaaactttgtcctgaataaatacattgtgtgttgcatcagtatgtatcatagttagtatccaactacacccaccaatt

SEQ ID NO: 135240 - DNA, 271 bp, Homo sapiens
gccgtggccagcagccaccgacggggtgggcagttccgcaggctccagatagacctgctgtgaggagttggctgagaggcgtgctgtcctcgaggacctgtcaccagagcatcacgcattgaacacaaccgcgtgtctgcctccgcagcataaagacccacgagagcatcccccttaggtggccttgacggccacctgacagccagctgggccgcgcttcctgccaacgcagagtgggtgccgtgcccgagggtgccactctacctcgcac

SEQ ID NO: 135241 - DNA, 457 bp, Homo sapiens
tctcgtagaccatgcctgggccagtcctgccttaccggagagctcaaggcttaaaatcaatgtccatgtgcaaccgtgacaaatggaacaagagggtgcatcatgctagcttatgatcacaatgacacatttaacgaaaacttcagtaaatagagcccatggatgaaataatagaggattagcctgggacaggataccatcctcgccccaacaaggagaaaaagaattccagcttttccaaatcactttgaattagtgatagctagaaaactcagagaatatgtacagaattgaaagaagaaaaaaattagccagaactctacttcctgaagaggatgaggcaagcagaagaagaaatttgcgtcttaatggaaaacgaagcacatttagaaagccaacccacaagccacggtcaacccacaagccacggtcaaaccacaagccacggtcaacccac

SEQ ID NO: 135242 - DNA, 842 bp, Homo sapiens
ggcgcaatctcagctcactgcaacctccgcctcctgggttcaagcgattctcctgcctcagtctcccgattagctgggattacaggcttgcaccaccacacccagctaatattgtatttttagtagggacggtttctccatgttggtcaggctggtctcgaactcccgacctcaagtgatccacccacctcggcctcccaaagtgctgggattacaggcgtgagccaccgtgccaggcccatgttagtttttaatattttttaatatgagtgtgcatatagttgttagtatgttattttattatctcttaaatgactacgggatctgtggttatatctcctctttcattgctgggcaacaacagcgaaagtccatcgtcaagaaggcaaacaaaaagagtcacctccagtgatacgaattctcagggatgcacaatgctcaccctggttaaggcgtagataagaaagatagcaaacatattggacagttgctaggacattcaagcataggaaattggattgaataacaccatgatggagtacaaactataaccgctgaacagacacgaacgaacggcatgggtccgcagcgctggactgcacaactcgctaatcccagagactacgggaggcccacgaaggcggactcacacacggccacgcgaaaccgcagaccaacactgggcaaaacaacgaggtgacacagagcctgggcacgatagcctacacacaatccacaagaacaagagcgggaaagttatgcacaacaaggagcggtagacgccgaaaactaaacagggaggccggaggaaaggaagaaatggcggaaacgacgagaaggag

SEQ ID NO: 135243 - DNA, 540 bp, Homo sapiens
ggcgcaatctcagctcactgcaacctccgcctcctgggttcaagcgattctcctgcctcagtctcccgattagctgggattacaggcttgcaccaccacacccagctaatattgtatttttagtagggacggtttctccatgttggtcaggctggtctcgaactcccgacctcaagtgatccacccacctcggcctcccaaagtgctgggattacaggcgtgagccaccgtgccaggcccatgttagtttttaatattttttaatatgagtgtgcatatagttgttagtatgttattttattatctcttaaatgactacgggatctgtggttatatctcctctttcattgctggcatcatttttttgtttttttgttttttttttttttgagacggagtctcgctctgttgcccaggctggagtgcagtggcgcgatctctgctcactgcaagctcagcgtcctgggttcataccattctctggcctcagcctcccgagtagctgggactataggagcccactaccacgtccggctaatt

SEQ ID NO: 135244 - DNA, 358 bp, Homo sapiens
gaacaaaggcctctatcctgggccttgctcccttatctgtgcagctgcagcttgatttttccccaggctgctctatctgtgcctgtagctttgatttttcaaaagaattttaccaaggactagccatagctgtctgcccaactgctttattccttttctcctccctcagcatcctataggagaaagtcacctttgtctccaaattccctggtcctggttttgaaaatcctgctggcacctactgctgaaggctgtggctggagaattcagtgagctactctgatctggacagggtctgatggtcctcacttgacctaagctgagctctcccaggctgtgagcatccccaaggtcagcc

SEQ ID NO: 135245 - DNA, 181 bp, Homo sapiens
gttgcttctaactgttacttgatattccatggtttaccttcaccatattttacttttccatttctcctagtgatagaaactagattgtttgcaacttctcattatctcaaacagtgctgtaattaagattttgtatcctctccttgtgacccagtgtgagaaactttggggaatacatata

SEQ ID NO: 135246 - DNA, 363 bp, Homo sapiens
gactttctagatcacttgacctgtatttaaatttctgatttgctatcattaattgagagttcctcttgaactcaacactgttctaagctagacatctctggccttatagcctgttatttctacttcatcttggtcaatcactatcattcggtaaactaagctagaaaacaggaagtcggccgggcgcggtggctcacgcctgtaatcccagcactttgggaggctgaggcaggcggatcacgaggtcaggacatcaacaccatcctggctaaaatggtgaaaccccgtctctactaaaaatacaaaaaattagccgggcgcggtggcgggtgcctgtagtcccagctactcaggaggctgagg

SEQ ID NO: 135247 - DNA, 363 bp, Homo sapiens
tggaaggtgcccttccatagtgttcagagagatttggactggagttttctagatcttagggaggagtggggagaagtggtctcagccagaaaactgttgggtgggttggctgtgacagagcatgtagtgacagcccctgggtgggcgaggctgggggctgctgtaactgccacagcccagagcccctcagctctctccctagagatggcttctccatcagttcaggtagctgttggctttgatttaacaggggtgggggcagatgaggaagttcaggcaacacagggcctgggtttcctgagttgttctgaattgtttgcccttttgtggaagctcaggtcttcagacccacttcctcttgtc

SEQ ID NO: 135248 - DNA, 681 bp, Homo sapiens
gatggcattgctaagattcccataggcgtttccctaatgaatgctccccagtgggactcagcctcagggactcagaaacctgccctcgaagatgtccctgtgagtatgatgcaggctcgcctttgctgagtcacagagacttaatcaggtagcaggcagccagcttactcatcacaacaagaactcagatgtcagccagtctggaacgcagaggtctgcctgccccggtcattttgtcccctatgggtctgattccttagaagccgggttccaccagaagccacgtttatccggtgctttccgggagggcaaggaatcaaaacaagaggagtttgttgttcttaccaagggtctggcaggtatcacttgaggctccttcatgcaccaaagggaaagatctgccaagggaaccatgtgttgaagtcaactaagccttgatgatacttctaagagcactgcaccactgccttcggcctccatttgtctttgttttcatgactgactggacccttcctgttcacatcaatctccagacacattgtgatgcaatcagttagatttcccactttctccattataatcatgtgccaacccaccctcttacgattttttttagcacaagttttgcaggttccaaacttttgcaagaaaggaagtctcttgctcgattcccacaatggc

SEQ ID NO: 135249 - DNA, 272 bp, Homo sapiens
attattattattattattattattattattattattttacattttaacatctctgaaacagggatgtgtcctacaatcaccatcagccaggaagtggtcaggatgcagtggttataactggattattttccctggcctggctgaccatctgcaaccccctggtgtttcaatgtacaaactattttaggaccatctgcgtactggctgttgcctgaaaatcttgtgttgatgtggatttgtaagactgggaaagcaccagcattcaaaacttg

SEQ ID NO: 135250 - DNA, 243 bp, Homo sapiens
tcaaaacaaacaaaaaagctcaaggcttgaataaaagttttcaagaagaaaaggtttgaaaatatattctagagtagcacttctcaaacaatagtgaacacagaaatcttccagggatcttgctaaaataaaagattatgattcggtaggccttagagcgaggtctaagaatctgtgtttctaaagacgctcccaagactgcagatgctcctggtctggtgatcgcactttgagtactaaagt

SEQ ID NO: 135251 - DNA, 421 bp, Homo sapiens
tacgcgagaatcactgtttccttctttctctctcttcctctctcccctcctgctctggccatcttttcattttaactggtccctgtgcaaatggccttagaactccacttgtaacccaatatctttgcaactcactccaactgcgagagacaagaagccaaaatacacaacagggaatgatctggactttgccattattgtagctagccttgttacaaccccacgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagc

SEQ ID NO: 135252 - DNA, 259 bp, Homo sapiens
aattccattggtcacaatgtatcacttcttatcacctctaccacttgtccatctaatccaagccaccactttctacagtcagaaatactgaaagaacctgctgttatccctatcattagtcaagctccagagggttttctttatacaaaagccagagtaattttatttttagagacaggatctcactatgttgcccaggctgacttctaacttccaggctcaagcaatcctcccacctcagcctcctcaatagctgggg

SEQ ID NO: 135253 - DNA, 562 bp, Homo sapiens
gatatcaaacagggttaattcaaagcttttagttataggaacattgggaggcccaaactgttgaattaaataactctacaatcctgtgctaaaatactcattaaaaatattgaacctcaataagaagaaagtctgtcaatgtgttatctataacccttgagtccttggatttttctactgtgaagtcatcccttcactcaaaacaaacaaaggagcaaatcagaacaacaagaaaaaacctgtgagaaccaattgcagcactggcatgttaccaggggctggggacaacgtctttacaaaggccaagtttttcttctcaacaagtgaggaatctagaataggctacagataagttaccttataattctagttcaatgatataactcctaagacactgacacaaacaatataatttggcagcaccaagagctaactttgctgggaaaggaaataatgtgacccctagagaaggagaaaggaagtgaggatttaaaataaggccaaagaattgaaattgatatggcaaaatgtgaatatttgctaaatccagatagtgggtatt

SEQ ID NO: 135254 - DNA, 424 bp, Homo sapiens
cattaaaatgtcttctcagtttacatcacttaacccatgtgacttctccaaacgctgcgagaaggattgtagcagctcagtttacttccagcctggagcagaagggctttaaaaaaaaagatatttttaggatctttagaaaaaatagttcttttctaacatttttgtaatccaagaaggcttttcttatcaaaagtgctcagtaatcttgttttacatagctattttgtaagctcttaaactgttgaaaacatatttgaaaaatatatatgattcaggagtcaggcgtggtgttttttctgtagtcccagctacttgggaggctgaggagggaggatggcttgagcccagtttgaggctgcagtgagctatgatagcaccactgcactccagcctgggtagcagaataggaccatgtctctta

SEQ ID NO: 135255 - DNA, 384 bp, Homo sapiens
  misc_feature (115)..(115): n is a, c, g, or t
  misc_feature (127)..(127): n is a, c, g, or t
  misc_feature (147)..(147): n is a, c, g, or t
  misc_feature (165)..(165): n is a, c, g, or t
  misc_feature (174)..(175): n is a, c, g, or t
  misc_feature (186)..(186): n is a, c, g, or t
  misc_feature (193)..(193): n is a, c, g, or t
  misc_feature (201)..(201): n is a, c, g, or t
ggttgggagttcttagacaaagggagaccactctttactagctctttcacctctacccactctgagattttctggctttgggaggtcctgactgtggctgggaagacagcttccnttctcttagagnccacgatggtggagggaaantctcaagacccctccctngccttgttnnccctttccttnggctgcnttctctanttcaggtccccacctctcctggtaccactccattcccattccttctttctgttttcctctctctctcagcaagttttttatgtgattacaggcactgcatggtaattagtgctaaactcatttgcacaactacagttaattggctacaacaattaattaatgtgttggaaatttggcactgga

SEQ ID NO: 135256 - DNA, 312 bp, Homo sapiens
ctgcctgggcataagagctactccagccgggcatagagctactccagcctgggcaaaaaagagctatagtacagccaccgaccaaaccgaaggatgtccacaagacctgggccagccctgcaggtacaggcagaggagaacagctcaggatggcagaagtccctggctccatggcccagaatccaaacaaagcagtgaatggccccactggcctcttacccttgaagctctgcagtgagagacagggtacaacaccactgatcaatggacttcagaaaaaggtaaggccctcaatgccatgaattcactagt

SEQ ID NO: 135257 - DNA, 350 bp, Homo sapiens
atctcaaaaaagaaaaagtgtagtctccagtctgatatgcagaggatctattcttaatataaagataatgaagtttgcattggatgttttttctatgaacatactcaattttggaattgacaaaaagttatttcttaatgcatgttttaatagttgattcttgtaatgttaatcatagagtcatttttggcaaaatagtaaggagttggacagataatttatattgccaatgtcttctcttaaataaggaatcctttcaggcaaacatttggagaagtcttatttacagataagaataatgggccaggcgcagtggctcatgcctgtaatcctagcactttgggagggca

SEQ ID NO: 135258 - DNA, 402 bp, Homo sapiens
ccatttatctaagttattgggttattgacataaaattgttcataattttccttattatctttctaatgtttgtagaatctctagcaatatcctctttcttactccctggtgttggttatttatatcttctcttttattttccttgatcagtctggctagaaccaggttcttcctgttgttctatttcattcatttacactctgatcttttattctttcttttgctcgtttggggtcttacttgctcttctgtttctagttttataaagtgaaagctgcaatcattgattagagacagttctacgctaaagtcataatgacattttatgtaatttcttttttcttttttttgagacagagtctcgctctgttgctcaggctggagtgcagtggagtgatctca

SEQ ID NO: 135259 - DNA, 249 bp, Homo sapiens
agggcctgaacacgtcttttctgctggaagtgagggaacagcctctctaccaacttttctcctcaggctcaagggtgggtgggacagtgcccctagagagagcaggggctgcaagctgagagtgtccacgtgaagaccatggtctcccagtcactgtttggtgccggtgtggtggtctcagttcagccaggtctgggctctcttcccatgaccaggaagaataagacatacagacaccagagagtgagt

SEQ ID NO: 135260 - DNA, 380 bp, Homo sapiens
tggtttaaccaggcgccagggctcaggcctggacctgctggattccaaagaagacttcgaggtggccgagcttgtctggcttccagaggagctttctctgtcccgcccgggggagtggctcaccttggtctgagaccaatgggaggaagcctgctgcgggcaactggtctgtgcctggaagttggacttgcattttctctggacctccaaagcaaacccgaatgaccactctcatcctccccttttgcttgtttgtgtatgtgcttgttttgcctggtcgtcaggcaggaggtggtgtcagatgatgagaggtgttgctcgtccctgggttggttctcttacggggctgtatggatgtcttagctcagactgctgtgaca

SEQ ID NO: 135261 - DNA, 607 bp, Homo sapiens
gatgagatgagatgagatgtaatgatgagatgtaatgaaatgagatgaaatgaatgagatgaaatgaaataatgaaaggaaattgaattgagatgagatgagatgaaatgatgagataaaatgagatgaaataagaaatgatgagatgaaatgatgaaatgatgagatgagatgaaatgatgagatgaaatgagattaaatgatgagatgaaatgatgagatgagatgtgatgaaatgagatgaaatgatgacatgatatgatgacatgaaatcagatgaaataatgagatgaaatgagatgaaatgatgagatgaaatgatgagatgagatgaaatgaggtgagatgaaatgtgatgagatgaaatgacataatgaaatgaaataaatgaaatgatgaaatggaaatgatgagatgagatgcaatgagttgaaatgatgagatgaaatgatgagatgaaaagatgagatgagacgagatgtgatgaaatgatgacatgaaatgacataaaatgagatgaaataagatgtaatgatgaaatgagatgaaatgatgagatgagatgaaatgaaatggtgagataaaatgatgatatgaaatgatgaga

SEQ ID NO: 135262 - DNA, 436 bp, Homo sapiens
tcacacaacggaacactattcagtgctaaaatggatgaggcaaacctgactgtatagaaatataatgataatcaatatgaactgttaagttagaaaaagaagaaaaacatctataaaatgatctcattgtttaaatacatgttagtttgtgtctaggaagtaaaacatggaggaacagcccccaaaactgtagggcatagattatagggagctttcactttcttggcacatgtatatgaaatgtttgagttattttttaccaccagcatgtattataattgtagtcagggaagaaaaaaggttttaaaaatgtctccacagctgggcgcagtggcttacatctgtaatctcagcactttgggaggccaaggcaggtggatcacctgaggtcaggagttcgagaccagcctgaccaacacggagaaaccccatctct

SEQ ID NO: 135263 - DNA, 110 bp, Homo sapiens
tcaatttgaggccaaagtccaaggatgaagacatgagttgacctagatcacttctgtccatagaaatagaatgaaagcttcaaacagtagccacatagacaatgggactt

SEQ ID NO: 135264 - DNA, 398 bp, Homo sapiens
ctctgagcctggtctggtttctcatctataaaatgggtttcacaggtgtattaatgaagacacaatatatgtgaagtgcttagcatatgccccagcatatagtgagtgctctatcagtggtagctcaaatgtctttattatggacctcagagagccacgggttgttggggaaagagctcggtgtgtcccagtgcattgcaaattgtctgggttcaacctggaagtctccatctgtgcccacatccactgtcctttacgatgatgggttctagattttattggctacagctggaaagaatgctagagaatctcacagaactggagtccaatccaggctcccctcttcctggataacctgtcttgaacctctcacctctcttgcactctgtacgttgtgc

SEQ ID NO: 135265 - DNA, 482 bp, Homo sapiens
cagcggaacaagcaaaaaccacagaaaaacatatgctggagtgctatcatcagaccttgcttccttttgattacaggctttaggcagaaggtgaagtgaagtcagagcaattgtggagtcctaattagggaaaaggagtcaggctggcaggacaaggggaaagcaaataagctacaggtctgcctttcttcatggtccagaacatataaacaaaaagaagaagcagataagctataggtctgcctttctttatggcccagaacatatagccctcctgtgcagacaacatacaaaactcataaacctcctgcttatcaccaaacactttgatctatcatcaaacacctcggctgacagaaggatgcaagttagttccctcctaccttggtgctgtcaatcagcccaagttccattctataaaatccccagcaagcctttgtctcctggcagttgggtcctctctgcttgtccctgcccgttgc

SEQ ID NO: 135266 - DNA, 692 bp, Homo sapiens
gaaaataccatttacttatggacaaagaatggcccttgagttcctggagtacttagccacagtactttcacagcctttgtcagggaattccagcatatcatggagcccactgggctttgggctccctctaactcttctcccatattgtttggtatataaattatctttgtacaccccaccaacacacacacacacacacacacacctctgcctttgcaactccttccttatttagtgctccatgttgcaattgacttggtcagttcagcacatatgtgctgagtgcctatgatgtgccaggtactgtgctagaccctaaatttagagaggaaagttacccttagggagctgccaatccagtaggggagatagataggcaaatagattcggtggcaaaaggaacttaagatggctcaggaatataaagtgccaactgatcatgtaagtttcatttatgttgctaaaacagcttgagtgcaaatttaccctcgtgatacatgtgaagataggacatttctccatagaggtttaaaagtgacagcagtgtcataagcaatatttataaagtctagtaataatctctttgttactattcttgaaggaagaggcgatcctgttcttcctcccccattaacatgcaatgtttgacctgaaagttgtagcagcttgattatagaagcctttgttgatct

SEQ ID NO: 135267 - DNA, 181 bp, Homo sapiens
aactattctagtgttgagttttccagtgggattgagatgcaagtgtccacagtgtaattgggagattccttaagattacctctaaaataaactacttatactcacattcttatctcacagtctgcttcttggtaaacccaaaccatgacatctttcatctttcaagccaactctaacttgg

SEQ ID NO: 135268 - DNA, 369 bp, Homo sapiens
aaattgcagagctcaagaagagccaggcccaggacaaagctaaacttcttgagatgcaagagtccatcaaggacctgagtgccatccgagcagatcttgctaataaattggctgaggaagagagagccaagaaagcagtgcttaaggacctttctgacctcactgcacaggcaaaatccagggatgaagaaacagctacaatcatcacacagttaaagctggaacgagatgtgcaccagagggagctgaaagatctcacatcatcattgcagagtgtgaaaacaaaacacgaacagaatatccaggagcttatgaagcactttaagaaagaaaagagtgaggctgagaatcatatcaggactctgaagg

SEQ ID NO: 135269 - DNA, 292 bp, Homo sapiens
atgcacatatagcccttggaaaagagtggaagatttgtaagtttcaggtatttaaggaaatatgtattcagtcattaaccactaagctaaccagacagagacctcagtggccacacacaacaaagaatacggactttataacattaagaaaagtcactaacagacagcaatgacaagcgtagataagaggacagttctgctatctggagttgccgtattatatttattttaaatgcctatttttcgtcataaaattttgagacaagcggaaagaaaagtatggcccatatac

SEQ ID NO: 135270 - DNA, 469 bp, Homo sapiens
agtccgttcgaatgagctgagaaggtttaagcccacagacggcagatatcacacccccgggccaggtttcagctgctttccagtccacagaggatgctccctaggaactcaaggtagcacctgcccccctggctcccctttggtctgaggttcttgctggacggggctcctcctgtccccaaagactgtgaagatggatggtctagcaagcagcacaaacgagaagagtgcatttgctccctaaacagaaaggtgtacaagagacctttgctctctgtgggtcttacctagaatgtttccttccctccatccaaatcaggatgtcactcagccctgactcttccaattgcttcagtctacatcgagccctccctttcgggcagactctgtgcccggcagctgaggctttcattttcttccggctccctgcgagtccctacatacctctggtcccttgctcagtcgaacg

SEQ ID NO: 135271 - DNA, 811 bp, Homo sapiens
tgagtaccagctgtttactggttagattacctctcccccaggagcctttaccgagtagcctttctctccattcagagcaatttattcattctgcagatatttattgcatcctttccatgaaagtgtgggaggcatttattatgcaccattatatactaggaataacccttcttcagctccccttccttcttttttttctaaatgcaggtgtgcttgaaatcctcacctgccagctggccttgctataccttttcctccatgcaaccccacaatcatttaatgagcatttatcgtatactactgagaaccctgcgttaaatgcctcttctcccctttttgtagtcccaattcccccttcaacaatctccatcctgccttttacacaacacaatcctgaaagctcacaatgtgcactgttttccatttattctagctaggcctcttcctccacttagtagccatctccccagctgcctttttctccccgaattagtccagaaaacacttattaatctcttactgtattattttcaaacagccacattatcatccctgcagcaggcttctccgcttttttctctatcaatctgtaaagcatttatggagcacgtgctgtaattccttcaccaacgtccactcaccaacgtgttatcttcctggttaagtttgctccattgaagtcagcaaacatcaatgaggcctctgctggatataggtaatcaccctcctttagacttccggtctccactccagccctccatgcaggtcctttgcgtctgcttccttctttccatcaagcatttattatcta

SEQ ID NO: 135272 - DNA, 492 bp, Homo sapiens
agccacctggaatttctgggacaggcccaacatgaaatattctggtctgttatcattcagctcccaaggaacactggtgcgcctccagctggcccctcgtgctttgctgctgatgtcaaacgctggcattgttgcagaaaaaaattaagttaatgaatataatttttttccatttaagagtttctctcctactttttcttacgcatttggcacctggtacctattgtagcaagcatatgctagcacttatcaaactgaataagcaataggaaaaaatgagcactgctgaactcagaaagagctgatcatgtgtagttcagcagccttttgtgtgcatgtgaggagtatgtggcttgaggttgggttttcttgattatgcacatgcaatataatcagtataattatattttgggggtataacattgttttcagttcaaatatagaactaaccatatcagcatttcatggggttccatagagagctttgcccct

SEQ ID NO: 135273 - DNA, 517 bp, Homo sapiens
cggatacacagtttgaaggtctgggagtggtcctggctaggcatatacattcaggcatcctcagtgcttacacatagtacttaaacccataagactagaccatcaccaaaccagaagtacagacagaaaagctaggaggtcagcgcacgaagctctgggctgctccacaccctctactgtggcccctcctgcagatcaagtgaaaatccaagattgggccaggctttcctagcttgcctcaagggtgagggctgtgtggtgggggtgagcaatctgcacagcccctgcagccccgacacagtctcactgctgctctggccgggacaaccttggtggtgtctcctctgcagctctgcttctggcacaagaaaggcagccagctctctcatccacccggccggctttctctctcgactactgtcagtgaggagcactgctacttccaacttccagtgagaaaaggaagtcagggaagtgtgaagcagcagaatttagaaagggaaaaaatacttcctac

SEQ ID NO: 135274 - DNA, 400 bp, Homo sapiens
gtgcccaccaccactccttgctaattctcgggccgttagtatagatgaggaatcactgtgtagcttaggctggctcaggctcctgacctcaggaatccacctgcctcagcctcccaaggtgctgttattatagacgtgagccaccgcacccagctaatgtttcttgattctctgggtaaacctacctccagacctctggatataccacctccaccttttgtttctccagcctcaggaagttaatgccttcctgctgttgctaatctctagattgcctcgtggtacccagtaggcctctcagctcttccattataaatgtaaccaagtgcctgtattacattacccctcttttcaatatccagagtggtttctattttcctgactgatatatgcaggaaaa

SEQ ID NO: 135275 - DNA, 492 bp, Homo sapiens
aaaagactcaggaaagcaggcatgatattactagaaaaagaagttacaagaggttgtagtccaaatcccatattgttcacaacaaaggcgcagtgaactaccattcacagaaaaagcctggaagactctgatggaacataattacatgacaaagagcttccaaaggaattcctgggacagaaaaatggtgccagggctcattatttccctgtttccagacagtaattttgtcatgacagtgtgctttattactttctgaataaacaattgaaggtcacaaaccaagtatgacctttacaattgcatgagctttcttacggcttttgccgtttataaatatttctacagccaacttcatgatagctatgtgaggcctagaaatctctctgaaagcagcaagtgaggcagagcaagacacacttaccccaagtccaccctgccgtgtggatgtctgacatataagacaccaaagtggaacatttaatagcacca

SEQ ID NO: 135276 - DNA, 443 bp, Homo sapiens
tcatcaaagtctcctcgggaggagggacatcagctctgagagcctcatggatcaaggcaggggcagaggcaatgtcagaaaggtgactggagccagctggtgtcagtgtcagactgtctggacatagtctgataacaacgggaagccttgggactttgagcaggaattccatgtgtttctgctggatcccctacgacaacctgagttcctctggaagtcagacacccttctacgccaaagttacctatgcagacaggcgtgcagcttccatggaggatcagatggcaaatcctgctctaattacgctggtaattatgagctgacacttgcagagcaagaaagaacattccttctgttaggaaatgatcaactgggaagccagtcccagcctctcaaacagggaaggcgctgtgaatttacaaacagctgatgaaaggaggtga

SEQ ID NO: 135277 - DNA, 316 bp, Homo sapiens
ctcatttattataaaaactctcagtacactaggaatggggtgggggggagcttcctccacttaataaagaacatctacaattacctacagccaacaacacacttaatggtcagaaactcaaggctttcccgctaagatgaggaacaaggcaaggatgtcccctctcaccttttcttttcaacactgtactgaaaatcctagcttacgcagcaagtcaagaaaaggaaataaaaggtatacagattgggaaagaagaaataaaactgtctttgcagatgataagattgtctatgtagaaaatctgaaagaattcacc

SEQ ID NO: 135278 - DNA, 780 bp, Homo sapiens
gtaaaaatgatttaggtatagcacttatgacaatgcctgacacacagtaagtactcagatatcatcgatgatgaggatgatagtgatgatggtgatgataatggtgataatgtgatgatgatggtgatgataattatgtaattgatgaagacaattactactaaaactaaaaagggaacgttgaaggtttggacaagcaagcacaactgggagatgaaatccatcccacttttgatcactgatccataagcttttggatggggttgtgtcatccataagaaaggaacaccttttattatttttcaacccagaggttgccccttttggtaacttctatattcaaaggtaaacttttgcattaaacttacaagaaggtatcatgtaagttagtggtctccttagaaatcacaatatgtataactcatgcaaacatgtttaaagaataacttatagaaatatctcttctttctttcttgtccccatttctaaattctcccttacaacatttcacaaaaatatagaggcacctcttacgctcttttgcctcagggcaagtttgtatttcaatgccaactgcaggagttttctgtaaggtattttcctctcctgaattttgttttttaaagactgaatattctgaaaagatggtactgttgagattcagaaagcaacatccccaacatgaaagcctcagaagcaaaagtttttctctgaccctctcctgccctcctgtctcttagtcccattctcctcctaggctagccatagaaactagactcc

SEQ ID NO: 135279 - DNA, 386 bp, Homo sapiens
tctcaggacggaacccaaagacaatttcacaggatttacaatttgcagctattggttctcctttgaccgaatccttgaatttgcttaaaaaacaatgaagagttgacaagatgggccactggaaaatgaaaagagcatcggcacttcacgttcattaaaacgtgaagagatgaccaactaatgctgctttcataccctggatagtgctgagtacctaacagctctttaggtcacaacgtaaaattcggcttccagctggtccagttttcccatctgtcgtatccacggaatgtccaaatgtaagggaaaaatgtggagtgtccagccgcccaccagtccacccagcaccacagcctaacctcaccgaggcctcccagcactcacac

SEQ ID NO: 135280 - DNA, 317 bp, Homo sapiens
gtttaacagaagagtcctctcagcaaaccttcacttcgatgtcaccactactgagatgccttctctcaatcagttacccaggttcttagatgctaaaatacaacttgagtcatagccttcctcaaggagggtccatggattcccagggacaagttaattccattcatccttttaggtccagttggcacctccttcctccacaagtctctggcacttcacagctccaacgtgcacccaatcgtgttgtttggtcacactggaatgaccatcacaccttgtctcttcaactagaccataagctactgaggaccagaaag

SEQ ID NO: 135281 - DNA, 684 bp, Homo sapiens
tacccagttcgacggagactctcccccaattgggggagagtggaaaaggccaggtgaactgccaggttctgcaaggcagaccacagtaacggctacaggatttttaaattaatgggaggggaaaagggggctcaggagatttctgggggtctgaactggtgatagcagaaatgctaaaggaatacatctcctgaaatgtgagggaaaacccacagagaaaatgggctttcatgagtaattggctcctctacccctttccaggctccgagagcgtttcacgggtttaccagagaaaatggcctccggagactgcaacgtgagagtctccgtcgaactagttcgacggagactctctctctccagctggctccagagtgcctggctgctccagagatacagacgcttctaactccatacaaggctggagaccagcagatgtggtacagaagtgagctctgccattccttttactttggggccctggcaccttttgccccaacagtcaagcttcctagggtcgaaaaaaactcctccatttccctctgcaacagctggttcctcctctccgcatcctcccgcgcccgttcagagttccgcagctttatttccagcatgatgtattttttcttttcctggtccagtttctagaatctttagtcacactcccttcttcgattcactgac

SEQ ID NO: 135282 - DNA, 812 bp, Homo sapiens
aaagaagaaggaatatccaagcactcatgtttctacacgtgaacagaggagatggctatttctatgtctactgcatgaaaaccatgggttagctactacatctgagatttcctccatttttgacattccattaaggcctttctaagaagtatgtttatctaagccaaggaagtaggttatatgggagggaaacactttagcttgcatattagggaactagtttatctcaccaaaatccatgatcacttattgctacctatcagaatgcagtccctaggggtatgagtgatggaatggaaggggtctagggctggcaggagcctgggacattgcataattgtggtggatatctgggcatcagagctctgaaaggaggtatcttggatccaagaacaaacttcgttcttcacaattttttccactgccagccctacatatggtaatcagagatctacatcagtcaataaaaagggatatagatcagttgggggtaagtcaggaaaatagaaaccccaggagttgttttaacagaaaatttaaaataagaattagaggactgaaaatttcaaaagaaaaactgagattacacagagatcgtaaatgcaggaagcagctatcatttctaaggttgcgggaacaaagaaaagagtttgaagttgtcagaaattaaatgcttaaaaaacggacccatacaaatggcacaacagacctctaagaagaagacactgcactgcccagcaggtgctggtacctctggagggagcgtgttggaacaaaccggagaccagaccacttacagctgtagggaaggg

SEQ ID NO: 135283 - DNA, 546 bp, Homo sapiens
cattactgttatcaagtgcctgctcctaacatcagaaatgttcaaggtactgagctaccttaattacctgcttgcaattcacaaatacattctttcaaccacatcctcccaaactacagaagtatcctgatgaaagaacaggtgtcaggctcaagggaaagaagcagatgtggtcacaggtgtctgtttcctttagggggctgattcaactatgcagatctaaccctgccaaggtagagtttagttaaagaggaagcctgcctagtgccttccacttctcagtctccaggcccatgtggttaatagcagaataaagtgtttacaattttctaatgaaaattttgaaggaaggggcttatgtttataagattccagcatctcagttcttcatcatatttcctccccaaagagcgatctctcttccagtgtcaggtttatgcacatcaaagccttctttcggatcattcattttgaagcataaataatgtcaaataactacatttaaggtcacctttcagaagcagaactgggtccgagcctgacgta

SEQ ID NO: 135284 - DNA, 398 bp, Homo sapiens
actagcaagcactgtgattggaggaaaggcattcaactgtacatcagaaccctgggtcatggtttaagcttgtcaataactagttatatcacttggcccaagtatcctttgacttctccaggtgggctcagttcctcatctatcttttcatgacactatgaatttgggattgatcctagttttagaagtttcaatagcaggtggatttagtaattccagtttgaagctttggttaagtagtgaccttgggaatataaccatgaaatgtcataaggaaccataaccattatataaaattgtctcaaaaactaaggtcagtgttgaagtgaagaccttgggtggtatactttgatgcagaaaaaaataaatagaacaaaatatcctacttaactgtcatt

SEQ ID NO: 135285 - DNA, 291 bp, Homo sapiens
caaaaagaagcatacttaattttctattctgatattctgaaacagaaacacaacatccctgtgacttcctttcttagaaggcttgataaataaacaccctgggttctcctgaaaagagagaactttcaggagttctctgttatagaagtagacaaaaaaatgattatttgctgcacagaatattgtttgtgggttcttatttttatttaatactctttacacatgatgtgtatttctcagctctgggttttaagaaataattttacttctcaaagaggcaaaactttttgg

SEQ ID NO: 135286 - DNA, 816 bp, Homo sapiens
gtttgaatttgtataccatatgcacatagaacttttcaaacaaagaagaatttaactaaaggtctgtggagtatatttgcccagtagatgtgggagttttctttcaggtctagcacaacagcagcagtacatctgagcatttttcttttcttgtcgtaaaatatacataacataaaatttaccatttcaaccacttttttcttttatttattttgttttgttttgttttgttttgagacagggtctccctctgtcaccccggctggagtgtagcagtgtgatcacagctcgcagcagcctccacctctcaggctcaggagatactcccacctcagcctcctgaatagctgtaaccacaggcacatgccactgcacccagctaatttttcgtattttttgaagagacaaggttttgtcatgttgctaggctggtctcgaactcctgggctcaagcaatgcaccctcctcagcctcccaaagtgctaggattacaatcatgagtcactgcacccagcctcaaccattttaaaacgttcggttcagcggcattaagtaccttcacattgctgttcagccatcaccaccatccatccccaaaacttttttatccttcccacgtgaaactccgtacccataaaatactaactcaccactctcctctccccgcagtccctggcacccactcctttactttctgttttttgtgaattggacagtgtaggaacctcctataagtagaatcatacactatttgtctttttgtgattggcttatttcccttagcatgatgtcctcaaggttcatccaggttgtagc

SEQ ID NO: 135287 - DNA, 161 bp, Homo sapiens
agcgatctgcccatctcagcctcccagagtgttgggattacaggcatgagccactctgcccagcctaaacagaatatttgactatgttatttaaaacaaagttttggtagaaatgtctttttttaatagggtaactcagccagtggtttagggacaaatct

SEQ ID NO: 135288 - DNA, 244 bp, Homo sapiens
gagccttcgcacttctggagagacagaactctgcaaatagagctgagggaatactcaaaagacagatttgggagttctaagaactcgtgcagtaaaatgacagcagaggagaaggggcaggaaaatgttaccctaagagcatggctggcaggaaggagtgaggctgggtccactgatccccactacttagcaggaaaatgccaccctacagggcatggctggtagggagaagccaagctgggtc

SEQ ID NO: 135289 - DNA, 666 bp, Homo sapiens
ggcactaaaaagaaaggctatgattgcaaatataaatggcttaaggaggtggaagcccagtttaatggaattaaggtggtcaacgtgtcaagacaatgctggcattttaggtatagagaaattttgttgcctagttgaaaattttcaagtgaccttgggagcctgataaggatgtaggttactggcagagctgggcaaggagtgagtgattgatattgccaaatggcttatgagacacaaaacaaaaataacttgttttggaaaaagtttaagtaaaatgattattcctgttaaagatttatttaagttgagacaaaaaaattggagacagagaatttttgtgagaagtttgagttcatagggaagcttaggaaacatgaaatttgatttccagagagcagagtgaaaaatgttttcaggaaagatagggcttagataagtcaaagaaaaagagaaaaagaggggaaaaccccatccaaatctctcgctctctcttcctctatgtattctaaatgtccatatatttaatgaagaacagatagtcagtggggaacactagcagacattaaagggatatgaggcatgaagagaatagctgactttggaatattacgtaacattgtcatttcagtgtaagctgagggttttgttgtgctcaggggcata

SEQ ID NO: 135290 - DNA, 1314 bp, Homo sapiens
gagatcagagcatggactgcaatgtagagcattctttgaaatggtagaacatcaggtgggaacattgcctataatcccaatactttaggaggccgaggtgggtggatcacttgaggtcaggagttcgagatcagcctggccaacatggcaaaaccccctctctactaaaaatacaaaaattagtcaggcgtagtggcttgtgcctgtaatcccagctactacggaggctgaggcatgagaatcacttgaacctgggaggcagaggttgcagtgagctgcaattgagccactgtagtccatcctgggtgacagagtgggactgcctcaaaaaaaaaaaaaaaagaaaaaaaaagaatatatttgacaccttagactggagttaaccagttgtgttatttatttttaattactgctgctgttgttggtcagatatattcatgccactataaatgttttcaattagagataagtaaacattttcatcccatcgctttttaagcagttaaaaactttaaataaccatccccttcactagcctgtgagcacattgaggacctgtgagctcattgaggacctgtgagctcattgagggtggtgcaggtacacttttttttttgtatgtttccagtacccagtggagtgtttggtatatggtggggctcacagctatttacagctgttgaagaaataaatgaatgcatcagctccattcctacaacagcatttgaaaatatttgtttatcttcactctcactaagactagtttttagagtagttgtctatcaaaaaagagaaaatatcagattaagatttaaattttgatgtatagtagcatatatcgttagtctaaattattttcttctgcttaaaatggggcttagcaaactatggcccatgggccaaatctggctgtctgtttttgtaaataaagttttattggaacacagccatgcttatgtatagtctatggctgctttcgtgttacaaaggccgagttcagtagttgtgacagagactgtaagctctgcacagcctaaaaagcataaataggctgggtgccatggctctcgcctgtaatcctagcattttgggagatcgaggtggacagattacttgagtccaggagtttgagagaccggcctgggcaacatagcgagaccctgtttctacaaaaaatagaaaaattagctgggtgtggtgtggcacacctgtagtcctagctcctcggggggctgaggtaggaagattgagccagggagatcaaggctgcagtgagccaagatcactctacaccccatcctgggtgacagagtg

SEQ ID NO: 135291 - DNA, 539 bp, Homo sapiens
  misc_feature (20)..(20): n is a, c, g, or t
agcagcccgactctagtggnatccccgaacccaatgagctgcttttgacttgatgtcattttgttggtttcaataactatttgttgaaataatctgtgccaaaggaggccaaaagggaagaggcataggactggggttcaaagagcagaccctgaagagtccttggaggacgagggagagtgcgagaggcttagcagggtggacagtgattctcattttacaaaaatgcccagtatcgagattgctgcagtgttttcagtgctggggaaatgacatccctaaggcttgcattctagatcctcaaaaaacaaattgcccttttaaagtctcacggttaaagagatatttggtgtctcttgaacatgtggtcggagggttttctgatgggaatccttggttgtttttaacaaaataagccagatccagaggctgcgtgacaggacccgggcacctctcaggctgtcttctcacagtttgtcttctttcctagcctaatttctagactctctgcacctgtggtctttgtttcactccagcat

SEQ ID NO: 135292 - DNA, 511 bp, Homo sapiens
agggtggtaagccacaaggaaacaagcattttattatgttgctggcctactggggataatttcgcagtatcttttaaattacaaattccctttgacccagaaattctaaggttttatcttactggtatagatgcacaggtatagaatgatgtatttacaaggttattcattgccatattatttgtaatcgcaaaagattggaagcaggaacataaacctcatcagtagttgaacagttaaattatgattcatattctttgtatgccaggaagctgtaaaaagggaggaggatgttatgcaccgatatggaaatatccttaactgaagaaaagcaagggcgaaagaatagatttgctcatatatgcattaaaaaatctctagataaacaggaaaggcacaactttagttacctactgtgtggaagagtgaacagggctgaaagggagatttctctatatacacctttattactgatccaaaaaaattaagtactttttctaaaggtgtgtgt

SEQ ID NO: 135293 - DNA, 918 bp, Homo sapiens
atatttcttgtccactatttttctcttcaaatgttttaaacttgttatttatccccactattgaatttctatcttagtccatttatgcttctatgacagagtacctgagactggataatttataaagaaaatacaattaatttttcacaattctgggagctggaaagtccaagatcaaggtggcagccagattggtatctggcgaggactgctctctgcttctgagatggcaccttgcttctataccttctgctgggaaggcatactgtgtcctcacgtggcagaagggacagaagggcaagagaggactcttttcaaccttgagccattttgtaaggatgctaaatccattcagggggcaaggtcctcatgacttaatcatctaccaaaaggctttccctctcaaaaccatcatagtgcgattaagtttcaacatgaattttgaaggggacacatccaaacacagcaatttctaatttcaatgataggtttaatatctttacattctacttatttcttttcaaatttgcctgattattttagtacttttttattccttcattacactttcaatatccactttatttacttaaaaatattaagcatacttttattttggatctgatcattcttatacctacagcctttgcaggtctctgtctctaacattgggttgtattctgcggcttttcagaggtgatcgtttggttctggaatgcctgtggagcatattctgggcgtgtctggggcctgtcctggtcaaaggtctctcagtatggggtctctcccgcgcttaaccatactggttgtggccaagcagtgctaccctgtaggtgtgacgcgccagcgtgtctcttcctccccggacagaacacacctgtttgcccggggggttaacgcaatcactttcgccagcgg

SEQ ID NO: 135294 - DNA, 358 bp, Homo sapiens
caaaagtatggaattcaattcttcttatatgctgcagccatgttcctgccctagatttggatgggtgtggtggcatgtgcctgtaatcccagctactggggagcctgaggcaggagaatcgcttgaacctgggaggcagaggttacagtgagccaagattgcaccactgcagtctgcctgggtcacagagctagactctgtctcaaaaacagaaaaacaaaaaaacaactttccagtggcttctcactgctctgagaataaactccaggctcttccattgcaaccaacaggatctggtgattcgaccccagcccctctttccaggccctcatcaccttgatcctcccttaacctatcc

SEQ ID NO: 135295 - DNA, 595 bp, Homo sapiens
cacagtggctcacacctgttatcccagtacttagggaggctgaggcaggcagatcacctgaggttgggagttcgagaccagcctgactaacgtggaaaaactctgtctccactacaaatacaaaattagccgggcgtaggggcacatgcctgtaatcccagctactcgggaggccgaggcaggagaatcacttgaacccgggaggtggaggttgtggtgagccaagatcacacctttgcactccagcctgggcaacaagaacgaaactctgtctcaaaataataacaataataacagtccttcacaaactctcccaaagtttggtatacttcctaattcttttaatgagaccagtataacattgatacaaaaacttaataaagccattaaaaaatgtctcttccttcctattctctgatagtgtttgtagagtattattattatttctaatgtttggaagaatttacctatgaagatatctgagccttgacttttcttcatgggaaagttttattacagatttagttctattctgatatttaaatttctcctgtattattttcagcaagttgtgcttttatagagtattttgtcc

SEQ ID NO: 135296 - DNA, 282 bp, Homo sapiens
taattaggcaggcatggtgatacaagcctatagtcctagctactcaggaagctgagaggggaggattgcttgagcccaggagttcaaggttgcggtgccaccacagcctagtcaacagagtgagaatctgtctctaatttatacaaacaaaaaaaagattttataaatggaagagtttacgttttcagctgaaaagtgctttatttcttcctcccagtggctatactcaggaaccaccagtcttgagtctggccagttgagcccctatggcttaagctggca

SEQ ID NO: 135297 - DNA, 405 bp, Homo sapiens
gaaatcatcacggaagaatttatcaatgtaaccgaataccacctgttccccaaaaactattgaaataaaaaaaaaaagataatgacatataatgttgttcgtattgtatgcaattagaacaactctttaaaattattcttaggagcttaaaattagaacagtaatttacttagcagtattttacatgcaggtggtttgcggaatttgtgatggggtttctttcttttttttttttcttttgagacagagtcttgctctgtcgcccaggctggagtgtagtggcgtgatctcggctcactgaaacctccgcctgccaggttcaagcaattctcctgcctcaacctcctaagtagtggggactacaggcacgcgccaccatgcccagccaatttttgtatttttagt

SEQ ID NO: 135298 - DNA, 473 bp, Homo sapiens
acagagacagggagaaaaaaaaattgagagatagagagatggagaagagagagaggaggacagcgacagcaagatcaagagaggcagagagatggacagaggacaaggcagaaggaagcaaagacagggctaggcaaagaaagagatcaaaacattaggagtgggaaaagtgggcgagggacaaaggagtttcgtggcctcagtctctctagcctggtctccccagggtgttggacccttactttgctattctctggtttccatagcaacagggagggcagcgccaaatttgcatacacatttacatcctttctatttgaataattcaacaggtttctgtgcatattcatgagataatgaatgaaggtgactctcaatccctgctcaaaacctggctatggtatcccctgctttgtagtgtatggtatggctctgagcctggttttgtaggccttgacctctccctgccagac

SEQ ID NO: 135299 - DNA, 779 bp, Homo sapiens
ccaggggactggctctcagcataccaaggacatgcaccagcaccggtctctgagttccctcagtttttattattattttcattatctcagcaagaggaatgcagtaggagagcagggtgataataaggaggaggtcagcaaaaaaacatgtgagcaaaagaatctatgtcataattaagttcaagggtaggtactatgcctggatgtgcacataggccagatttatgttactgtccacccaaacatttcagtggagtaaagaataactagacagcattgctgccaacatgtctcacctcccaccatagggtggttttcctcctatctcagaattgaacaggtgtacaatcgggttttataccgagacatcaagttcccaggggcaggcaggaaatggtggccttcctctatctcaactgcaagaggatctcctcttttactaatccacctcagcacagactctttatgggtgtcaggctgggggatggtcaagtctttcttatcccatgaggccacatttcagactatcacatggggacaaaccttggacaatacccggctttccagggcagaggtccctgtggctttttgcagtgcattgtgcccctggtttattgagactagagaatggcaatgagttttaccaagcatactgcttgtaaatattttgttaacaaggcacatcctgcacagccctagatcccttaaaccttgattccatataacacatgtttttgtgagctcaaagttggggcaaagtggctggggcaaagttacaa

SEQ ID NO: 135300 - DNA, 203 bp, Homo sapiens
aaatacagggaagatttgctttaattaaggaaaatgtatgtgataaaagaaatcactttggaagctagcagttggttctatatgtagttcgtgtagtggaacaaatagacttggctggaggcacctgtctcttatgagggagggagacagactgacacataacgtgctgttttctgtataaaggagagggtgcagtgttcggg

SEQ ID NO: 135301 - DNA, 315 bp, Homo sapiens
ggtttcaccactgcataatgcgaattaccatcttttcagctgcaacatgtcattctccattatctggccctaaagccagtgccatatatctcatgtactgctgtattccaagcatcctactctgagtaccattatctgtatcagtcatcttaggctaaggtatgctgtcatgtgaaaatggacaaatgtatgtgctacggatggattttcaaattagcacagcctgaagactatagaaaaataaaaggagactatgatagattctatgaaaaaattcggtgtctatatctttctattaaataattaatagcattt

SEQ ID NO: 135302 - DNA, 449 bp, Homo sapiens
gctggtgtgtgtcttgtgcaaggtgttgaaaagataagaagaaacaagatagacaagatccctgagctcatgaaccttacattctaaccaggtagacagacatagtaagaatgtacattagttatagattgtggtaattactgtgaagtaaataaactattgagatggaaaacaacagaaagcacccattttagatagggtggtcagtgtaggcctattttaataggagacagtgagtttaattaatgtgaagacctgacttctaggtagatggaagaatcacacaaatgtaatttcactctttcttgaaactccactagaaaaaagtaaggcactaagcttaacaaattctacagaacaaaagacttggattcctcaacaaataaattatcggattaggagtgaatagagaggtatctattcacagccaaagatgactttctgcccca

SEQ ID NO: 135303 - DNA, 453 bp, Homo sapiens
acatggtatgttgccatcagttgggtgtgtgtcaaaatacacctataactattagctgtgtgaaggaattgcttttttaaaaattgagaagagcagatttaaggttatcctatgatgctcttgtttgcactgtgatatgcttctcaaagaggagaaagggaagaattacatgcagtgtatcagcaattatatataagtgtctgctatggtttgaatgtgtcccccaaagttcatgtattaaaacttaatccccaatgcaacactgttgggcagcaaggtctgataagaggtgattaggtcatgtgaggactctgccatcatgagtggactgatgttattgcaggagtgggctggttatctcaatagtgggctttgtgataaaagcaagtttggccctctcttgctctctcactgttagcttcttctgccctttggccttctaccatgggatga

SEQ ID NO: 135304 - DNA, 505 bp, Homo sapiens
tcgacggaggactgctctggtcgaggacatatctcagtaagtgtggcatccaagcctcaccttgcaggagcagaatttccacttctgatccacctctacttaacattcctatcaggaaaagtctcaatatcctcttttagtcaatttgcatatataacctttattctgattctgtaaaagtcagcttactaaaaaatatcctatcttaaaactttatgttttaaatttgattttaaattttattttctttgatgacagtctcaacctctttcccgctttatttaaaaaaagaaaaaaagaattgttggaactataaagaatacattttgacacttgaagaaaggacaaaactgtggcctagagaggttactctgcattaaatcacagaattaatcacaaacaactagaaactatccattattaagtagatgttaaagctctaaaagtgatcctagtctctcttcacagatttatttataaatgaatcacctcacacatatcttaa

SEQ ID NO: 135305 - DNA, 404 bp, Homo sapiens
aggacctcagagttgtttcccactgtacatataaatacaatgtgcatgtgaagcacccatgtcagtactgcaccttcacacccagttctgttgatggctcaaagaatgtcgacttcaattgaaatagttctggcctggcatggcagctcacacttgtaatcccagcactttgggaggctgaggcgggtggattgcttgagcccaggagttcgagaccagcctgggcaatgtggctctacaaaaaatcatacacagctgggtgtggtggtgtgcctgtaatcccagttacttgggaggctgaggtgggaggatcgcttgagcatgggggtgcagaggttgcagtgacctgatgtgcctctacactccagcctgggggacagaatgagctcctgtctcaaaaaaaa

SEQ ID NO: 135306 - DNA, 419 bp, Homo sapiens
aggacctcagagttgtttcccactgtacatataaatacaatgtgcatgtgaagcacccatgtcagtactgcaccttcacacccagttctgttgatggctcaaagaatgtcgacttcaattgaaatagttctggcctggcatggcagctcacacttgtaatcccagcctcccaaagtgcggagattacagctgtgagccaccacacctggccgacaattttttttttttttttaacttttaagttcagggatacatgtgcgggtttgtaaaataggtaaacttgtgtcatgggtgtttgttgtacagattatttcgtcacccagttattaagtctagtattcattagttatttttcctgattgtctccctcccaccccctatcctccaccctccaaaataaaaaaatttgtttttagaaa

SEQ ID NO: 135307 - DNA, 742 bp, Homo sapiens
ggctgtttttttttacgtttttggctctcacataagaatggtattgtggaactagattcattctgtgctcatctggagagtggaactaggcatattctgttataagaagtataaattttactaaaactttgactgttagaaaaacatatgtgctggggcaaggaaataggaaacaaaatacagcttcctgctgttgatatatctgttacacaaagtgattcagaacattagtgccagtgcttcaccttcttcttcataagcctgaggcactaaaggaatgcaaaacactgggcttatgagagccagtctccatcctttgttattctaatttttcatgtgtgtagtgagaataaaccatttccatggtaggatcttccaataatcaagttcgcttttcaagagagttataaatatcttcaggtgaaatcagataattgacatttaaggcaattataagaaaatatatgatatacatatttaatttcatgcaacaaatacttttcaaacaaatgaccgtgaatacgtttagttaagagggcatttagcttcatgatgttcacccttaccatttacttattttctttttgctcttgttgtttagaattgtacaaatattaccttatgaattctagaatatatattatattcctaaagtgcaataataggttagttttaaacaaaataaatattgcttttgtcttctaatcggtgattgcttttctctattaagtactttaaaaac

SEQ ID NO: 135308 - DNA, 299 bp, Homo sapiens
agagcagagaccctgagaagttcacccctcagctgagtgggcaagtgccaggcatagtgctcaatgctagagagacagatatgagagaggtagagatgcttacacattccaacaccatttaaaggtgaaggtgaaggcctattttgttttctgcctgcccaacctgcttgggcgaattattttgccaactataagtctgactttaaggatttggcccctggggctgcaagggatgggaggtggaccggggggaacttcatgtcaaggcttcacatgttatgctagggcaagatgataca

SEQ ID NO: 135309 - DNA, 423 bp, Homo sapiens
gggcaggggcctggaggaggtggtcttgaagtgcatgccacagatcttccttcccagggagggcgagctggcaccatggtgtggcacagaccccgcgtcccttcagattctgccatgccaggctgtttggcctcagggaagcagcttccctgaccagtccttagcacctggcacgtggtgagccctgtccatggcaccagtcaccgtcaccatcagtcaagggactgcaccttggggtgctgggtgctgacgtcctatgggagggctccaggggtgccgcctgtctggtgctctgggggtcacccaatgaatatgagagccttcctgggagagaggggtctcgttcagcacccctcctgaggacccagccccaccccagggtgtgaggatgcaggccaagggggcctgagggagctgcagtag

SEQ ID NO: 135310 - DNA, 520 bp, Homo sapiens
  misc_feature (16)..(16): n is a, c, g, or t
aactctgcttcctgtnatgattgttgttactaatattactattatcttaagatacagaattaatacagtgaaaactacattgggctaaagtcagaacttagtgttctgatatagttgagaagggacgtgaaaatagccagcagaattcagtaattttaagaatcctctagcccttaaaattatttttgcttttcaggaatgtagatttagttctcatcagatgatgagtaaacatcttctgaggcattctttttttctgctttctttttttttttttaacaactttcaaccccattgatttttttttttaagtttgaagtagacagttggtatctgtctctgttacttaatcaaggtgtactatacattgtgtttagtatgatgaaagtacattttacaaaatgctacttaaagtcaaaagcaaaacaactttctaatatattgtgtcacttagataaataagaaaatattgtacattgcatagggaacctatgagaattatgtaaatgagcaatagact

SEQ ID NO: 135311 - DNA, 776 bp, Homo sapiens
gaaactggagtctctttgtgggatccagggcagtggctttcagattctgtttttgctgcctactgaggtgtcttaggagcttctgaggggaaatcactgagtacagggctccctttccaccttcaataggagcatcccctcccttacctgtttcatgtgaaggaggggcttaattactttaaggaagtttaaaccccagaactctagagcaggggttggcacattatggcctatgggtcacatcaggtctaaagctgaagcttgtttttgtaaataaagttttattggcacacatccacacccatgttggttatgtgttctctgtggtggcttccctgctaactggtggaggtaagtagttgcaaaagaggccttctgacccacaaagcccaaaatatttactgtctggccctttgtagaaagtttgctaactcatactttagagcatttcttctcaaacttcagtgtgaatagagatcagctgagactattcttaagatgtctgccatggcaatacacctggcagcaggtgcaatgtaagtacgtcttgcacagtgcaggcagtttcatggaccaaggaccccaggcgctgtgctctgaaacacatcactgcattttcactgaggccacagatccctggggtggcatggttaaaggcagaccagttcctgagagacagtcattgactttggctggaggactcaaaaaggccttgcaggaaattccttagactgcactgtagtcaacaacacttccatcccaccttccttccctct

SEQ ID NO: 135312 - DNA, 749 bp, Homo sapiens
cagtgaaagtataatatttctttgataatccaaaatttagaattctattactatcttctttcctattcccaatatatatgtgaatttatttacacatagaaagtttaatcactgctcgggataattctaattcaaaaggtttttcatttaagactgattaaagccctcttctacggtcctggaaacaacctgaaggcatttaaccattattgaatggttaaatggttaaatttaaccattattgaattccatttactatgtctggaaaataggcactaattaataacaaatatattgtgtttctgccataattgttctttttagttatttatgattttccagtttccagctgattcagcatctttctcaaaaacttttcttgcatttgagatgcattgacattaataatcagaaaatgacacacctctctaaacactttttaaatggtgcgtgtttgttttttaagattataatacctttgaattttgtttaactttttcactaaaactgctaactctaggaaatgttaagtgataaatggtcatatatttttctcgtctgagaaggtagataatttgaaaattgtgttctctgaatctatagttttctacaaggttgactggcaagtatgaaaaatataatgcaggaaatgagagtcaagtacacacttaggggaaaaaccaaccttttaaaggacaagactttgtatatttgtagaattttacaacctttcattttattaacattca

SEQ ID NO: 135313 - DNA, 348 bp, Homo sapiens
ggtaagtgggctctccctagatcttttcagagctgcagtctgcctgaccgtgtatcttcctttcctcttccatagctcctatttccaactcccctgccttagtgtatccattgacactaaggtgttgtgactgataccaagataatatgctgcctcttctgcctctctctttgagagagagagagagagaccaatggatcaggttcatttagcacctgaaagggggtggtgtttggggacagagagacctttggagttccagcttaagggtatcagcctccctggctgatgtaagtcagaggcctcttatacccactttgatgaggaaggactgtagagttgatgcca

SEQ ID NO: 135314 - DNA, 370 bp, Homo sapiens
atcaatccttttaacaactattcgccatgattatgtcctgtattttaggcatttgggtcctttcatcccaaagaatcctgaaatcgtttcctatctgtaccaagaatcctatgagtgttagtcactttattcatatctgaaatattatctctctcctcagctctctcccttccctcaggacagaaagaaacagtggttcttagagaagagaaatgttaaagaatgtaccttcccgagaaggaagaaaattctaattagtcaccacattctcatttctattaccaaataagggagattgtcataagtgacaactgaagatgacccctcagaactttcccccactacaaactctttggagttgacatgaggc

SEQ ID NO: 135315 - DNA, 330 bp, Homo sapiens
ggtatcagggaagaaagggcaattaggcataaaggttaataaacacagaaaaaagatttgatggcagtaaaaacattttaaacttcagtatgctttaaaaaaagaaaaactgaaacaaaaagacactgggaaaaatattagcgtatgttggtaaaaaggttaacactttactgttaagagtttttaaaattaatttattctttctatgacaaatatttattctgtatctactaagtgtcaggcacttcctaatctgcagaattaataataagcaaagcagagttgaaaaaggtaaacataggcccggcacagtggctcatgcctgtaatc

SEQ ID NO: 135316 - DNA, 323 bp, Homo sapiens
tcagtaagagctactccagcctgggcaataatgagctactccagcctgggcaataagagctactccagcctgggcaataagagctactccagcctgggcaacagagcaagggtctgtctcagataacagagagagagagaggtgcatgagaactgccctcccggccttcagagagaaagctggttttgtggagccttgtctaagcatcaggtgcacccctggcattcttactctgaaatttgattatctgtttaaaatcaatagcatcactttccacctccagagaggttgaaagatagggaactctcggctcaggctgacct

SEQ ID NO: 135317 - DNA, 135 bp, Homo sapiens
ttgtgcacattgaaaaacaatctacgctggggatgtttagagcatcaacactgtccatttcttctggacacactagagtcaaagatgcatttggtaggttaattaagcaaaatgaggggcagacaaagaaaacca

SEQ ID NO: 135318 - DNA, 295 bp, Homo sapiens
tatcactctggaatctctgccttccagtcccagtccttaaccctcaatttagcccacagaggtttccaagaagtatcccctcttctcagggctgcagatccttgcaaaattcaatacacatcaacatttactaacactgactagatgtcaggctccatccaagacactgggagcacagcaacaaataagataggataattatactcaaagtcctcacagccaggtaggggacacagcaaggaaccttcagctcaaagttcttggggaaactagtgtctcaggttaagagaagcag

SEQ ID NO: 135319 - DNA, 639 bp, Homo sapiens
aactctaaaaagaatcctttttaagccattttgtccgttggatactctgggaaacagacgacaagatgaaggtaacacctatgaaagacagggaaagaaaggagaactaggcagtaaaagcccttagaccatgatgctggtctatcattttgaaagaaggaaggggcaggaaaagcctgagtgctgttcaactctgacaacatcttggccagtctaatggacggggactctctgtgatgccattccagtagttacctgctacaggctggctacctcatctgtggagctccagagaccacgaaagataacactcattgccatagctacttgtcagcgcataagaaagtgaacacacagctggtaccaatgaccttccttttctgtttccaagttaatggctggcaccaaaggtctattcctctaccctactggtttatcactgggctgaagaaacccaagtagtgaattacccactaggaccctggaagaggaagtacaacggttatcctcagttttccctggaatctggaatgagcttcctagtttactgaaagtctactttgttgccttgaatttaacccaatcccatatgtgataattattttagcatatttgataataaagattttaggagtgttg

SEQ ID NO: 135320 - DNA, 456 bp, Homo sapiens
taaattcagttattttgattttcctcagatgagagactagtgttattttttaggtcagttaaaaagcttcgctgtcttagaaaagccctgggtgacaaagtccttactaaggcaaaaagcgaaacaaaacctcagaaacttctctgtgacagatggcccaatcttccttcttgctcatggggtatagtgaggacagctctttaatttgatagcatctctttaattagatgtgtcatccgggctcagaatgggtaccatcgggagcactcttaaataattaccactctttatgcctcgagtcattttgcatttttcaaatgtaatcttttgtgatcttccaccttctattttaatattcttatccacagaattttgctcttgtccagcaatcaactagttgtttatatagtattagccaatgtctaaagagttaacccatcacattttttctttttt

SEQ ID NO: 135321 - DNA, 160 bp, Homo sapiens
cttgttgttcttgtatatgacttttttcctctcccattatatcttctaactgcttactgtaagattatatgaatgctattatttttgtatgctaattttataactttctcccttaataaattcttttaattttcatctttgattaccttgggttttatag

SEQ ID NO: 135322 - DNA, 524 bp, Homo sapiens
gtcaagagaaacctccagcctttgaagattcaccccaaagtctgtgtggagatgaaagaacactggtgcagaaaccctgtgttctactcaccacatgaccactaactggctgtgtaaacctgggaaataaaaagttctaacttcagtcatccagaagcaagatccagacccctgttggaaggaatggagctaaacaggatatgtaaatctaaggtctattttatcacaacgttgcatatcaattagaatctacattgatttgctttctgccatgcgtccatatgtgcacaaatgaggcctggacatcaccagctagaggacaacagtcgtgtctttgtgtgccaatgactaatttttggagcatgtactactctgatatatacttctgatatatatatatactctgatatatacttctgatatatatatatactctgatatatacttctgtatatatcagattttatatcaaagctaatataattatgcaaacctatgtttctttttactctttaccatgatgt

SEQ ID NO: 135323 - DNA, 315 bp, Homo sapiens
tcaccccttccctcttcaggagaaactgaacacgttttccagcctaaactcggcagggcaaaccagaacattccccgtctaagcagttccggggagttttaacaatttcctcgtaaactcgtctacagaactcactgtatactgtttaaatgtcgcctgtgtgtggagcaacagttttattgtgccgtgcaatcctcaacaagaaattgtagtccagggagatgaaaatcccttatttggcattcaggcgttgatcaaggtcgtgcaaccctcgctaaaaggatttaggttcatctccgtcattctcagccgggg

SEQ ID NO: 135324 - DNA, 187 bp, Homo sapiens
gtgggaagttcctctcatcccttcatagtgtgaagcaggaagttcaaaaacgttcatttttgaagcaatatttgaatggtgcaagatgggagtccacatgacaccaaagagtcaattataaattaataactcaaatgcaacagaacccatgcttcttattcatgtaggaacatgttctaggaaagac

SEQ ID NO: 135325 - DNA, 194 bp, Homo sapiens
ccattttatctattgcacatgtcctgtgtattaaataagcgtcttgacttgtaaacacccctccgtctgaactcctggactcaagcaatcctcttgcctcagcctctcaaaatgctgggattaccggcaagagccaccacgcccaccttgtcactttcagatagttttttctcatcttgcatttgctattgata

SEQ ID NO: 135326 - DNA, 450 bp, Homo sapiens
gttttgccatgttggccaggctggtctcaaactcctgacctcaggtgatccacctgcctcggcctcccaaagtgctgggattacaggcgtaaggcaccacacccagccgagaggataagatttgaaagaggtgggcctagtttttgtggctgcttttcactggtgatgtatgatctaaaattgaaatatacagtcttaaggggctagggtaataaaaatctactacatccaaccaaggatgggaacactggcacaccatgctttgtgctgagaccttaaaggaatgaaccccaggagtaaaggtaaactaaaagaatctcagaatggtgagctgacttttatggcctcttttaccctggggggaatttgctgattctgggcatgggcagggatctgagaagcagaaaccttatgttggcggaaagcccctactggggacaagaaatcagc

SEQ ID NO: 135327 - DNA, 500 bp, Homo sapiens
tagtctcaatggaatctaaatactgccttgtgagttctgtgaaaaaatttaatatagcataacagacagaaatgattgtcttgtactttctgaaataagtgatactgcttcttcctccacattagtgaaaaaagactgaggaaggggcttttataagcaaaaccatttatacatttgaacactctaggagttgtcattttaaaattagttctcaaataatgagatacaactgtttattatataatcaaaacactacatgaaaacaggaaaactgttaaaatagtactataactgttacttgtatttgattattataaactcctgggaaaatgggataaatactgtattaaaaagaagatatcttcccactcagtaccaaaaacttccagatgtaagtaaaaatttaagtgtaaaacataaaaccataaaagtagtataaaaaatacgtgaagtaaatatagaatattagaatgattcccatttctagcaggtacctaaaa

SEQ ID NO: 135328 - DNA, 541 bp, Homo sapiens
gttcacagggggaatgctttcatcttttccttgttcagtataaagttggctgtgggtttgtcaaaagtggcttttattaccttaagttatgtcccttctatgccagttttgctgaaagttttcatcacaaagttatgctggattttgtcacatgttttttctgcatcttttgagatgattgtatgatttttgtttttacttctgtttatgtggtgtatcacatttattgactgacatatgttaaaccatccttgaatcccaggtatgagacccacttgatcatggtggattatattgttgatatgctgttcaatattgtttgctagtattttgttgagaatttttgcatctatgatcatcaggcatattagcctgcagttttctttttttgttatgcccttctctggttttggtattaggattagggtgatactacctactctgttattagtactttggaacacttagctcatttacattcaatgttagtattgagatgtcaggtactattttattcattgtgctatttgttgtctgaata

SEQ ID NO: 135329 - DNA, 431 bp, Homo sapiens
acatctgcctgcatggcagggcatggatataaactaagcatcttcaacttaaaatgtcctcagcagaactctggatcttcctcctcaaacccactcctccacacatccaatcggctctcctttctaaatatatccaggagctgactgcttctgccaactgcatcaggacccttgatccaagccaatatcatcttagctggattattacagtagtcttctagctggcctgcctgcttccactcttgcaacatgccaccccatcttaattttccatacagtagccagagtaatcttcttacagcacaagtctgacataaatccttggcaatgagccctgcgtgaactgcccgatggtatttcttttccctctgctcctgttatactagccccactggcttttttttttttttttttgagatagagtctcgctc

SEQ ID NO: 135330 - DNA, 400 bp, Homo sapiens
tactacttcgctcaagataaaaatttggagttattttaaaatatgaatatcaacttctctcccaaatatgccattaatacgctcatatagtaaaaccagtgtttaagattttaaagtaaggccgggcacggtggcttatccccataatcctagcactttcggaggctgaggtgggcggattacccgaggttgggagttcaagaccagcctggccaacatggtaaaaccccctctgtactaaaaatacaaaaattagccaggtgcagtagcacacacctgtaatcccagctactctggaggctgaggcaggagaatcgcttgaacccgataggtggtggctgcggtgagccgagattgcgccactgcactccagcctgggctacagagcggacttcgtctc

SEQ ID NO: 135331 - DNA, 549 bp, Homo sapiens
ttattattatgataaagtccacatgaatgccaaaggcccagaactccaccatttgcagtttgcagaaccctttcacatctactacctcctctacaaaacagtgatgattgttcccatttaacagagatgaaaactgaggctcagagagaggaacttcccaaagctttgcagcaagttggcaacagagtcaggacctgatctcagaccatgtgttttgcggccaatgttcccagccacctccctgctatctcctgtgggaaagcctcctggacacaggcgtgggggtacccatagtcccatgataacgccatctcccatcacacccgcctcagggcccaggcccagcagggattgcgttgcacatgtgactcagccgccttcacaaagggagctgtgtgtctggttccctaggcccgcctcccccacccactgcccatcccccagtcagggaaagagcagggagcctggcctagccaagatgcgggggaagcaaggtcatcctcatcgctaaaacgggacaaatctagtggtgcttcaggaccagcctta

SEQ ID NO: 135332 - DNA, 310 bp, Homo sapiens
attgcactccagcctgggcaacaagagtgaaactccgtctcaaacaaaacaaaacaaaaaaccacatagttctgaagaggagttaatgtcataagaaaattttcatatgttaactgaaaaacaagtatataaaaacaatatatagaggatgatcccaattttataaatatgcagtctgttactagagcttatcttgattggtggcattatgagctattcatttctttttgctcttttccaattgttacagtgaacctgaattacttttataatcagaagtaactcatatactttaaaaataactctgtga

SEQ ID NO: 135333 - DNA, 817 bp, Homo sapiens
gcctggcagcactgtccgctcccatgcctcttagctgtgtgagctgggcttttcacttgctctctctgagtccagctgcccctgcggtaagacatgaggatggctctggtctgatgggttgtggtgagggtgacatgaggtgagctgtgtgcatgctgggcacactggcgaggggctctcagtaatgggaggctgctgttgcagggcccgggctgtgatggggaaagggttgattgtcctgcgtttctcagttgaccagcggcatccgagggcctgaacagcgagtgactcagggactgcccttacgtgtcagagttagaagtcatgggagaatggaggctgctctctctgggtttccctgtcctgttaggaggggtgaggttgcacaggaaatctatggggaaaaggtgacaagtgaactggaagtagccgttccaaagttcctaggatttgcactgccaaacaatgagctttaagggacgcttggaaacatctggggagaaggaaggccgggacactgcgccctgccatcaccaacccctaacctcagtcctctgagcggctccactgtccctgtgccaggtgacttcatgtgcgtcctcattaaagcaaagtgcctgacatttccattgtccagtcaatgatgtcctcggttgctgactattgatggcctctaaccccttggtaagggtaactgcagcctaggaaagggtgatctgatctttctcttttttaaacagagacggggttttgctatgttgtccaggctagtctcaacctcctgggctcaagcgatcctcctaccttggccacccaa

SEQ ID NO: 135334 - DNA, 577 bp, Homo sapiens
cttggacttacccagttctccctgcttatttgattatagttctcaagaataactgtagaatgttatcctgagatagaaagggactggctagaacagaccaggctctgttccagtgccccccggaaacaggatgcacttcaatgctttagtccagcgaatcacgttcctctggagtgtaaaacccagggcaggctgctttaccggatccttcaactgcaggaccagtggggcacacacagagaagactccatctactttaggcagctttccggagccttgggaaaaagttcaccatagatcatcagcttctgttggtccttgctgcttatctgtaagtatcaaacccacttcatgaaacttgtgtgtgagcgttcaatcttaccagactcagacaagttggtcacagaactttctccaccaatggtttctttggtaatcttgcaaaaatataagcagcttctgatccatttgcttctgcctcctaaaatttctttccgaatgtagatgtcaagtgtattttactcccctgatttctggctctgtgtctcttactagctgttcctttgatgctatctgg

SEQ ID NO: 135335 - DNA, 442 bp, Homo sapiens
ttgcccaggctggtctcgaactcctgggctcaaacgatcctcccaccttggcctcccaaagcattgggattacaggtgtcagccagtgtgtccagcctaactatgctctaatgataacaatgacagtattaccctcattgaaaacatatcctatacatcacatcaagtactgtgatttttttttttttttaaatggagtctcgctctgttgcccaggctagagtacagtggcacgatcttggctcactgcaacctctgcctcctggtttcaagcaattctcctgcctcagcctcctgagtagctgggattacaggtgccagccaccacgcccggctaatttttgcattttgagtagagacggggtttcaccaagttggccgggctagtgtagaactcctgacctcaggtgatccacccatctcagcctcccaaagtgctggg

SEQ ID NO: 135336 - DNA, 430 bp, Homo sapiens
ctgcccctccgcttcagctggggaatgttacaatcagagctgggctggccaggccggccccaggtccctcaccctctccacagcatctgatcagtgcccaccaggactgtcggtctggcatacacccaaatgcccagtgttattgctttgggccagctgacattcccagtggcctttgtctgactgaaactattgctgtctccactgtttgtgagggagagaatgtggccctctgaaagcccacaatcctagaacgctgaagggcctcaagaatgtcttctaagttcttcatttcccagaagaagcgctcgaggcccagagaggggcagcgtcttgcctgggatcacacagcagcacaactagaaccacaccccaggtcttctgacttccatcttggtgtgaagagtcccggggcagccaagtgcagcag

SEQ ID NO: 135337 - DNA, 592 bp, Homo sapiens
ctgcttgctacctaacctatattggttcattggtcctttcagtgatacttgtttttgtattctagactatagataagtccatagacttctgtcatctttccctctagctaatgacagcagcactatcatcataaatattataggagcttctggtaactgagtacctactgcatacctggaactgtgataggtgtttcaaagataatcagtatctttgtctgaaaggtaggtagtattacccttgtataacttaaattgcagaagaattggctaaataaaataaatgatgaaaatagctgtaagacaagaaatgtgggaatgagtatattttttagggaagggggacacctgccttttaggtacaatgattgtttttaagtgagctaagcatgaacagatttcaggttttcaagagaatctgaatctgtgaattatgatgtgaaatagccttagagttgagatggccaattgaattatctttctaactacatggtgggtgaagcaaaaacaaatgtagacaaggtctgctgtaagcaattttataggctacttggtgtcacacaggtactaagtgataaagcaggatcccagc

SEQ ID NO: 135338 - DNA, 825 bp, Homo sapiens
tacaatttaaaattcagttcctcggtggcactaactacattccaagtgtccagtgaccacatgtgtccagcagccaccatttcagacagcacaaagaacatttccatcatcacagaacagcaaaacctaactctcaagatcttcagactacgttacaattcttcggaaaagaatgggaaaaaaacatttcattccctaagctcctaaatcctagtcatttttgacacttattcaatacgaatgatttataatagcatcaaggagtgtgaaagtttcatattttgcacaaaatttccatggcgtgattttaaacaacattttaattttcaccagagatgaggtgttaaaaagcatggtggaaattttatttggaagagttaagaatggaaagccaaaactatctatacaataaaaattatggggctggcctccaattatttttttaaacatcttataaaactgaaatccaaaatacaatcattttaaatacatccaaaaatgataaggaaggaaaaaaacaggtaagagagaaagacatcaagcaaaactgtgtctagggaatgtatcatttaaaactaccacctgctttcagcggtatttgaaagggactttgtccaattactacttcccatgatatggccacacttctatcctgaagcttgttctggtttccttagagcataggagtcaaatatggacacaagatgggacagagacactttctttttaaaatcaagcactagaaaggttgccgaatgatgcaaaactaagcaggatatgaagaataaaaggaagaactttaagagaaaaatcacaccatagcat

SEQ ID NO: 135339 - DNA, 448 bp, Homo sapiens
tctcacacttctgaactcaagcaatcctcctgcctcaaattcccagagtgttggcattacaggcgtgagctaccgcacccgtccttgttcctattatttgtttgtttgtttgtttgttttgagacagagtctcacactgtctcctgggctggaatgcaatggctcaatctcggctcactgcaagctctgcctcctgggttcacaccatgctcctgcctcagccacccaagtagctgggactacaggcacctgccaccacgcccagctaattttttgtatttttagtagagatggggttttaccttattagccaggatggtctcaatctcctgaccttgtgatctgcccacctcggcctcccaaagggctgggattacgggcatgagccactgcgcccggccagttctaacccaaattctaagtcactcacccaccggccatcttatga

SEQ ID NO: 135340 - DNA, 357 bp, Homo sapiens
tgcctcctcctgtgttttctcatttcaaacaaacaagtgagtcattcacaaatgctgcaagactggctactcatattttggatgcttgagtattttgttcaaacaagcatggatatatgacgactattcatttatcctggtaaaatcactaataggcttaacaggttgaacaagatctgataaagaatactcaagacttaggggaaaaaaaacctgtctcagaagaaaaaaaaaatcagtcatgtacctatacctgttgtaagaacacacttcaactttcatacactgctggaattgatgtatattggtaaaaagtttctggaggccacttaggtaacaaatagcaaaaaccccctt

SEQ ID NO: 135341 - DNA, 212 bp, Homo sapiens
cagattgtgatctgacttcatccatagttgtagcctgattttctctattcatcaggaatcattatattaataatataagctcctcactgtctattgtttacagctgtgggagttacaaagtaaattttctgtgccttttcccctcttttcttttgttgttactaatggtgttatttagcaaactgctattgaagctaaatgataaatgtaag

SEQ ID NO: 135342 - DNA, 768 bp, Homo sapiens
tatttttaatgcaaaaccagacatgtaaaattctgactaagttgattacacgtatttaacaaagtcatcctccaaaagtgctgggattacaagcatgagccactgcgcccaactctctgtttgttttttgatgaccacccccttgctccccaaatggctgtatcagcaaagttgggagcttaagaagaaatctaaacaggccattactacccctgcagctgcctgttctcctcaaccagtgtgatgccacccttacccgtctctattaaaaatacaaaattacccgagcgcagtggtgcacacctgtaatcccagctacctgggaggctgaggtaggagaatcacttgaagctgggaggtaaaggttgcagcgagccaagatcgcgccattgcactccagcctgggcaacaagagtgaaactccatctcaaaacaaaacaaaacaaacacatatattcctttctaaaaattaaatagttctcttgatcttaccttcagcttgagaggatagaacagtaccctatatctgcgctcccttttatttatttttgacagagagtctccctatgttgcccaggctggtcttgaactcctgggctcaagcaattctcctgcctcagcttcccaagtagctgggattacaggcaggtgctgctgggcctggcccatatggtcctttttaaagcaaaattccaggccaggcatggtgacatgaacactttgggaggccaaggcaggaggatcacttgaggccaggaggttgagacc

SEQ ID NO: 135343 - DNA, 539 bp, Homo sapiens
tcatccagtgtgtacaaaaactatactgcatagggtgtgcacagtaggcagggtcaaaacctgcaggactttgtagactataggaaaaccttaagctggggaatgacatgatcagatttgcatatttaaaatactactcaggcggcagtgtggaggattgtttggaggaagagaaccacttaagaccattgtttaggcaagagattatagtgacttggattaggataaatggcagcagaaatggagaaagaaagaaagatgggagaaaacttgctgggggtggggactgaattgtattgctgcctttcactgaggtagggatcactggagaatcatgaattttattttgggtcaacggagaagagattatgagtttgattttatacattttgatttgggggtatctatgagataaccaagagtagatggtataagcagttagatatattgatttggagcgctggagaagtctgggctagttttaaaaacttgagccatttagccttagatagtgattgaacccatgaatgaagggtggg

SEQ ID NO: 135344 - DNA, 596 bp, Homo sapiens
gtgcctggatgacagagcaagactctgtcccgaaaaaaaaaagaaaagaaaagaaagaaaagaaaaaaaactgggaaagaaagaagatagggtgtgcacagtaggcagggtcaaaacctgcaggactttgtagactataggaaaaccttaagctggggaatgacatgatcagatttgcatatttaaaatactactcaggcggcagtgtggaggattgtttggaggaagagaaccacttaagaccattgtttaggcaagagattatagtgacttggattaggataaatggcagcagaaatggagaaagaaagaaagatgggagaaaacttgctgggggtggggactgaattgtattgctgcctttcactgaggtagggatcactggagaatcatgaattttattttgggtcaacggagaagagattatgagtttgattttatacattttgatttgggggtatctatgagataaccaagagtagatggtataagcagttagatatattgatttggagcgctggagaagtctgggctagttttaaaaacttgagccatttagccttagatagtgattgaacccatgaatgaagggtggg

SEQ ID NO: 135345 - DNA, 423 bp, Homo sapiens
ctgtctacaagaaacccatttcaaatgtcacgatataactaggttaaaaaaaactagcctaatcccctgtttattagcatcaacaaaacgtctaatattaggcattactgccatctcttctccacccacaattagactgcacaaaaatataagagcctccaaagtaaacaggagacctagtccttgatctccatagtagccagagtttcacttgctccttccattactatacgatgccattttcacttcctcctcatttgtctttgagctttgttgcattgggtaggaagagaaacgttctttttttttttggagatggagtttccctcttgttgcccaggctggagtgcaatgggcacaatctcggctcactgcagcctccacctccggggttcaaagcaattctcctgcctcagcctcccg

SEQ ID NO: 135346 - DNA, 699 bp, Homo sapiens
gatgtatgttgtgaaagagaagaatcaaggctgactcgaaggcgcttgacctgagtcactggaaggatggagtctctattaattgaaaaaaggaagactctgagtggagagactttgggaggtgataaggagtttctctttggccatccccctgaaggggcaattggatttacaaatctggggtttcagacaaatctggagcattgtgtttatttttaaaatctgggctggagatgaaaattttgaaatccttagcatgttgatggaatttaaaactaggagactgaatgagatcaccaaagtaccagtgtacataagaaaagaacatcttagggtgtaagggtgggaaaaacaaacaaacaaaaaaaaacaaaaccctttttgggccccttgggcccccggaaaaggttttataaagcccaatcgttggggccgcgcggggccacaagagggtaacgggacacctggggcacaaagcggtggtgccaaaggagagaaccggggcacaagagcaaaggggaggggagttctccccgcgcagtagaaaaaaagggcccggggggataacacgagagggcttctgtgggaacaatattccgcaatggtggagtcactgcaggagggcacaataacgggggagctctcttacaccgggggggagttccagaggggaacgctgagagtattctaatttatggc

SEQ ID NO: 135347 - DNA, 155 bp, Homo sapiens
accccttccgactagcaaacacagaaatgtgattctttctgtatcagaggaagatggagtgacctctggtggcctaagaaaagccaccaccatgcccataccatgtggagagctaggaagggaggtctctactgtcttgtcctgtcttagtgggt

SEQ ID NO: 135348 - DNA, 411 bp, Homo sapiens
ggatagctgttctgaggtcaacgggggcactggaaagagggagagggcaacatgactgtgcatcgtgtgtaaaccatgggtggtctctggagacctcctaaataccccgaaaaaggcaaaagggggtctgtgtatgtagatatgtgtgtgtctgcacacatttgccatgggggtgcatttgttcacaggaaaagactcctaggtttcctctgactcccagagacccccaagatgcacaggggagagaactatggcatcattctctccagccactgggagaggaagttgttagctcagcaagttgtccagcaccctgctttgactggaatgaaagcctttcctttggcagccaagaccctccctattttcctccccactgatgctgcagtgcgggccagaaatacagcctct

SEQ ID NO: 135349 - DNA, 807 bp, Homo sapiens
gttctgcactttatgtcttcccccaacgctttgtgcaactgacgtcatattttgtttcttggtatgttatgtttttatgaacaaatttctgtggttatagttattcttactatcttttcttttaatttacattcttgtgttaaatgagatttacacactgccactacagtagcacaatattctgtgtttatatttacctttagtagtgagttttatattttcatattctttttgtgttctttagcatcttttcatttccacttgaagaattcccttgagtacttcttgtaaggcaggtctaatggtggtgcactaccttagtttttttgtggggctcgggggacagggtttcactctgtcacccaggctggagtgcagtggtgcaatcatgggttcactgcagccttgacctcctaggctcaagtgatcctcccaccttagcctcccaagtataataactgagactacatgtctatgccaccatgcctgacttttaaattttttgtagagatggggtctctccatgttgctcaggctggtctcgaactcttgtgctcaagtgatctgcccacttcagcttccttaactcagtttttatttgggaaagtctttatatctttttcattcttaaagaacagttttggttttttgcttaggattgccttcttcattcaggctcttttttgtttgcatatgaattttaaagtagttttttctgattctgtgaagaatgtcactggtagtttgatagaaataacattgaatctataaattgctttgggcagtatgtccatttaaaaaatattg

SEQ ID NO: 135350 - DNA, 137 bp, Homo sapiens
gggacgtgcttccagatggcccctctcctgactctgttacctggaaacagagtgggtgagaaagacccttgtcttctttgggcctcctctataaaatgaagcagccaggccacacaagctctggcggcttaccagca

SEQ ID NO: 135351 - DNA, 869 bp, Homo sapiens
caaaaagaggcctattatctttgtctacacaaataggtcttattgaatgttttcacctcggctagatcactactcttggcaagatttttgtttagtactattcaggaatctatttagttcaccaaaagtgatcaacttctaacttaaacattcaaataacagcataaaagaactgatatgtcaaaaaacaagtttcaatgaactatatgggtgtatagtagtcagattattactttcctttataagaaagtctgcaaatgaaaaaaaaaataattttaatgccaatgcaataactgaattaaattagtacaaactgagtatattatttaataagtataccaataagaagctggcagaatattttaagaaaccaaatgaccttgtctacttccaagtttctttataatagtattctttgtttgttttcctggagtaacttaacatttactgtaaggagaaatcctgttaaaatagtgtcttttagttatgtataaaatcccaatagtatcagaattgatccttaacttgtaggatgtagttcctatacagttcacaagctcaaagctttgttgttctctgtcgtcacatgactatcatgtgttcaacataagttttctacaaacatgcaaataaatacattaaaaactagtatataaacttatttcacttaaaaatatttatacaacatttatattgattcaacactaattgagatatcatgccaattcaaaattagcctgttcacactgaacatctgaattattcacattttaataatactaaaagggctgtctttaagttaaaaaaaatacacacaaaactctactgtgttttacatattaaaatacaggatgaatgataaaaatatt

SEQ ID NO: 135352 - DNA, 537 bp, Homo sapiens
ataaaggtgggaaaaggaagaaagctaaaatgatttcgcaaatgctctacagcatctgagttatgaagagaggcatttcaacaggaaaaggaggccacaatgtttagttaagtggtaaagaagactcactgaaacttaaggaaaaaccaaagagtatttccatggttattttcaaatatttgttctctcatcagttctactctgggcaaatatataatgcagaatttcactttttaaagatcacattattgaaactattctgctaagcaatgacttcttgatttacggtaggactcaccaagattttaaataaagcaataaaaacagatttgctctaatggctttagtgttatacactgtggttgatagtgtaatgttttattaagattgataaacattaagcattgtgtatttgaatcaaccactaatccaaaccagtaagcatctgttaccattcgtgattgtctgttatgtgaaaagcaacattattgcagagctaagagtatcttgagcagtaattgaaatagtagcctttgc

SEQ ID NO: 135353 - DNA, 111 bp, Homo sapiens
tttagtcttttctaaactttcatgatctttacatttttgaaaatttcaggccagttattttgtagaatgttcctcagttttgagttggtctgctatttcttcatgattaga

SEQ ID NO: 135354 - DNA, 465 bp, Homo sapiens
tacagaagcagccaattggccaagaccctcaattcatttaagcatttgctcaaacgtctccacttcagagagaccttccctaactgcccattttctggaagtggactctcctcacctctctccggagcacttatctctacctcattaatttttattcatttgtttacatatgtttattttctgtctcttcccactaaaatataagctttatgaaagcagacatttggtttgatttgttcacagatatgtctccaggaccttcagaacacacctaaaataagatggaggctcagtgagtgactgattgaataaataaaagcaagtgggtactttaaaatctaaataataatttcagattacctaatatttaatattttactattttctgttatcttttctaaggaacatactcacctcttaaattttcccatttagaatataacccttttcacccacatttccata

SEQ ID NO: 135355 - DNA, 383 bp, Homo sapiens
ttcatatttttaatgtctgtttcattgactacaattgccagtcagccagaattaagacaaataagcaattcacacccactgtgtctacctgctagtgagtactgacaagtaatttataaagtataatgtatgtctcaataaactggcatctgatccaatagatatatatgtcttgagaaaaagcattcaagaaaattttcatatatcttcattaggtcgagagaacagctttaaacacaatattaaaattctcaacaggccaggcacagtggctcacgcctgtaatcccaacattttggtaggccgaggtgggtggatcacttgagggcaagggttcatgactagcctggccaacttggagaaactcagtctctactaaaaat

SEQ ID NO: 135356 - DNA, 218 bp, Homo sapiens
ctcatcctcagctcatcctccactcatcccctgctcattctcagctcatcttcagctcagctcatccccagttcatccccagctcatcctcagctccgctcatcctcggctcagctcatccttagctcatcctcagctcatccccagctcatccccagcttattcccagctcatccccagctcatccccagctcatcctcagctcatccccagctcat

SEQ ID NO: 135357 - DNA, 137 bp, Homo sapiens
taatggacacagtggatctttttaactgtccagccatcctctgggtccatttggaagtcttataagtcatcttcctacagatctggcacatatttgttacatttattcccagacatttcactccatgcatggccaag

SEQ ID NO: 135358 - DNA, 282 bp, Homo sapiens
gattgtccacgttcagcgagcacagctgtgagccatggatcagtatccttcagaatttcagagttttaagaaacgcagtttccattcctactggttgctatgggattattatgaagacgagcaggccagtgcttgtctgtttcaaacgaggggcactgagcaaccctccccggactctggtggctcgacgaggctgctgtggcaacaggagctggcctgggtggccctgactctccacttcctctgtggtcagggctgaccctccttaaccctattttccaa

SEQ ID NO: 135359 - DNA, 498 bp, Homo sapiens
ggttagcattggctctccctgggagctcttgagaaatgcagaatcttaggccttaccctagatatattgaatcagaatctgtgttttaacaagatccgcagaagtactgatttttttgtgcagtccatattcagattcagattctcacagttgttctagtgataccctttatggtttttctttctctttttaaaaatcaggaatcaataaaagatcacatattgcattcgattgtcgtatgtctttagccttcacttccagctttcccacttgggacagtggcatttttgtatagtttaggccagttttgtagatgttctccattttggatttgtcaaataggtgtgatgatgtttttttgttgggtttttgagatcgagtctcgctctgtcacccaggctagagtgcagtggtgcgatctcggctcacctcgacctctgcctcccaggttcaagtgattctcatgcctcagcttcccaagtactgggactacaggtg

SEQ ID NO: 135360 - DNA, 683 bp, Homo sapiens
gggtttcttttaactggtgaaaactgtatttattttgtttgaccagactgtctaacttaaatgaaagcaatggataatggaaaggaaactgaacaaagacaaaagtcttcttcatcatagtgaaaggcatttaatcaggaagagttggaatcctggaagtttttctttttttcaggtacaagaggcatgatttttttctcttcctaaaatgtccttccccttatctgtgtacttattagttcaaggaataacaaatgagtcttaattgaacttagtctttggaaattgagctctttatttaggttatatgtgaaagagtttaaaatattgaaatactttggttgctaagcagatttagaaaagcaacaagcaattgtcgggcaaatccctaggtttgagaagatgtcctcagcaaaatatacccttaggacttacggaattagatcagggttcagcaaacagtagtttccaggccaaatgctgaggctacttgcttgtgtaaagaaaattataatggaatagggccacacttacttgtttaggtattgtttatgccttctttctactacaatggcaaagttgagtacttgtgacaaagatcacgtggctacaaagcttgaaaatatttactgtctggtacttgttagaaaaaatttgccaactccaagaaagaattacctcct

SEQ ID NO: 135361 - DNA, 845 bp, Homo sapiens
tagggattcatcactgcacaaaacaggcaaaattcttgccctaaaggagttttcattcctgtggaagaacagacagtaaacaagttaagtaagtaacatatgtggtatgttagtgatacatgccaaatagaaaaataaggcaaggaaaagggttaggatgtttgtgtgcaatgttgccattttaacttgggcaagcagagacagcttttagtaggaaagtgatatttgaatagaaacttgaaaaagggagggggttctcttaccactcctgttcagtgtagtattggaagccctagccagagcaatcaggcaagagaaagaaataatgggcatccagatgggaagagaggaagagcaactgcttgatataaagggaagagaatatggcatatggatattgctgggttttttgtctttcaagagacagattcttgcttgtcacccaggctggagtgcagtggcacaatcataattcactgcagctgggctcaaaggatactccagcctcagcctcccaagtagctggggctgcatgcacgcaccatcacacccggctaatttttaaatttttttgtacaaatagggtctcactatgtttcccaggctggtctccaactcctggcctcaagcaattctcccatctcagtgttgcaaagcattgggattataaatatgagccactgtgcccagccaatattgctgttttttttgtttttgttttttactaagatgggaaaaactgttagagaagaaagtctggaagggaatatttagaattcagttttagactttaattttgagatgcctatattgaatgtctgtaagttaatatgttgagttgaatg

SEQ ID NO: 135362 - DNA, 500 bp, Homo sapiens
gagtcatcatcagctaagaggattcaaggtttcctttcacagatctttagaagtcttttctgaaataaattctgagaagatttagctcaactctgatcaattaattttgccaccgattttgtgagcacctgctcttgagcgtgtgaggctgagaatcaaggttaatgaggtttgtgagttttgttttgttttgttttttcaaaataagctaaaatgataaaaggttttattccaagactcaagtgagtatcatcaacgtgatgtcatttccaggaaaagttcaatatattaaattctcctaatattttagttcctcctaaaagcatgttagacactgtataaaatcacattgaaagacaccaagaacaataagtttctatcaactaaaggtcttcctgtggatgcactcccagtaatgcaaaagagtttagatagttttcaaaactgactctgaaagtacaagttgtgcaccagaagaatatgagtctgtatttgcttaa

SEQ ID NO: 135363 - DNA, 215 bp, Homo sapiens
aatcatgggaacttcttcaaggccagcaagagaatctctgatctcagggaaggccttaagcgcttttttaaaggtctcacctgattagatcaggccacctacccaccagggtgatctcccttttgattaacccaaagccaaactgatgaggtaccttcattacccctgcaaaatcccttcacctttgccgtgcattgtagtccaatcacaggggt

SEQ ID NO: 135364 - DNA, 275 bp, Homo sapiens
gtgagaccctgtctctaaaaaaagaaagaaagaaagaaaaagacatgtccagaagaatacctaagagaccattaattgttaactgtggatacgtctggggaaaatgggaatgggatatggaagaagaatatttttacttttttattttatatttttgcgtgctgtttgaataattcagtctgtgaatatgttacttttattttaaaagtaaatcattgtttaagacaaggaaaggtgtttttccttaagatacctgaactctgttatctgtattt

SEQ ID NO: 135365 - DNA, 312 bp, Homo sapiens
cggagagacagcagcctgcagcctgagctccaaagtgagcaatcaatcagcctccagaggagccccagtgccttcgtctcctggggttgccacaacaaagcaccgtcaaccaggtggctggaacaatggacattcattgtcttatagatctggaggccagaagttccagatccaggtgttggcaaggctggttcctctggaggctgcaagggagactgttccaagcccctcccctggcttctggtggttgctgacaatctggcgttcctaggctcgtagaagcctcaccccatctctgcctcttgccttcac

SEQ ID NO: 135366 - DNA, 336 bp, Homo sapiens
atccagcccccttaaacgcacaggctcttctggcctcaggggctttgcagacctccaatgcaggagcagaaattcccctcttccttgttaatggaatttgatcttgttgaggtatccaccctctccccacagccacgtgctctggggagtgggtcatgcctggctaagacccctgcccttgattggcttaggtatcagcacatcatgcaacactggcccgagagacatgagtggatgtttgctgggggcttgtgggaaaagatttccttactgtacatgcgtgtgcacgcacacacacacacccttcttctatagggcctttgcgtgtttggctgt

SEQ ID NO: 135367 - DNA, 351 bp, Homo sapiens
gttaatctctcactgtacctaatttataaattcaattttccttttcttccctattctttacaaaatgaattgcaactataaaaattaatgtttatcatagtgagaaaggaaaggtagctcatagcaacctgtgctatgtgaagcaggcaaaattgatcaggctcagcgagaagtcagcatggaacggttagggcccatgcctggaggcaactgcttaaaggcattttgtacctgactagggtgctgcttcacccattatcttcatgtgcctaatatctgtgagacaaagaacaatgtatagcagatcaatagcttgttattctaatgtaaactggtaaacaatttaggaac

SEQ ID NO: 135368 - DNA, 210 bp, Homo sapiens
gtgtggagaagacagaaactgtcttctaaggttggtgctgtttctgtctcagacacaagaaccaaaagggcagatagaaaaacaagcagggctggggacggtggctcacgcctgtaatcccagcactttgggaggccaaggtgggagggtctcttgaacccaggagtttgagatcagcctgggcaacatggcaaaaccctgtctctaccc

SEQ ID NO: 135369 - DNA, 245 bp, Homo sapiens
gacagccttctctcatcagccccttcaggacttgcctcagttgcagagagctgccttccccaagatcacacccttccctggggactcacaaccaatggctgatccagaagaatccataaagcccgtatcatttcagcccaatttaggacagctttgttgagccattagacctacatgcagcccaacctctccttctacccacttcttctttcttccctttccttccacggtgtctgttccaagca

SEQ ID NO: 135370 - DNA, 343 bp, Homo sapiens
ctcttgtgtctgggataggaaaggagatcagaaacctgtgaagattgcaaactcctgactccataagaatgaggtggaaggtctgaggacagagagctgtagatgccctactcaattttaaagaccttagtaaacaagaaaaaataaaattaaatactatatgtgtattccatgggaaattatttttattgtttcttttggtggggagaacaccactatatgcagttttaggaggaaaagataagaaacatgaattctcagaagcaggtttcaacccccacagctcaagggttacattaaaaaagagaaatgaactgctgctgaaattagaagcaagagaacc

SEQ ID NO: 135371 - DNA, 702 bp, Homo sapiens
ttaaaagtatatttgatggggaaatatttaatatttttttctatgattgtgaataaagcaaagatgtccactctgaccacttctattcaatattatactatagctcctaaccaatgtaataaaagaggtaaaggaaataaaaggcacagaggttggaaaggaagaagaaaactcacagatacaatatgtgtacacagaaaatcctaagtaatgtataaaaagctaccagaactgatacgtgaatttagcacagaatataaagtcaatatacaaaaagcagctgtggccagttacagtggctcaagcctgtaatcccagcactttgggaggccgaggtgggtagaacccttgaacttgggagtttgagaccagcctggtcaatatggcgaaaccccatctctacaaaaaaatacaaaaattagccaggcatggtggtgcacacctgtaatcccagctactcagctaagtcaggaggatatcttgagcctggggaggtagaggctgcagtgagccgtgatcacaccactgcacttcagcctgggtaacagagtgagactctatgtctccaaaaaaaaaaacgcaattgtatttctatatactggcaatacataattggaaaatgtaaataaataacatatctaggaataaatttaacagaagatgtgttaagacctgtagagcaaaaactataaagcactattg

SEQ ID NO: 135372 - DNA, 362 bp, Homo sapiens
tgttcctttagggaatgaagacattgcaatattcctgcttcggcatggggcctatttctgttcctacatcttgctggatagtcctgaccccagcaaacatctgctgagaaagtacttcattgaagccagtcccttgcccagcagttatccgggaaaaacagctctccgtgtgaaatggtcccatctcagactgccctgggtagacctagactggctcatagacatctcctgccagatcacggagctcgacctttctgccaactgcctggcgaccctcccctcggttatcccctggggcctcatcaatctccggaagctgaacctctccgacaaccacctgggggagctgcctggcgtgcagt

SEQ ID NO: 135373 - DNA, 383 bp, Homo sapiens
tttcccacctatgccacaccaacagcatcctccgtgatagcacccctatctttgcaaaacaactggtagatcctctccacttacagtttttgatttgtataaccctcggatgaattcagccaactgcaaaaataaaagcagccgaacaaacaacagcaaagccaaagcaaaacaaaacaaaaagaaccttataaaagcgctgctgttgagcacactgagaacaacttggagcttgacctcgccacttgggggcgccctgggagctcagaaatgcaagctccgtccagccccgggagcccgggctgactcagggcagccccttccttctgactacacggtttctgtattcaactaaccacacgggaaatgagactgccttttag

SEQ ID NO: 135374 - DNA, 160 bp, Homo sapiens
cgtaagcacaagtcattccaggactccttctccctagaaatctataatgatcacactcccctaaatataatggataaaatgtctcctcttctagaattttatttgaataagcggacagtctcaaaattagcatactatatcaggagatgggagacttcta

SEQ ID NO: 135375 - DNA, 734 bp, Homo sapiens
gggcatgaggctatgttttgtaagcctttgtattttagctatgccagagacctggagtatttattatctgagctgctcatgttacccccaaaaaggtggaatcttggcagatctccattctttttcttgatgactaaaacccaagttaggtgttgacagaagtccagaagatctcagtgtgaagccgaactatgatatctggtactttcacatttacatgggttacactcccagctattttaagtacgagggatgatatagtttcttattagtatttttttccaccatgcatggtgaaaaactcatcctgaatcactttggaaggaatggaaagtttgagataacagaagtgccattcactctgaaatgttagacacccagactaccatttaaaaaaaatatagccatttaccaactcttatttgtgcagttggtggcacttccaatagattgttaagaatttctttttgctggtggaacggactggttgggggcagttcttgtagattcaacctatcagttcctttcatttatgataaagcagttgtgctgtacccataaagggccgttggaagtttctggatagatgtttttgtttggtctcatagcctatttggcaggagtaaagtagtctttctccttgtgtcccatccaacatgttgcattcagtatcagaaggactcttcagacctctgggaaggctgattggaggtgagaaatggaatgcgaatttt

SEQ ID NO: 135376 - DNA, 142 bp, Homo sapiens
tgaagccagggactgctatgctttggcatcaaggtttgcggtatctttacaaactgtgttacatgtattatttgaacaaaattggcaagtaaaggtaaaattaaaggggttatagagagagcacagatgaagtataataaag

SEQ ID NO: 135377 - DNA, 581 bp, Homo sapiens
atagactgagatccaatgtttaaatctttttatttcagtttgatctgtgcctttagattggggacaaaattttaaaaacaaatcttccaaatgacaccacaatgaaagccagttgtggtcttgaaaaatctctctattgcattacttatcctcacccttgttttttaagaggtagagagagattactgggaagcagtgagccaacataattgtcctttcctctacagaatagctgtgcagaaggggaccaccacacttaggaccagtgccaggtgacaatctttccgtcatgctgctgcagcattttgcaccttgagagacaggaaaaaaaatgggggtgagggagtggaagatgatgaaactatttctcttttatgtctacatccttactcctcaaaatactttaagctcactcagaccccatataccctgcccacaatactaacacatgtactttgcataagtaaattgttgattaaataagagcaaaactatattcttatgtgtagattaaccaaggctaatttcctggagtttaatacactttggattcaagtaaaaacaatcacttaatgcagcaa

SEQ ID NO: 135378 - DNA, 476 bp, Homo sapiens
tcagccaggctaggagagcctcctcacccccgccctaagccagacacaatggggttcccaggaggacactgtgcaaacttaggctctgcatatacaactgagggaggatggccacatatctgttatagcaggaaaagcaaaagatgcttactatctggctgacccagacttcaaaacgcaaagtcccccacactgccctgggctcgttatctgtccctttgccaacagtggttcaaggccacctgagatagtctcggcccccatccactttttcagtgcctggaacaaaacacagtctgcttccaaaactacctgtggctctttaaaattgtcaccataaaattatgcaattccctgatcactttaatattgaagcaatagtgttttgttttgtttttttcaattccaaattagtcgataaaagcatcaaacattccctgaaggaaaccatcaaatattcaaaatcagggccaccg

SEQ ID NO: 135379 - DNA, 183 bp, Homo sapiens
atgatttgactttgagacttactgtaaagtcactacaatgtaaatcctcaaattatattagtgtttttcaaagtagatttgacttttctaggctctttgcattttcataagaattttaggctgggcacagtggctcacacctgtaatcccagcaatttgggaggccgaggtgggtggatcacc

SEQ ID NO: 135380 - DNA, 122 bp, Homo sapiens
tttccagcctctactttggggaagggctggacccacatttcctgggtggaaaaggttctcggtgtttgggaagcagcttcgcaggagctgcaaggagctgcagagaaaggcagatctgggag

SEQ ID NO: 135381 - DNA, 679 bp, Homo sapiens
ttagaggcttttcttaatgtattcacctggtgtgttcagttatttctgaagatatagaaatgtttgatgaaatgaatgaagatacagaatgtagattcagtatcaagctctatctcataacagtaacattcctactacatgcaaaccctatacatactattatttaataccttttttcaccctactatcatcaatggctccattttatagatgaagaaattcaggattacagcagttaagtattttgtccagctaggtcgtacagccagtaagtattctgcccaggtcatacaaccagtatcagatttgtgattaatcgcattactgtcaagtcctcatgcaggccagtcagacttctgtgtgtgttccctcaccttccatttaagtttcagcctttatctatgtccttttgggtgtctgccatgctgatgatagagctcatcagtctttgataaatactgttaggtccttaagtgattttctgtgaaatcttacgcataggatttctgtggtcagggtttgacgtctgatcttgttcgtcagctccccttgctcaagaatgcaagtgcattacctcttaaattttaaaagctggtaaacttaataggaagtgcttctttatattgcaggtgctaaacttaaggagcccattaattacccccaaggagattgtagtctt

SEQ ID NO: 135382 - DNA, 144 bp, Homo sapiens
acattttccatgtacctttgtgtgttagctagaacataagaagatctcaagttattaggatttctgagctgcttcttgactaaataaaacataaaaatcatgggcagctggcaccatcaactccaggagggcctaagatgtcag

SEQ ID NO: 135383 - DNA, 576 bp, Homo sapiens
ccaatataacagatatgaggtgatatatctcattgttgttttaatttgcatttatttgatgatttgaaataataaggtttttttcatatatctgttggtcatttgtgtgtcttcttttaagaaatctctattcaagtcttttgcccattatttaatagggttatttgttttcttgttattgagaagttagagtcccttgaatattttggatattcaccctttatctaatataacatttccaaatatttttctcttcattcttggattgtctcttcattctactaattgttctctttgctgtatagaagctttttttagtttgatgcaaccctatttgtctgttttttctttctttgccaatgcttttgaaaacatattcacaaaatccctgaccagaccagtgtcatggtgtttttcccctagatttttcttctagtagttttatagtttcaagtcttaaatttaggtctttaatacattgtgggttgattcttacataaaaggggagattttcattcttctctatgtgaatatttagttttcccaacatcatttattaaaagtaatgtccttttc

SEQ ID NO: 135384 - DNA, 343 bp, Homo sapiens
actctgacgagttctcttaatcatggctcagttccgaaaaccaacaaaatagaagaaatcttttctaccgaccttgtgccaggagatgtcatggtcattccattaaatgggacaataatgccttgtgatgctgtgcttattaatggtacctgcattgtaaacgaaagcatgttaacaggagaaagtgttccagtgacaaagactaatttgccaaatccttcagtggatgtgaaaggaataggagatgaattatataatccagaaacacataaacgacatactttgttttgtgggacaactgttattcagactcgtttctacactggagaactcgtcaaagcca

SEQ ID NO: 135385 - DNA, 835 bp, Homo sapiens
aattgtatctgtgtaatgttaaaacaaacgaaataaaatagaaggaaaaactttctgagtttcaaaaacaacagactagtactctaaagaactctttaaaacaattaactgttaggattgcagttatgattggatattatttaattctgtttctgatgtggggttcctccactgtgttctgtgtgctattaatatttaccattgcagaagcttcattcagtgttgaaaatgaatgcttagtggatctgtgcctcttatgcatatgttacaaattatctggagttcctaatcaatgcagagttcccctcccctccgattgttctaaataattgaaagatgtctgctgtggaaaaaggcatgtatttaaatctgtatgattctcaaccatctttagttgggaaaggtccttgaaagccaatggaaatactttttttttttcttggcactaatcaagtgagtgttaccttttcacttagtaggatgtgttgttacgctagtaaaatagaaacctgtgtttattctcaggtattttagaaacaacagccatcattttattttatgtgtgtgttcttggctgtattcataaattatatattttgggctatcaaatattacttcattcaatataaataacaatagtagaagttgtttacttagatatgctttctagttgcattttctcagcctatgtaagactactttgttgtaatagcctttgaaatttacagtactgtctctctactatcttcagattacttgattcaaataaaccaattatgtttgtaattgatattaataaaaccagaataaaagttcatatctacccaaaaaaaaa

SEQ ID NO: 135386 - DNA, 436 bp, Homo sapiens
cttcagagtaactgatgtcatcgaaggaacagaggtccagtttcaggttcgggctgaaaatgaagctggagttggccacccaagtgaacccacagaaatcctatccattgaagatccaacaagtcctccctcaccaccccttgacctacatgtgactgatgctgggagaaaacacattgccattgcttggaagcctccagagaaaaatggtggaagtcctatcataggataccatgttgaaatgtgtccagtaggcactgagaaatggatgagagttaattctcgcccaataaaggacttgaaattcaaggttgaagaaggtgttgttcctgacaaagaatatgtcctgagagtgagagcagtcaatgctattggtgtcagcgagccatctgaaatctctgaaaatgtggtgccaaagacccagactgtaagagca

SEQ ID NO: 135387 - DNA, 516 bp, Homo sapiens
cttcagagtaactgatgtcatcgaaggaacagaggtccagtttcaggttcgggctgaaaatgaagctggagttggccacccaagtgaacccacagaaatcctatccattgaagatccaacaagtaagtagtgctgattatacacaagatattgtctagaacttgatgagactgtggatatgaatatttcactcttttctcaggtcctccctcaccaccccttgacctacatgtgactgatgctgggagaaaacacattgccattgcttggaagcctccagagaaaaatggtggaagtcctatcataggataccatgttgaaatgtgtccagtaggcactgagaaatggatgagagttaattctcgcccaataaaggacttgaaattcaaggttgaagaaggtgttgttcctgacaaagaatatgtcctgagagtgagagcagtcaatgctattggtgtcagcgagccatctgaaatctctgaaaatgtggtgccaaagacccagactgtaagagca

SEQ ID NO: 135388 - DNA, 310 bp, Homo sapiens
atagaatcctgtgcatccctgattctattcttccccaaaggaaaatggccagcgtgaccctcaccttataaaccctcgggtaaattagagggcgcctctaggctcactgttctgagaaagctctccagctatcaggcagccttgtcagtcacgtgcgctccattgcctaggagatgaaattatattgaaaagcattcatgtctgttttccacgaaactggcaaatacatggtttattatcataagcagcatattcccatatgacaattggtgtgtatagtgtaagaatgttctagagtctccatgccaaa

SEQ ID NO: 135389 - DNA, 794 bp, Homo sapiens
caccatgccaggccaaaatgataaattttttttttcacatgtgcagaacatgcagctttggtacataggcatatgtgtaccacagtggtttgctgcacccaaagtgataaattttatgttatgtatattttaccatgacaaaacaaaatctgtaacatcttttcatttaaaacaacttgtttactaatgcttaaacaccaatacattgaagatataaaaaattacccagagatttgccccactggaccttccatggcagaaggaggtatttataatgaatacaaagtagaaactaatacatttattatgaataaaataacatttcagaggaaggaacaattccttttggtcaaaagattgtggaagccatagaggagatggcatttgaattgagccatgatgcttaaaatagctgagaggtggaaacaactccaatgcccattgacaaatgaatggataaagaaaatgtggtacatacatacaaatggaatattgttcagccttaaaaagaaggaaatcttgtcacatgctacaacataggtgaatctcaaggacattatggtaactgaaataagccagtcacaaaaagacaaatactgtatgattctagttatatgtggtatccagagtagtcaaactcatggaaacagaaaacagaacagtggttgcccagggctgggaggggggaaaatgttgctcaatgagtacagggtttcagtgaggcgagatgaaaatattctaaagatctactccctcagactgggacattcctcacttctggactgcttcccccg

SEQ ID NO: 135390 - DNA, 346 bp, Homo sapiens
acctggcgtgaggtctcctggccacggacgttgttggcgtcacacctgtggcacctgaggtgaattgttcagatggaaacggcaccatcaggcaactggcaacagaagcctaaagccctgggtgcctcaggtcagaggaaggaaggaatgcaagggccccgctccccccaatgccaggagcgtgtgttcacagctttagacaggacaacccactgcaaatccaaagcagaaaacatggtccaactccatctctgtggcaccttcatagatggtgcccacctgccttggcagtgatgaccgacactgcgaacgctgtgctggcagtgtgtttaagggctttaactga

SEQ ID NO: 135391 - DNA, 171 bp, Homo sapiens
attaaagaagggatcccagacgggatgcggggaaactgtcactaacattcaatactggaccacatccttaaaaatagatttctctgagtggtagtccaattctacttctggtcaccaaacgttcaaatcatgcgtctggaatctgttggactatgccttgactattctcca

SEQ ID NO: 135392 - DNA, 625 bp, Homo sapiens
ctaagtccgtgaaaccagaaaaattctagaagataaatcagaaaaactcttctagacattgtcttaggcaaagagatcatgaccaagaatccaaaagcaaataaaacaaaaactaagataaatacatgggacctaattaaacaaaaagtcttctgtacagcaaaggaaataatcagcagagtaaacagacaagtcatagagtaggagaaaatattcacagactatgcatccagcaatggactaatatccaaaatcttcaagaactcaaacatatcagcaagaaaaaaaaacaactaatcccatccaaaagtgggctaaggacatgaatagacaattctcaaaagaagatatccatatggccaacaaacatgaaaaaatcctcaacatcactaattctcagaggaatgcaaaccaaaaccacaatgagatgccccataccttactcctgcaagaatgaccataattcagaaataaaaaaataacagatgttggcatggatgtagtaaaaaagaacacttttatactgctggtgggaatcccacttactgggtatctacccagaggtaaaggagtcattatatgaaaaagacacttgtgcaggcatgtttatagccacacaatccac

SEQ ID NO: 135393 - DNA, 159 bp, Homo sapiens
aagatcttctagcaacaaaaatgatttatcaagagaaatatgatgcaagatagataaaataattgcaggaacaaagaccagggtcttttgaaaagccacaaggagacaggatccagtggacaggtagaggggcttgccttttagagaagcagggattat

SEQ ID NO: 135394 - DNA, 470 bp, Homo sapiens
attctagagtgatcccgcacccaggcgcacttctggtggaaggaacagcaagtgctggcctgagctgagatcatacttagtgtgttcaaaaagcaaaaggaaagcctagtgtggcaggtggggagtgggtgaaggagagtggtaggtgatgtgaccaaagaggtggtggctggggctggattatgaaggcatctatataccgtggtaaggatgttggcctttacttgacatgagatcagaatccagtggaagatttggagcacaagaattgcacaatctgacctattttttaaaaagattactctggctgatgtggtgagctgagttagtaaggaagtgggcaagcgtggaagcagggagactagttgggaggatattgtggtaattcagagggaaaagagatacatgtgggccaagctagcagcagaggagatggggaatcctggattgatgttgatagtatagttcag

SEQ ID NO: 135395 - DNA, 343 bp, Homo sapiens
cgcctgcctctcctgcctcacccagatggctctaccctttgcccacctcacttcagccacagtggcctcacctaagtgcctccacatttggtatctattcattctctagccagtgcacctcagaatgcctggaattcagctgggcatggtggcccattcctgtaattccagcactttgtgaggccaaggtgggtggatcacttgaggtcaggagttcgagaccagcctgaccaacatggggaacccccgtctctaccgaaaatacaaaaattagttgggcatagtggtgcgtgcctgtaatcccagccactctggaggccgaggtaggagaattgcttgaacc

SEQ ID NO: 135396 - DNA, 324 bp, Homo sapiens
tacaggatggatctatcttagcataataacatgtagcaaaggccctgggtgccaaacacagcagcagtcacaggttccaggtgggcatattatgggagaccaccattcaacctactacaggcatcttgtgtaggcaccctgcctgcagctctcagtattctctgcatttaccgtgtgctttggatttggagttgaccagaaatatctcctcacctccactgcagcctgttctccaacctctaaatcggtgttggcagtggaaaaccactggaccagtaaaaataattgcgtttctggcctggctgtggcctcatgcagaaggca

SEQ ID NO: 135397 - DNA, 652 bp, Homo sapiens
aaacacttttctcttgtttccttggaccaagtgatgaagaggtggtgaggggacagcaaaaaatgcaattacatttcttctctttatttttattttttgagacaagagttttgctcttgttgcccagggtggagtgcaattgtgcgatctcggctcaccgcaacctccacttcccaggttcaagcgattctcctgcctcagcctcctgagtagctgggattacaggcatgcaccaccacatctggctaattttgtatttttagtagagacggggtttctccatgttggtcaggctggtcttcaactcttgacctcagatgatctgcccgcctcggcctcccaaagtgctaggattacaggtgtgagccaccactcacagccccctcttctctttctctgatcactccaatactcgttctaattgggaggaatggatttaactaatctttggtttttatctctgtgtagaaactgatttcttggcagaatggactgttaatatatttaaaaagactgaaaacctcttagaatcttaagtagtaaaatattcagagcgaagaagtagagattttacctttacaatatggtgacaacagataactgtaaaaacttctttttcaaatagaaccagcaggagcatgcatggaacaca

SEQ ID NO: 135398 - DNA, 484 bp, Homo sapiens
gatgatctgcccacctcagcttcccaaagtgctaggattataggcgtgagccattgagcccgggctcaatttttaaggaactgatgttatacagaaaatgttctctattataagattgtcagttcaaaaacaatgttcaaaagttcaaaatttaaaaatactagaaatctatactaataaatcttatgtatttctaaaactaaagaacgcccttctataaacctcataggccaaaaagagaagtcatactaaaattagaaaatatttacacctatattataaatactcctttgggatgccgtcaaagaaaaattcataacttaaatgcatatattaaaatttggaaaggcaaaaattaacaaaacagcacattttagaacttgaaacaactggagaattatctgggacaagacagataaatttatgaactaaacataaaaatagatcagattgacaaacccaaaagttagctccttgaaaggac

SEQ ID NO: 135399 - DNA, 413 bp, Homo sapiens
ggtaaaaataagaatgattcaggttgaacattaaaaaaatcttcttggtcattcaggttcctacttaaaacaggtacaactgatttgaataagaaaaaattgaaggtgtgggcatgtctaacatcctaattgcattttgctttttctatccctggtttgaattctttgttataatacatttttatgcattatctggggaaatgatagggaactagtgaaaaagaagactatggaaaatatagctatcaaaaacttggctgggactgcaggcgcccgccaccatgcccagctagtttttttgtatttttggtggagacggggtttcgccgtgttggccaggatcacttgaggccaggagttcaggaccagactgagcaacatagttgagacctcatctctatttaaaaaaaaaa

SEQ ID NO: 135400 - DNA, 421 bp, Homo sapiens
ccccaatgcaaggcaaggttgctgggttctgtgcagggccccagcaggttctcaggaggggaagaggcatcactgaaaatgacagtgaccactgaaggcgtctgtccaggtggcatccaggcccctgcagggttggctacaagccacagctggtttccccctcccgtctagagtaatggcccacaggctgtgtttcccaagggctcctcctgcaggatcctggcatttatatctgcaggaggactctgagacccatggagacctgtgctgagaaacagccacccttgtccccagggcagagaagtacccgggggaccctctggctgtctgcctgcagatcagcatgcagccccccagggtgcctttgggtctaaaaaggtgtgttctattcctttgaactggaccttttgagaagagcaag

SEQ ID NO: 135401 - DNA, 269 bp, Homo sapiens
ttaattcactatctatatgaattgtgatgagaacaaacagtgtaataatagaattttatagtacgtgatgaagatatatgctacactatttggggcttttcaatctttttcctcagtaaaacaatcctcatcttactgtaatttcctctaaagctaattcaagagcctttccatgagctgccactaaccagtattatatttagtatagatctttaatgaccccatcacaagtgtccactgaaagtagctggccatctttcttgaaaaat

SEQ ID NO: 135402 - DNA, 470 bp, Homo sapiens
cgggccgggattcccgcggggcgggcgcgggcgcggcttccgggtccgcctgcgggtgggaaaccggacgagttggactggggccgtcctccgtgcgccccgggcgggtttcggctttcatattcgctctctcccctctcctttgcgccgagtgagtgttcccggggccggagcccctggccccccgttccctggccgccgttccttcctgtacaaacaaaaccatctcgcccacctccaccccctcccccatatatgatagccgaggaccctgagggctgtccgggaggagcgcggggactctcatctgacaccggaaggaagccagggagaaaatggaagtcagtgcaaactcacctgccttcctttggaaacttcaagaaaaaaagagattgtatcaactgatggcttttagtctcctagactaaaaagaaagtttcgttgcagctttaaagataaatcacattttc

SEQ ID NO: 135403 - DNA, 322 bp, Homo sapiens
tggcattcagaatgggatcctgggacagaaaaaggacattagagaaaaactgagaaggtgtgaataaagatgaacttaatgaataatattccatgaatattggttcactaattgtgccaaaagtaccatttgaatgtaaaatgttaataaaggagagactgggtatagagtatataattccgtaactctaaaactgttctgaaagtaaagctttaccatgaaaaaaataaagaattcatagagggaaaaacaacatagggcaagccatcaaccctctcaggatgtcagtttttatatgcttgtaaaatttggcattgctcct

SEQ ID NO: 135404 - DNA, 298 bp, Homo sapiens
cccattaagctaccattgacatcttcacagaattagaaaaactacttaaaatatatattttatatatataaaaaatacattatatataatatatatttatatattttatatattatataaaatatatataatatattttatgtatatataaaatacatataaaattggcccatattgccaagacaatactaagcaaaaagaacaaagctggaagcatcatgctaactgacctcaaactatactacaaggctacagtaaccaaaatagcatggtactggcactaaaacagacacctgga

SEQ ID NO: 135405 - DNA, 510 bp, Homo sapiens
aattctccaatcgaaagaaacagagtggctgaatggatttaaaagacaagatccaaaaatatgctgtctacaagagactcactttagtctgaaggacataggtagacagaaagtagagatagacagttattccatgcaaatggtaaccaaaaaataacatgagtggctacacttatattaatttcagtcaaattctgtcatgaaacaaagtaggtcactatgtaatgataaaagaatcaatccattaagaggatataataattgtaattatatatgcacccaacattagagcacctaaaaatataaagtaaatattaacaaaactaagggaagaaatagacagcaatataatagtagaagacttcaatatcccacttttaacaatggatagaccaaccagacagaaaatcagaagggaaactgcagacttaataacaatatagaccaaatgggtctaacagacatatatggaccattccatcccaaaacaacagaatatatattcttctt

SEQ ID NO: 135406 - DNA, 392 bp, Homo sapiens
ggactactgagattacaggtgtgagccactgcgccctggcctcacatgtagctattgaaatttatattagttaaaattacataaaatttaaagttcaagctgtgtgccaaggtgctcacctgtagtcctagctacttgggaggctgagttgggaggactgcttgagcccaggagttcgaggccgtgattgaataccatcacacctatgaatagccactgcactccagcctgggcaacacagtgaggaccctgtctctaaaaaagaaaaaattcaggactgaatatggtggcttatgcttataatcccagcagattaggaggctgaggtgggaggaacacttgaggccaggagtttgaaaccagcctgggcaacatagtgagactttgcttct

SEQ ID NO: 135407 - DNA, 249 bp, Homo sapiens
ttaaggaaaatgctctactttgtggggtgaaggagagaaattaagggggaatgtaattttggctgttaaggaaataccattttcttttaacgtaattaagttcttgattgtgatgctcttaaatgaaccatgaaattctaagcacttaccatgcgagtgtgatttttaactaagcctttttttttctacccccaatctgaatgttaaggtggcagatgcataactaatcttagctgaatctatattaag

SEQ ID NO: 135408 - DNA, 579 bp, Homo sapiens
tttggtttgaaaagaaagtccagggttttggtttgaaaagaaagtccaggaaacaggagaaatagctttaacgtacattatgtttttttgctttgtttttgagacgggatctcactctttctctaaggccaccatggttccctgcggcctctacctcctgggtgcaagcggtgttcctgcctcggtctcctgagtggttgggacaacaggcacacgtccccacacttggctaatcttttttaaaaaaattcatagagacaaggtcttgctgtattgcccaggctggtctcaaactcctggactcaaaccatcctcccaccttaacccgcctaaattgctgggattacaggtgtgagctattgcgcccagcctgttttcttcatggttaccctaaggaacatatattttggattattttttaattcttttgaaccaaaatatatttattgttcattcaagttttaaaaaaaatttcctatcttatttccacagtcggttaaacttttagctaacttgcctattgtctctgctgagttaaagttgccaacttttgttttaaatatttttaccaaaaaaaaa

SEQ ID NO: 135409 - DNA, 237 bp, Homo sapiens
tcgagctcgcacccggccattctagtccacagagagggcaaaaggataaagactgaagagttgttcattgaatgtgaccaggaggtcgttggtggccttaatgagagcaatctcagtggactgatggggacaaaaactaaaatgattgagagaatcatgaaaatggatatagcaagtataggtaactctagaagcttagttatgaagggaagagaaatcgagtgatgactagagtgg

SEQ ID NO: 135410 - DNA, 187 bp, Homo sapiens
cagggtttcatcgtgttagccagtatggtctcgatctcctgacctcatgatctgcccccctcggcctcccaaagtgctgggattacaggagtgagccaccatgcctgaccgccctgtcaacttttcaagggacttgtttctttatatcgagcagatgttaggagcataggctttgcagtcagacatt

SEQ ID NO: 135411 - DNA, 288 bp, Homo sapiens
caggctaggactagttggtctcaaactcctgaccttgtgatccacctacctcggcctcccaaagtgctgcaattacagtcatgagccaccatgctgggcctataattttttagagttaatatttttataatactcttttcaaaaaaaaaacaccttgctgaatgtagatagcaaatgtcataggagaaatctgatacctgagagagtagtacatagtttcagaaccaaggttgagagttatgctctgggatctgcttctaaatgatctgactgccatatcagtgagtc

SEQ ID NO: 135412 - DNA, 227 bp, Homo sapiens
gctattctcaccggatcttgtatctttatgatagattactcgcacccggccttctcttttatctcagagagtgtgacccagtgtcacagctccagcaagcactttcacctgagatcctctgatgggacttaacaacctagtgttaacaggatttggttctggggagtttgaggggaggaggctgttaacttttcccatttttttcctttagtcgcacccccccccac

SEQ ID NO: 135413 - DNA, 370 bp, Homo sapiens
cagggttcagctgagctcttgtgcacacgcactgcagacctgatgagggaatggggcacccagaggtgagaggatggaggagcccgctagccagctagtcttctagtgggtgcaggtcaggggtgagcaccaggtatggtgctcagtgctcttgcctagcaaggggggcctagtgtctgtgttcatgtcccgcacctgccatctgtcttctgatcagaacagggtttgtagaggaggcaggctctccagggactatgagaagggtgaaaaggagagggctcgaggatctggaggatggaagatgtacaacgtgggaggatgcctatccggtgaagggattgtggacaagcagagggagtggggagggtgg

SEQ ID NO: 135414 - DNA, 408 bp, Homo sapiens
accaacagtgcacaagggtcccaatttctccatatcctctctaacacttcctgttttctgtttgtttctttaaatagtagccatcctaatggatgtgaggtggttatcttattgtagttttgatttgcatttccctaatgactgagcattttttaatgtgtttactggccatttgcatatcttctttagataaatgtcttttcaagtcatttgcctgtattttaaaattgggttgtttgttttttgttgttgttgacatttagttctctttacatttgagatactaatctcatcagatatgatttgcaaatattttctcccattctatgtgttgcctttttattctgttgatagtgtcttctaattcacaaaattaaataattttcacgtagtctaatttgtctattt

SEQ ID NO: 135415 - DNA, 483 bp, Homo sapiens
tacgcggcagtgcacgcttgctcctgcggtcgactctaagatcccccgaggcggctcgtgctcttccccgtctcgaatttttggcggcctgcacgtctccctgggattctgtctgttttctcagcgttttctgctggcacagagtctcactctgtcacccaggctggagtgcagtggtgtgatcttggctcactgcaaactccacctcccagattcaagcgagtctcctgcctcagcctcccaagtagctggggctacagacacacaccactatgcctggctaatttttgtatttttagtagagatggggtttcaccatgttggccaggctggtcttgaactcctcatctctggtgatccacctgcttcagcttcccaaagtgctgagattacagccgtgagccaccccatgcctggctgttttctttactatagagttgcagctttggcttattttgaagacaaattgttggttatcaatag

SEQ ID NO: 135416 - DNA, 1024 bp, Homo sapiens
atagaagaaaacaactggtattactaaagatgaagttaactctgcccgaggtggtcagaaaaagcttcacagaacaattagatgtttatttaaactcgttgctggaagaaccatgctttagaaggaaggaatgacgaagctctggagtcatttgagtgaactttgcagatcagagaatcatgagaaattcagcatgatgaatgcaaagaatagaagattgagatatgaggctggaaatctgagtggagaccagaatctgaaggaacttaaatgctagtcccaatttgttcttgcgatataagcaaccattgaaatgttttaagagatgtgattatggttgttaataggaaaatcattggcagtaggaagggagagaatgagtcacctgttaagggagtgttgcacatggaatactgcacagccatgaaaaataatgaaatcatgtcctttggagccacatggatgtagctggaggttattatcctaagaattaacacaggagcagaaaaccaaatactgcatgttctcacttataagcgggatctaaacattgagtacacatagaaacaaagaagggaacattagacaccgggacccccttgagggtggagggtgggaggaggatgaggattgaaaaactacctctcaggtactgtgctcactacctgggtggcgaagtcatttcatttgtacattgtaccccagagtcacgtaatttacccatgtagcaaacctgcacatggaccccttcaacctaaaagagaaaaaacgaacacaacaataaacaaaaaaaaaaacgtgttgcgggccggcctcggggccctacagaaaaggtttttaaagacaatgcgtgtgggggggcgggccccgtcaggtgaagggacacctcgggctaaacggggtcccaagggagactcggggcctgaccgtggctggttctcccaattaaaaagccgggggaacagccgtctgacaatccagagggggtcggggcatcgcgggcctaacagggcccggggcaata

SEQ ID NO: 135417 - DNA, 608 bp, Homo sapiens
tgcaatgaaaaagtggagaccacatcaaaataacctatgccactggattcacaatgtttgagaaatatctttgcccagagtaagcactgtcaaagatagaattctgtgccctcctccttccctccacaagatttgaaagagacaaggctcacatcttggagaatttctggctccttttgacctggcagtcttgagagatgcagctcggtcagaagattgcaaggatttcctgctttcagcctgtctagaaatactacaagatgaacatcccccatatctcattatttacttcttcctaagtcaggaaacttggagacatgtgaaaattcatttcatgagtttcagtaaatattttattttgagaggctgggtggtggtttgggtttcttttgtttatttcctttttttgagataccgaaatagaattgatttactaaataggtttagtcttacgtcaaagggttaatttagcttccaaaggcttgctctgtaatccagctacttgggtggctgaggcaggacaatcgtttgcacctgggacatggaagtgcagtgaaacaagctcgcaaccatgcattccaacctgggtgacgaaccgagactgtttt

SEQ ID NO: 135418 - DNA, 245 bp, Homo sapiens
gatctatggtgcatagttgttcctagagtatcaccctaacaggctttggagcaggtgcagggggtcagaccccacctccgggaggatggctttcccagaaatggaaatggccaggcacacatgcagctactagccctgagcactggagagggcgccgctgactcacaggtcagaaggcaagccccatttggacagccatgtacatatatggaggagtccccaccctgctttggagaccccactca

SEQ ID NO: 135419 - DNA, 329 bp, Homo sapiens
gatgacaaaagcttctgtattttctccacttcttattggatagttacttccctggcctggaggactccagatcattgtctgagacatataatgtcagctcttgggatgggtggaaagtgtgtttctcagagtgccagagagatttccttccctattctcacaataccattttgtggaaacacttgattgtttgggttagcaaatagcgggagaaggtagagacagacagaatttctgcgacctggatccctacgatggcctagtggaatctgattgtgctgacctgtgtccctaactcttaggacaaatgtctagggcagtgtataaca

SEQ ID NO: 135420 - DNA, 341 bp, Homo sapiens
tctttaagctcagggagaatcacaaatccaccatgctcagtacagagggctcaataaatggctagtgtgtttacaagaccacagaggcgcgcagaagctaaggttacactactagaaaatgaaggaggaaagactcacatccaggcctcccagggtccatgcccttcacaggaaagcccccacttctatgagcatgtttagaataaacacagtgtgatggttacttttatgtgtcaacgtgaccaggcaatggcacccagagatgtggtcaaacattattctagatgtttctgtgaagtcgttttttaggtaagattaacatctaaatcacactttgaagg

SEQ ID NO: 135421 - DNA, 363 bp, Homo sapiens
ccacacagggacatgtcaattactatctagaagcagcaggcttcccaggaggccctcttgacatgtgtccacagttccatcgtgattcttccagtcccacatgcatttattgaatgataagtgcaggccttagtaaccacctgagaccaggggcagaatatccatgatagatctgggtcctgaacgctgcctttgcccgttgcttccagaaaacagtggggagctctgtttcagctctagaaggagtggagcgggtgatgaattatctttactctaggctattcattttccctgggacacattttttaaatagagatttggaaaatgagacaaactaaaaataagaacataaaaagggagaaa

SEQ ID NO: 135422 - DNA, 760 bp, Homo sapiens
attgttgaggatatgaaacaactagaacactcatacgttgttggtagaagtataaaatggtgcaaccactttggaaaaccttttggcagtttataaaaataaagtcaggcacatagctccccaattttacaggaaattcaatttttaagggggaaaaatagatatatattcataaaaagacttgtgaatgaatttgtatattagttttatttctaatacatctaaactgaaaacaacccacatgtccatagacagatgaatagatacacattatacacacattatgtggtgtgttcataaaatggaaattaataaaaaggaccagactactaattcatgctacaacaggaatgaatctcaagaactttatgctgagtgaatgaatccatatccaaaaaagaatatattgtatactttcatttttatgaaattcaagaataggcaaaattattttatagtgatagaaatcatatcagtggttgcctgagtccaggagcatggatgattgcctggaaagggagcataagataactttttagaaatgttctgtatcttctttcgggagggtggagctacatgagtatataatttgtcaaaacttattaaatttatattttaaatgggcgcattttattatatgtaaattatatatgaatatagttaattaaaaaaactagttttatagctgcttgacacacaatagtcttgatctttttatgtatatcaaggaattagttttagcacttattatgtgcagagc

SEQ ID NO: 135423 - DNA, 892 bp, Homo sapiens
ctctaaactgttttgctgagattttgtctacaattttagtaaatctacaactcaatcctatgttatgtctttcagtccatgaaggagtgccataatttccatttgcttgggcctccattaagttctttcgtcaacattttatggtttttggcatgtagatcctatacatcttttgttatatgtgtattgggggtcggggttgtaagctattgtatgtggtattttttatttcagtttctacttgttcattggcaatgtacagaaatataactgatttttgtgtgttgatcttgcatcctgcaatcttgctaaagctaaactcagtttgttctaggaggggtgtgtgtgtgtgtgtgtgtgtgtgttccttgggattttatacataggtgatcatgttatctgtgagtaaggacagttttatttcttcctttccagtctctaggcctttctggttttcttgtcttatttcactgacgaagactattcaaaaggttaaatagcggtgttaagaaagaagatccttgtgttgttcttaatctctgagaacaagcagtatttcaccattaagtagaatgttggctataggttttagtagatggtctttatcaggtgaagaaaatttctttctattccaagtttgctgagagttttataataaatagatactgaatttttaaaatgaagatcaagtgggtttttggctttaaacgtgttgctatactagattaaacgtgatggccttctagtggtaaaccagactttcagctatttctttccatgtttctatgttctgcccttttttctttccttctgggactcagatgataggaagctcggcccttttgttattacctaaggtctctatggttctgttcaaggttttcaaactttg

SEQ ID NO: 135424 - DNA, 262 bp, Homo sapiens
acccaggaggcggaggttgcagtgagctgagatagtgccatcatactccagcctgggtgacagagcaagtctccatctcaaaaaaaaataaataaataaataaaagaaacttatcagcctcatataaagtcagttttcataatatcccatgtgagtttgagaagaatgtacaactaataattattgattgcagttctatatatatatatctgttaaattgagcttgttaattgcattcatatgcttaataaaagtaaataag

SEQ ID NO: 135425 - DNA, 550 bp, Homo sapiens
cccaaagataactgctaagtaataaggttaggtatcaacagataaggaggtttggatgaagttgggttgtcccccaaagcagacccggagaaaggtcttgggtgcaggcggtttgttagggtggtgtcgcaggaaggatagtaagctcctgtctcttgcttcaaacctgcccctctctacccagtgatgctggggctgggactctgcagccaggtcctgcttagccagctgctccctgggaggtgctgttagaggggagctgggggaagactgaaagtctggaggaggaagaaggcactcgctggcttttgtttgctttctgctcttgtccacaccaccccagcaatccttctgtggtctgaatgtttatgtcccttgcaaattcatatgttgaaggccttaccccaaggtgaaggtattaggaagtggggcctttgggaggtgattaggtcatagggcagagccctcatgaaccagattagtgcccttatgaaagagaccttagagaccccctcatcccttctagcatgtgagttcggagtgaggaggt

SEQ ID NO: 135426 - DNA, 266 bp, Homo sapiens
caccatgttggccaggctggtctcgaactcctggcctcaagtaatccgcccaccttggcctcccaaagtgtgggattagaggtgtgagccaccatgcccatcccagctgtctattttaaatagaagaccaggatgcatggtttggaatacaggccatcttgtctgtttgcaatacagaccaacaggtctagacgctaacatattttgttgtcaaggtaggcaatggaatgtaaagttccagccctgggtcaccacgggtggaatgg

SEQ ID NO: 135427 - DNA, 344 bp, Homo sapiens
gtctcaaaagaaaaaaaaaaaaagattcctggcccggcccccatcccagacctgctaattaagaatctggagggtagaattggattgagtagctgaggaggttgaggttcaacctggttgattgtcttgaccactccctcaggaagttggtctgagaactgggattggaccccagatgtacttactgcctctcagtttactgctctttgcacctggttgtactgctgccttttgagataaaaagttgtaaagaaggggacgtttaattttatgagatgacattttggttcttgtttcatagttttcttggggtcttactattgttttggtcaccctggtttgtt

SEQ ID NO: 135428 - DNA, 762 bp, Homo sapiens
gggaaaactggctagccatatgtagaaagctgaaactggatcccttccctacaccttatacaaaaattaattcaagatggattaaagacttacatgttagacctaaaaccataaaaaccctagaagaaaacctaggcagtaccattcaggacataggcatgggcaaggacttcatgtctaaaacaccaaaagcaatggcagcaaaagccaaaattgacaaatgggatctaattaaactaaagagcttctgcacagcgaaagaaactaccatcagagtgaacaggcaacctacagaatgggagaaaatttttgcaatctactcatctgacaaagggctaatatttagtttgccttctaaccttcagaaccctgccaattctgagagtatcattactattatttttttttacagcaatatcccctgtgcacaatgcacccttgcaggatttctgcctgactgtggcccatgcatagtgctcagtggagactgaaatatttctctgctaggctctgttctgcagatgcatttgcagtgagctagaatacgcttgcctgccttgggaagctttgaggcaacaatagcgtgaaaccaatcacagtaattatcacattaactcatgtcattttgttcaaatactttcaacctttaaaatgtgggagctaagctctaagatccaatgctgtctctagcatcctgatgcttgtatagcgtacatttagttaaaaggaaactcattttgaggttataattagcaagaaaaa

SEQ ID NO: 135429 - DNA, 379 bp, Homo sapiens
ctcctaagaaacttgcgtcctctgaattcatgtaacatttacttatctctcttcagatacctaattacaacccagactaagcccgtggtacatgccagttactcagaaggctgaggatcacttgagcccaaaagttcaaggctgcagtacactataattgggcctttgaacagccactgcactccaaactgggcaagatctagtctctttaaaaaataataataaaaaaaaaagcagccaggcatggtggcacacacctgtagacccaactactcaagaggctgaggaaggaggacggcttgagcccaggagctcaatgttacagtgagctatgaattgcaccactgtacttcagtctgggcaacaaagcgagactgtc

SEQ ID NO: 135430 - DNA, 636 bp, Homo sapiens
atataaggtcacctgtgcacacatgttcacattctgtatttgatcagatatgtacctgccaaacttttggagtgagataattagaatgacagtagttgaagctgacagtgaatttgaggtaaagctggaaagaatgtttttgaattttgcaaataatacattttcaagccagattaaaattgaataacttactttctagcttcaagggggtaattaagtgatcctctaacccaaattgcttttccaaattttgtggtagcagtgaataaactgatgcctcctgcttatttagacagcagccatttttgtttggtttggtttggttttgcggtgattttttttaacctagaaaaaatacaatttaaaaagcaatcatgttgttttctttgcctttgacagatgtggccttgtcaccacacagtaagccagaacacaatccattcctgagtcatagtaggatagtttgtgtaattctaaatgcactctccagtttaagagtgtgggtccctttttttctatctgaaattgaagatacaggtcagaaagatggtttaatgaatatgaattttctaaacatcttttcagtgtcttttaaggatatttttgatattacaatataataaagttaaatcatct

SEQ ID NO: 135431 - DNA, 198 bp, Homo sapiens
ctcatgaatacataaatagacgggctcgagaatgaatacatgtgctcatgagtgtattaaaacatgacatgaatgtataaaaatgtgctcatgaatgcatgaaaacatgtagtcataaatgtataaaaatgtactgactgcatgaaaaggtactcatgaatgaatacatgtgctcatgagtgtattaaaacatgaacg

SEQ ID NO: 135432 - DNA, 225 bp, Homo sapiens
tggctcactgcaacctttgcctcccaggttcaagtgattctcctgcctcagccttccaaagtgctgggattataggcataagccaccacgcccggccacaaggctttctttaatactcatccagtgagtgactttacagcaaagaagaacatcccttccaccctttctctcaggcctggttacagggccacatccaccaccacacaggaccagcctgggcacctc

SEQ ID NO: 135433 - DNA, 309 bp, Homo sapiens
  misc_feature (95)..(95): n is a, c, g, or t
cttaccaaaaatccagtatccttgccatccttgccaaatcccactaaaccaaacaacgttccttctgtgcccagtcctagtattcaaaggaaccntactgccagtcctgcacatgtgtgatagttgaaaatgtgaggttgctgaggtcttggtggggaagtgcgatcagggagaggagccgagagctgagaaagaagtttgggaaacacttgttgggggcagaggaggaagagccgtgaatgggaacaatgggagaatggcccttcaccttcctcccagacatgaggctctgcccttgcagtctcatct

SEQ ID NO: 135434 - DNA, 322 bp, Homo sapiens
aagcgagaccctgtctcagaaaaactaaaaacgggtatctttgaactgtctgtctgatatcttggtgggctatccaatgggcagtgcagcacttaggtgaggtaagaatttggaacagcctgcacatgtgtgatagttgaaaatgtgaggttgctgaggtcttggtggggaagtgcgatcagggagaggagccgagagctgagaaagaagtttgggaaacacttgttgggggcagaggaggaagagccgtgaatgggaacaatgggagaatggcccttcaccttcctcccagacatgaggctctgcccttgcagtctcatct

SEQ ID NO: 135435 - DNA, 726 bp, Homo sapiens
tactttttgaggttccagttactcatggtcaaccacagtccaaggtattacgtggaaagttccagaaatgaagaattcacaagttttcaatttctcatccttctgagcaggatgatacaatctctcactgtcccactctgttttgtccaggacttgaatcatctctttgtcctgtatgtccccctgtatagtcatccctcggtatcacgtaggatttgcttccaagatccccccaagactacccaaatcagatgatcttcaagacccttatataaaattgcataatacagtcacatgccacataaggacatttcggtcaacagcagcccacacctgtgatggtggttccataagattacactggagctgaaaaattcccgttgcctagctacctcagagcagtcatgacatcatagtgcagtgcattccttgtatttgtggtgatgctggcggaaacaaacctagtgcgttaccaaacagctttaacctggatgtggaggaggatgacattgagaatctcttagaggtggttcatgaggaatgggttaatgaggagtcattggaactgatacaggaacatgtagctgaagaagaggcaagagaatagggaactggctgggcacggtggctcacatctataatccctgcactttgggaggccgaggcaggtggatcacttgaggtcagtagtgtcaggagtggtggcacatgcctgtggtcccagct

SEQ ID NO: 135436 - DNA, 355 bp, Homo sapiens
acagtttttaccccacctgttgtaattgaatggcccctattataaggatagtgcccagcaggtgcacataaataacaagaaaagatagttatttctctagtaattagggataatttcatacccaaatatatattttaaaaccatgtttgcttatgaagttgctagaacaatatatcataaatgatatgtttaatttttatctaaatattataatttaaagtttccttctgctaagtctgctaagtaaaaatgtttagcccctaggcccctttattttaaaaatattattcacaaaaacatcatcacaaaggccttatctgcaggcagaataggtgtttccccacacagtgtgcag

SEQ ID NO: 135437 - DNA, 328 bp, Homo sapiens
ataaacgagtaaataagagaagagaaaatcttgtaagaagccagagggaaaaaacactttgtttatagtggagcaagaatatggattacagtagacttctcatcagaaaccatgcaagtgagaaaagagtaggataaaatatttcaagctcccaatggccaaagctagaactgttaaagcaacagaataagatagtactggattaatatgcaaagtataaaatcaacatctctgagtccatttgatataagtaaatagttgaacatacaaataataaataagagtgaagagacaatggaaatctttatgcagaattccaagtaactta

SEQ ID NO: 135438 - DNA, 692 bp, Homo sapiens
agggagactcaatctcaaaaaaaaaaaaaaaaaaaaaaaaaatagcccattgaaaggctgtgagcaaggaagtaataaggtcagatttgcagttgagaatgatccctgagtctcggttttcttatctatgaaatgaggctaagaataataaaatagagaattaaatgagataatgcctgtaaacagtgcctggcatatagcttattattcatccagctaagaggcccttccatatgtgaagctttgctctgtgaggtctgtattacaatcacattcagttatagctaattatttacttatgtagctatctctgaaacttagaaatgaaatcatcgaggaaaaaggccatttcttgatcctgtctgtgttccctgttcccagcataaagcctaacacgtattaggctaatgtcaccgagcaaagaaagcatcaaagtggcgggtcgggccctaaacccacgatgggagataccacattcggccacaagagggcgcgtcacattttctccaagagaagctgggccgctgatgaaggacgggctccgggcctcccagagacacttcacctcctgggatcttgctctaaggaagcccggtgcgaaggaggtggctttctcaggtggtcgcgctagatgtccaaggctttatgttcggtcagatgagctgtataataaaatgaaagtgttaactggc

SEQ ID NO: 135439 - DNA, 190 bp, Homo sapiens
caaaccacagggaaaacagaaccaccctcttccttcttggatattgctgaatgctggtcttgtgaacagtaaaaagcattaaatggcatagttgtgccaaataaagtttccaccattcagaaaaggacttacaatagtttcatacatgtgctgctggattatttaatgaacaaataagtcacagttaaag

SEQ ID NO: 135440 - DNA, 766 bp, Homo sapiens
cccacgcgtccgaacacggtgcccccgtgtttaattcacagtggtactgccaggcctatcctgcgaggttgcctccaaatacagcactcagtgcttttctgcccttcagcaaggggtggcttggaacctgcactcattccccagtgcagctagttaagggaaatttcaggagggctaactgcctattagaacagaagaaacagcattttggggttaaaaaaaaagatgattttcttctttggcatggttgctaggtgaacaaagttgcctttgtagctctgaatgacttaaagtttcaagagtttgatttcattctgtttattattttcttactggaaaggcaaattgaaaaggaagacaaatttgaaatcattcctttactacaaaaggaattttttgaaatctcctaataaactgggtcagttcccccaccctgtatgaatatatttgaaatcatttccttcctggcgacttgaggttttccctcgtgtctcctccatctctcttcagattattagtgtttaaaacccgcttagcagtcaaggaatctgctgctttctgtgtgggcctggctctcctgctgtcattgtttctgggcagctcttttagaaaggagacacgcttatcactggccttgcagaatgaggcgcgaacaacccgacaggttggcctgcctgccaggcccgccttcctagaatgagttgtctgaaagaatatgctgatctacagttaaaatgaggaaccaggagaatccctgctggaggag

SEQ ID NO: 135441 - DNA, 323 bp, Homo sapiens
tagggagacagggaaagtgggctggactgaagagtttattttctgaagccagacatttgtttgggctgccattggacacttgagtaacctcaagagagggctggccagggcaggacaggtcaggggatccagctaaacgggaggtccttgggaatgacacagataactaagtgccgaatcccaggaggtcaaacaggcccaggaaggggcagactgaaactcatatcaacacttggaaaaaaaaaagtgacagaagacaggaaaaggggtcaggtggcacactccttgggcagggctggtcccaagcttcctatgaaagcaga

SEQ ID NO: 135442 - DNA, 413 bp, Homo sapiens
acagacagcgaggctctcaggtcaccggcaccagtggcaccacccacagggactgcagggaagggcgggcaggctcccgttcgttctcccagcacccagtttccagacgaagcctccctgggatcctggcttcccacggctctgcactgtccctttctcagaacttaacgtgggcatttcctgaggcctcttcctccggatgagctggtttcggcctgggatcccagcgtccccacaccctctggtgaccaccacatggcccagcagccacacagcacccggcacccacctgggcgtctgaggctggaggaagctctgccctttctttcgagtcatgggggtggggcggtgtgcatcactttgggcccatggatggtgggtgccatgcggccacgtcagagcagggcatggtg

SEQ ID NO: 135443 - DNA, 390 bp, Homo sapiens
catcatactgttttccatagtagcttcaacatggtgtccccactgattggagcagtgagtagtcaccagagtttaagcacagtcagtgccctgctctttgtccccagttcatcccaggtggttctgcccatgtagcactcccagtggttcccatgggacaggactggagtgggcttcccagacttgtggagagctcggagttccacatctagttcctctcatctcagaaaccacgagtctagggaaattgtgtgcgagtggtgttctgacagtttaggagaccagggtggtgcactctgaaattgaactgtttctcttaccagtggtggcatcacttagttcttctccccctacttcaggtgcattaaagatggtattcttgtcttaaat

SEQ ID NO: 135444 - DNA, 327 bp, Homo sapiens
catactggaccttctggtcacacgattaacccgagcgctaccaggcatacctggacctttcctacatgacaaatagttacagtacctgcctgcccacagcctggatagaagacccagggaaggcctaggtagcctcgttttacaccatctaagattcctgtggccatcactgattgtccctggatggacacactacctagaggccattccgtagcctggacaatgacatatggtttgacgcaaagaagtaagtactcaatcaggttccttctcttgggaatttgaatgaggaaataccaatatgttttgccacaggggcaaaagcta

SEQ ID NO: 135445 - DNA, 231 bp, Homo sapiens
tttacatctctgggcctctgcttggaacacatcccatgcaggtcctacttccccttcccaaaccttaaccccttctagcccccagcccttttttttgtctactcaattcttaccctttaagcttctgcttaagcactatcttctcagggaggcagcctctcctgagctcctggctcaagttagagcccatggctataaaagccagtaccccatataattcttcttttgaac

SEQ ID NO: 135446 - DNA, 566 bp, Homo sapiens
tacaaacacagggaaaaagctaacacaacctttaagccgcattaacaggatcaagggatgtattattagtcctgctagcctccgaaccattgagagtacttctgaaagacagtgcttacttagcttgggctccagattttaagagacccgttaataatttggaaggtttattagcagactgcagatccaaaaatggtcctcctctatttgggaagatattgcaggaaacaatgctctaggagagaccacagctgggccagccagattggtcaaatccaccctagaaatgaattagggagaagagatggcagccagatggctttttaaatgttgataagctgaagtgtggccagaaaaagagaccagagaatgagggaataagtcacctaaagcatgatggcagaatctaagcataaacgcttagcagagaaaataaacacactgtccatatacaccatgcccagccccaagcccagggcagatctgatactctcctgctgaccctgacacagcctcagaatacttctcaacacagaccgccagctgtcactgcccctgtgaaagta

SEQ ID NO: 135447 - DNA, 586 bp, Homo sapiens [sequence omitted]

SEQ ID NO: 135448 - DNA, 316 bp, Homo sapiens
aggggacaggcagcagtaggacattaactttgtggcttttatggttttgtcaaggagcagatttggcactgaaagatactgtcaagcattcaccaaggaaatggaggacatgttggtgtgacatggtggtggacagattggtacctggtgtagtctggaggccgttccctctaaatctcatgtggaaaggtcatccccatgtcagaggtggggcctgatgggaagtgcttgggtcatgggagtggatccctcatggcttggtgccatccttgccatagtgagttctttttttttttttttttgagacagagtctca

SEQ ID NO: 135449 - DNA, 606 bp, Homo sapiens
gactacaggtatacgcctccacgtttggctcttccttccttttaggtaaggattagcatgcaatgacacttctctgcctcttgctgtattcactgtccatcccactccagctgtctctccctagtagttggtcaagattgtcctcagtcccctttacagccacagagtcctccattgtgctgataaccacaggcctctgctgatggacattttccttgctcccattctttagcgattacaaattgaattgcaataaaaagcctgtgcttacaccttttggtatttttgctagtgtctctctacggtagattcccaggaatgggattcttgagtcaaaggttgaacatacatgcaattttgctatagccattgccaaattcccctgcagaaggcctgcatcattttgcattcccatcagctctggctaggagtgccagcagaatgcattgccaaacttttggatttttgacaatctgataggtaggaaatggtatctctgagtagttttaatttgcatttcttttgtttgagcaatgttgatcatattttcacagggttatgagccatttgcatttctttgtctgtgaattgtgtgttaatattttt

SEQ ID NO: 135450 - DNA, 358 bp, Homo sapiens
ctcaaactacatttcaattcctctttaaaagttatatatctgagcagtggtttaagcagaaaattctgaaaagcaatttagaacacaccgctaattttttatttttgtaatcagactgttaagtagaacagagctaaaacctgggaccatgagcaaggaatgagaaggattccagaataaaagtatcaaataaaattctttgcactcacctttctctgatgatttaaactcaagcagctctgacagagagaagtcatgaattttcatcaacttcacacatgtcatacatttaaaaacattttgatttgccctgggacccctgtatgtctctgaagcatagtaatagtgctgggatgtt

SEQ ID NO: 135451 - DNA, 742 bp, Homo sapiens
gaataaaacagtgagtgaacaaaatatactgtgctataatgttttgataaaaatattcaaaacggacttgttatttcccaaaaaacatactttcatgcagattgaaatttgcaaatgatagtttagaaaatttatctacagaattatttctataaaatcctgacttgcaatggcagtctgtttttatttaaagatttatttgtattttatggatatttagaatatcacacatttactaataaatttcacattatctgtaagtatgaaggatgaactaaaacatataaaaataaaagttatatatgaaaacagatgattgcaaactaatgattctttggattaaaatacaccagaagaaaagaaaatattttatcatagactgaaagttgggatatgtaaatgaagcaagagactttggaatgacaggacaatgtgagtagaacagaaaaactttacaaggtaaattaattattttagggagaaatgggttctctttaatgcgtgaagaatcacctggaagcttactaaatattgaactctggggccctctccttgcgtgattctaatggagatgtttatataccacacctttcaaatggaccacacctttgaagaacagtgatattgaggcttatatgcacaataaaatgctcatttctttctttatctccttttcaatgaattgtcttagtactaagtattatactaataacagtttggggtacctctgagttgggaaaag

SEQ ID NO: 135452 - DNA, 590 bp, Homo sapiens
agctattctgggtcttctgcctcgctataaaagaatcagcttgtagatatccacaaaataacttgctgggattttgacataccacagattgtttatctattcacttattgaaggacatcttagttgcttccaatttttggcaactacaaataaaggtgctacagacattcgtacataggtttttgtgggaagaggaaatctactcatttgggtagacaccaaggagcgcaattattggatcacatggtgagactatgtttagctcattaggaaactgccatagctatatgttttttgcatttgttcagagatttttcgttacaatgtcactaacatgattaatcctcagaataaacctttgggttgggggttattagccttgccttctggctaatgttattaaatgttattgctgaaagaaaccctgaaggttcctaagcctctaagctttctgagtgtgagatccacatcccctatcactgctcttctatggcttccatggcaccgtgagtataatagttgctgaattagtgtccactacacactgaataccaataatggaaaaaccacttcactgtacagatgaaaac

SEQ ID NO: 135453 - DNA, 551 bp, Homo sapiens
gtacatatctcaaaacatcatgttatacacataaatatatacaatttttgtcaattaaaaattaattcattaaaagtaaatatgatacagaactccacccaacattctctgtcaaattttcctcctttatttttcttcatagcacttatcatataacatatatatgataatatatatcatatatattatgttgctaatatgttttgctaatatatcatatatatgataatatatatcatatatattatgttgctaatatgttgctaatatgttttggtcttttcctttctatttaaatgcaggatccatgagaacagagattttttttttttctgttttacattgctctattcccagcacttagaactgtgtttgacacagaagaggtactcaataaataaatattggtgaaaggtgttcagagacgttatacttttatacccttgttgaggtccctaatatactcagtgtgtatgaacaacaaaagcaggtttatgagatttcaaaaaaagatactttcctgtccaaagtgcttgttttgctgaagatac

SEQ ID NO: 135454 - DNA, 260 bp, Homo sapiens
atgcggtatctgtactgctggtgagcactgtgccacatttgcttatagtacatgtgcgtttcattcacaatacgttcagcacaggtactactgatgagcagtgtcagttagaggctagaagtgccagctcagattagactgctcagactcgcatccccattctccctttagtagctccaccacctccttgagcttcagtttcctcagctgtaagtagagctcatggtaaagactctggttacttgttaagcccttaacat

SEQ ID NO: 135455 - DNA, 469 bp, Homo sapiens
atggttccaatgataatttgatttttagagcccttgcagtgcttttctagtctgattttttttctcctggcactgtggggactcccattcaatccttgatcatgccatctatgggagtggagtggatttccttgggccggttgctgccaagtggagaatacgtggtagatgctggactcaggactcacgggtctgtgagcactctcctagtcccatcatgtggactcccacctggtgccagtggggcttccattcagtccctgttgatattgcctgtggggatggaaggctcttcccttgggcccctctttgctcctgggtggggagtggggaaacactggacctgcatagtcctttgctgctgggtggagggctaagagatgccagctgtgctgactggtgctgctggtgtgggtgatgtgggcctaccggctgtactgcatatgggggaggggatgaagtccccctg

SEQ ID NO: 135456 - DNA, 524 bp, Homo sapiens
agggcataatgatacctatgtcatggagttaatgtgataattaaataacttaatgaatgaaaaactctcagcctgacttaatataaaattccccacatagggcagctacaaagtcagtatcttagtcatttattgctgtaaaacaaaccacaccaaaatttagtagctttaaaaaaacaactcttacttgctcacaactctgtggactggctatttgaactgggctttgccaagcaattctgctagttttactacaaaggactgcaggaatctgaaggcttgactaagattggatagtgatatggtttggctgtgtcctcacccaaatctcatcttgaattcccaagtgttgtgggagggacttggtgggaggtaattgaatcatgggggcaggtctttcccatgctgttcttgcaatggtgagtaagtctcacaagatctgatggttttaaaaagaggagttccccgcagaagctctctctctctttttgcctgctgccatccgtgtaagacgtgacttgctc

SEQ ID NO: 135457 - DNA, 456 bp, Homo sapiens
tgatgatcagttgtctcacatttggccagtgagagtctcttgaggtggctgctgtgtccattttgatctgacctggttgatcgttgaatgcttccttgctttctggcaggataaaatgtatttcaacctgtacttatcttgccttaacctgggacactccttttctttaggaagttggcttcagtcttaattttatgtgattgctcacttctttcatctaaactttaaacagatttgacacattgagatcagcacttttgcctttttttggtagtcaacaagagcaactgaggtgtcctgttgatgctagtatttaatgtcttaaaacttgtcttaaaaacagaacattttcctgttcaatttatataagcaaaaagacactttaactgtatccagccaaactcttctatggcatctctgaaagtaatttatactttgccagtttgtacttttgct

SEQ ID NO: 135458 - DNA, 701 bp, Homo sapiens
aaaggaagcactcattccatgtgtcctgtgaaattcatccaacttcaggaagctggaggaatacatatggccaagctatctgggcagagagtagacagggaatggaggttgggcacagtggctcacacctgtaatcgcagccatttagaaggcaaaggcgggcagatcacttgagctcaggtgttcaagaccagcctgggcaacatggctaagtcctgtctctgcaaaaaataccaaaaactgagctggatatggtagcacacacctgtggtcccagctacttgggaggctgaggtgggagggttgcttgaccccgggagtttgaggctgcaatgagctgtgattgtgccactgcactccagcctggataacagaatgagactctgtcccaaaaataaaaaataaaatcaaagacacttaaaaagatggggaaaaggaaggacaggcacttaagcaagttataagctactttcctaactacacaagtggaatcttaagctgaggttcccaggagttgactggagccagagaagacagacctataggagcacccaattggagtcaccctccatagtagcccatatgtcttacatggatcagctttcgtggggcccttttactccatctggggaagggcgtcagatctgtggctctcatgtactgctcagtacactgccattcccagttctttttttcaaaaa

SEQ ID NO: 135459 - DNA, 727 bp, Homo sapiens
ggagatgcccgaggagacccactcagctttttgaaagatcatccctcctgcccataggattcagctatgactgaaaaattgaaggggcaattggacggttgaactttataaatgatctgcttctagatgtaaggagtcatatgatatatctaataattctatttaatcctatctatctatctatctatctatctatctatctatctctaaattatacagttaaattgatctctatatagatagatactctctatatctatacattgtctatataagtaactaaattagaacgatttggattcttcaaatgatgatggttttcctagttcactgaaatgacaggatagtttaccttgggtttatgaaataagcatggttgaaataattggcatcctgcacggattctgaatattttgcagataatttagggaaggagagggctcactgggataaaataagtgcacatgcagcaaagattttaatattctcattcttctggacgtctaggaattacagtgacataattcactgaaaatgtaggatagttgtctttttatatgacaattcattttttcttttcttagcatttttccccattaattctaaagagagactgccactgttaaaaaatttaccaatgcttacacagagtattgatgttaaaaacgacctaaatgaacagatatttaaacaacaaatactaccaaagagtgatgtgtaaagaata

SEQ ID NO: 135460 - DNA, 161 bp, Homo sapiens
cggaccggcactagagctactccagcctggcataagagctactcagcctgggcataagagctgaactatgaccaaatgtcctatggtacatctatttaaaaatacatttatggtttaattgtggataggtggtagagtttccctctatagtcttgtactgt

SEQ ID NO: 135461 - DNA, 891 bp, Homo sapiens
gccgtcattgttctcccacacaaatccaatattccaataaaaataaatttcctccagttgcttgatgtgacacaagcgtttctaactttgtatatgctcttcctcagtctctaccattctttttccttctttacctgtctaatttctatttttccttgaaaacccagtgcaggcatcactttctccttcttcctaggatgctatgggtgtttccccttctctgattaccaaaagcaccagttgtacacatagtcccagctccattacttgatgaccataactttggtttgaaacttaacctccacaatcctatttccctttacctctttaagataatgacacatctacctcttggggtcactataagaataatagattccattcaatatatgatgactggtgttattattttaaattattgtagtcattgttacatgcatcattattctattaactgatcggtttttctaatcagcctgaagggcaggttcatgtgtttgttttgttatttctttagtgtctcaaggaccagaaataggatgggagttcagtgaatctctactgtgtaatggaagagaaaaggtctctataggagccaaatgtccagcttcacaattggcctgttgtgggatattaggcagatcatttccctccctgggcctctgtaattttatctgagacacagaatgaaggaattagaaggtgactaaggtctcttctaattacataatgttattgaacttatcaaactataggatgagatgctttgatgatttttatgttattcctcaaagagtccactctaactccagggtctggtgcaacccaggtccaggctctcagaagttcactgccaaatctgaaaactggtttgtactgggtgggatgaat

SEQ ID NO: 135462 - DNA, 367 bp, Homo sapiens
ttcaaatttccatcaccacaaacatcctccagcagtcagcaccaaagccagatcacgtgacctccaatccatctgtagactgaaacgataacttgtttcagttatttcaaaaatttcacagactttatacgacttgttcccaaatctatatagatggtgtgataaggaaccaaatataaattatatttaaaagccctactgatccctagtagctttcagtcttttcatcactcaagtcactgaaagtctaactacttgtacaccaagaaccatttttgactttgaaagaaggtcctctgagcacaaagtgaaactgcctttgcaaaaattgtaactgaggaaattatgacagtgaaagacatcagac

SEQ ID NO: 135463 - DNA, 387 bp, Homo sapiens
aaagccaataattttgatgggtccataagtcgaggaagtttaaactcttcaagctatatgcatatactccctcttcctgcatactgttcttagaaactgataaagttgtattttaaattttgagtctgtgttcctattttccataatggatggcattttattctcattttacaaatgaagaaattaagggtgatgaggttgactataagatacttaacacctaatataaagcacctgaagttccttaagaaatgcatgtttaaactacacattttaactatttaagtaggtcaaggcaaaattaatcaggttttactccaataaaatttaaaagttaatcaggttttagcctaataaaaagtcactactaaaggctaagcagaaaca

SEQ ID NO: 135464 - DNA, 429 bp, Homo sapiens
tgctgttctatgcacctggcacagcactgatggaaccacctggatgggcatggctacaggttggccaaagaccatagagaggctcagccccagacttaccacagcacaaggcctccgagctctgaggccttttctggctctggcattctgaagtgacatggagcacgacaggcagagagcaaggattttagtccaagaaaggcactatcaacacatcccaaagcagggctgagccaggccaagtgacgaaccaagccattctgtaatggctaagctctctgggccctctgctgaaggacaagggaaacacacacagattcagtctctgccaggctggccaaccacagggccttcctagtgtcagtctcacctctggctaggggtggagggagattcagacccagtatctcttggctataccctgactac

SEQ ID NO: 135465 - DNA, 249 bp, Homo sapiens
aagcagacagctctaagcccagtcccagggcacaaagagacaaatgtttagggtcgatgtataggctttgagctggtaagaaataagttaactttaatttattgccatatggtttagaaaaggaggagggggttgtgttttctttgtttcactactacaggtttttggataaaaagtgttaagagtcttggcgaaaagtttgtcctgctaaggttaatacaagattgtagaagtggcttgaaagtttgt

SEQ ID NO: 135466 - DNA, 263 bp, Homo sapiens
tggatgaaacgaggcttcacccctgagtctgcaaccttagacaagtttctccacaatgctactctgagatcaagatctcaactgtacatcctggagacaacacaacaacacaagggaataaaatcttatacaactgtcagaggtattgtggagttcaaattagatgatatacaatgacaccaaggaaaatacattgtgaaatttgacgagattctgaactcaaaaagagatgctgctctattcatttcaaaacaactcataat

SEQ ID NO: 135467 - DNA, 447 bp, Homo sapiens
aaaaatgtgtaagtgtgcagctgtcttcaaactcttaggcttaaattctaggaaggaacctgtaagtgaaatcatctgaaacagattggcatttggccaaggccccagggatagcaccccaactcctaggaaaaagccgaagtattttgaataactgagtgtatttggagactggggtctctctggaaaaatttctaaaaggaaatatttttaacccagacagactacatggctcactcacaagtctgtctatttggctagaaataaactatgaaaaggagcaaaacagtcaccactccccagccccccactcacctgaggaggaaagtccacaagccaggtgaacagagaaactggggatttcatttgctccataatacggtgcctattggaactgtggagaaactggcttataggaaaataaacaggagacatttctatttgtag

SEQ ID NO: 135468 - DNA, 676 bp, Homo sapiens
gaggactcacaggaacctaacctgtgtttccccaaggaacagttgttcaatattcactaattgaatgttttgttgcaagttttctagaacataactaccactaataatgagaattgactatatgtgcaaaagtatagatgaatgaaaacatggtgtgttcagggaattttagtcactcattatagctacagtatggtttggtaaaaaaggccagagataagtaagtcagcaagagccgtatcaagaaggaccttgagtgcccttctcctatagtactctgtgtagctctcttttagcactcagtccaaataccttatgtgatgcttatttgcatatacttctaattgcactagaaagttgtacactgtactctaagccttaagcatgatgataaagaaaacgatggcaatgatgatgataacgatgatggtattgacgataactgccattcattaaatgctttctttgtgccagccattattaggtgcactgcacatgtgatctcctttcttggcttctacagtcctatgaagtaggaggtgttctctccattttacagttaagaacactgaggttcaaagaagttaagtagcttgtccacagtcactcagctgtgtagcaatactaaaagtaaaatattcaagtcctggaagcctctcttctttccagcttccca

SEQ ID NO: 135469 - DNA, 511 bp, Homo sapiens
gctcctctgtcctccccgcagcacctttgctttggctctttagctttggctggtctctccccgcatctccaccagcccggcctatcctctccctagttacgcgctgctccgtcccggcctccgcacactccccagggaggcccttggccgcccggccgcctcctccccgcgtcagggcctcccgccctggaggcccgcgccgggccccttgctcctgcgagtgctcattacggccgctcacctcacaccccggtccgccccctccctcctagggcggcctccgcggcagcccccgcagctctgcccacgccgaccccgccccccagcaccaccaccacgggctccggcagtcggaaaaaaaaaagaaaatcaccgcgtccccgagcggagaccgaggcactgcccgccccagctgctgcccacgtcacagtgcaggcggaccggagccccagcggcagagcagcctgcgccccgcgggccccgccgaagagtagcggcccggggcgggggc

SEQ ID NO: 135470 - DNA, 265 bp, Homo sapiens
gtcagatatgaagagactcaaggcaattaattcacagactttctgagaacctcattccaaagttggcacattgacaagctgtggatgaggcttttttccttttgtttgcattaatataggtgtttgaaagatgagatctcaagttgcattataaatttcactctgattctttgcaaactttgaaatgcatctcactgtagctgagctgggtccagccatcagatcaaaggggtgcttgttcctgttgaagttttttttttttttt

SEQ ID NO: 135471 - DNA, 732 bp, Homo sapiens
gtccatggtctgtattgaggcttcttggaatgacttcagacttggacccccccaggatcagaatagaaaagacacggagaatgggaagttggtttgagaagacaaaaacataaattggctggcatcaggatgaattagattttgccagctttatagaaatggaattttgttcttccccccaaaattgtgtgtgtgtggagggaggccaagagagatctaggtaatgtgtgtgggcaagaatgtctaatctaaagagagccctggaagcctgctgctgaagcagaattttaatgtgggaaaggggggtgtgtagtgaaagggggaagaatggagatggcagggctctggaattagaggaggtcattcatttcacaaacatttgcagaccccctactttgtgccagatattggagataaaaaggtcagtgaggcatgacctttgggttcacattctggtgggagagaagacagataaaaatatcaattacagccacttatccatagcttagttttccgtggtttccgttacccatggtcaacctcagcccaaagacagtaaacagaaaattccagaagtaaacaattcataagttttagatgtgcattgttctgagtagcatgatgaaatctcttgccctcccactgttccttcatcacaagaagggtaagtacagtacaagatagtttgagagagagagagaccacatgcatataacttttattacggtatat

SEQ ID NO: 135472 - DNA, 418 bp, Homo sapiens
atttttttgcatgaacatgtaacttgtaattctggttatcagcgttctcatgtttcttttgtttgctgaccttggtagtttctgagaatttctggagggagtaatagcaccagcaacagtacatgtgagaatcttaagttacttcaggaaggaacattgaagggcagattttacctttcaccaggttattggggtctctagtttggtgttccatagtccatagttctcatggttttgtttgtttgtttttttgtctgtcgcccaggctggagtgcagtggcacgatctcggctcactgcaacgtccacctcccgggttcaagggattctcctgcctcagcctccctggtagctgggactacaggcgcgtgccatcacgcccggctaattttttgtatttttagtagagacggggtttc

SEQ ID NO: 135473 - DNA, 326 bp, Homo sapiens
cttgccatagctgattcctgagggtaaaactacgttagggagagcgtttgctttggacagagcggttccctgggaaaaaaccctctccagcaaggccattgaggcttgaatccttctggctctggctcctggctttgtggtccaggtcacattccttaaatctgtgatcctcaatttcctcatctgttgaatggggatgataatatcacctaactcacagaatcactggaaagattaaatgtgcactcactctctagatgttgcttatggtagtatctcaataactaataaaaacagacacacacacacacacacacacacacaca

SEQ ID NO: 135474 - DNA, 183 bp, Homo sapiens
gtggcgttctagaggatcccgaagatcactcggcctcccaaagtgctgggattacaggcatgagtcaccacgtctggcccactacagttttatgtatccaaacaagattagaaataacctaaatgcacatcaatagaaaactcattaaataagccactgtacatctatgcagtgtaataatat

SEQ ID NO: 135475 - DNA, 477 bp, Homo sapiens
tgcagcaacacagaaaaaagcaaatgctataatgttaagtggaaaatagtgttataactaaaatacagtcatgtgctgcataacaatgtttttgtcaatgaatgacagaacagactgcattataccactctggcccctataaggttataatactgtatttttactgtaccttttctataggatgtttagatacacaaataccattgtgttacaattggctacaatattcagtacagtaacatgctgtacaggtttgtagcctaggagcaagcagtaggctatatcatatagcttaggtgaatagtgggctataccacctaggtttgtgtaaatacattgtctgatgtttgcacaatgatgaaagtgcctaacaacatatttctcagaacatatccccattgttaagcgatgcatgactgtacatgcaaaggaaaaagactggagggacacatcaaatgatatttgtgttagagtgat

SEQ ID NO: 135476 - DNA, 697 bp, Homo sapiens
gttaaaaataaaacagaaaatggagtgatgagatacaaatacatttaatagaaggagagaatagagataattgtagaaaagcaatattcaaataaacaatgcctgagaactttccagattctataataaaactaatcttcagagtcaagaagcatatattaaaattaatcaacacctggatgcattgtaatgaaaccagaagacattaaagacaaatattaaaactgagagaaaagacagattatctataaaaggttgattattagacccagctaacaacagaaataatagaagcaacaagagtttccacttctggtaactgttgaatagctcctattggaccaatactcccacacataactataacttgtggacaaaatatcaaaacaaaactatctgaaggcactgcccaggagaagattgacacttggaaaaaggaatggcactaggatgagtttctttgttttatggctagctcaaaggcaggcactggattgtaccatgcagggtagctaaaattcagatagaaaccttatggtatttctggcttaaagaaccagattatggagtgagtttaaagcagtctcagcagctggaaaaggaggtaggaagtcttaaaaagagtcagagagaggaaacctcaaattctgtgtataaactttaaggaaagccaggttcttttttggaacataagaaa

SEQ ID NO: 135477 - DNA, 954 bp, Homo sapiens
acatttggaaaactaattttaggaaaaaaaccgcgtataattgcaagaaaaacaataagatacctagaaataaatctaacaaatgtttaagaccttaatggagaaaatataagattttattgagagatagtagacttaaataaaggcagatataaagcatgttcatggaagactcactatgataaagatgacagttctctccacttaatctatatattcaatgcaattccaatcaaaatcccaacagggttttgttttttgccttttgctgtgtgtgtgtgtgtgtgtgtgtgtgtgtgtgtgtgtgtgtgtgtgtgatgtatatcatattgacgcgtgactcccaaatatatagtagaggaggagagaagcagcatctcgtgagtatcacccgacagaataatttcgctatggagagggactgatggctctctcatgcatcatcatcggaggttttatctaatcagacgcgtagatataatacttcgctcttcttcgtcatcatcataaacactgagtagcggcaggacgtaggaacttcctactatattatactagtacctcgcgaggagcaggatgttctcctactatacttataactacagcatgtgatgctgctcgtccgcactgatgcccgacactcaacctactcgatcgacgaacaaacgaaacaaggtggcttgcttcctaattattagttcgtgcaaggaagcacatcatatccagcatggattaatctaacctcacaagactgatatatacaagagacggggcgagcactccatccgtaggaacctgccatccaccaacagcaagtcaccaaatcattatttattgactcctctacccaaattaattatttacttaacatgcaagtacttcctaattggctgtgttacataacacacgcaaacccagtccttacaaacagatggtagtgctctgccacccacc

SEQ ID NO: 135478 - DNA, 172 bp, Homo sapiens
tgttcatacttctgaaaatcagaatgtggtcaagaaatgaccagagagtagaacagctttcagattgatctgcagatgcttttaggacagcccagccccggacaccctctgtgcttgctgtgctaataggatattcgactttcactctctcagctccggttacatggaaagg

SEQ ID NO: 135479 - DNA, 513 bp, Homo sapiens
ggtagaggtgcgagtataacttggagaatgtgaagtcaaactgattctgtgattctttggtcatctggctcctagcttagctcttgattcactaactatatcatggagtgtgctgtgtgccctctttctcactccatagctacctccaccctgggaggagggaggcctgaggggagagagaaagattgggaacagctggtcaatggagcagtgagaacacacacaacatttatcaattaagttcaccatcttatacaggtgcagtttgtggtggccgaaagtaattacaatagtaacatcatcaaagatcactgatcacaattaccataacagatgtaatgaaaaagatatagtgaaaaacagatataatgaaaaagtttgacatattgtgaaaattaccaaaatgtgacacagaaacacaaagtgagcatatgctgttggaaaaattgtgccaatagacttgctcaatgaagggctgccacagatcttcaatttataaataacataatatct

SEQ ID NO: 135480 - DNA, 445 bp, Homo sapiens
aagatttgtttcaaacaggtttatgaacaatgcagaagaaacaacatttctacaccctccataggaaactagtttggtgtatatttttctttgcacatttaatagatataaaatataacttttaaagttctcatatacatattgtgcacctttttgttgtacaatttataatccgtgcaccgattataaataaacagttcagtgagttagcacaattattatgtacccatgtagccatcacctcagaatgtttgctcatggctggttctagtcatctctggcatcatctcattcccggcacaatagatttaatctgttttagaacttagtaagtaatcttttgttcctggcttctttcacttaatatatttataagattctttcatgttgtatagtggtagtttattattttttattgctgagcggtatcccattgtatagatat

SEQ ID NO: 135481 - DNA, 478 bp, Homo sapiens
agagaacgtaccaaagagcagagtcagaagtgaggaggtttagcttgtttagggagttgcaaatgggcaaaatgcaagctgattttggttgttagttttcttttgaattgcattagaaatttaaggcaaaaaacaggcagaagccagattacagagactttcaaggcccaaagcagtaagggtttttccacagaccttggcttgaatgggggtgaatgactactcaatcattttcttattagtcggaaccctgaaattgctttctcatgccgcacttattcccattccctggattgtgtgtgaagatgtccacgagcaataaaaggtgtgtaacacttagccagccatttctgcctgggttttagatacatggcttttacgtagatagtagttgatggctttcatttggaatttttttttttttttttgagatggagtctcgctctgttgcccaggctggagtgcagtggcacgatct

SEQ ID NO: 135482 - DNA, 518 bp, Homo sapiens
gtctgcgtgattctagaggatcccggttgacgtggcttaaatgaaattagggagacctctgtttagtgatctgggaagacctatggttgattgttcagtctgcctgtactagttgcatgtccctgaagaaaagtgactgctttttccccatctccaaggttactgtctgctctgtggacaccagaaggtttcggagtagaacagttgaggtgggccagtgagaccaggacacaggtttaagatacttcaccctccatgagccttaacagaagtggacattttcttgagcaggaattatgcattaaatcttgggatgtacatagcacagtgtcttgctcccaggtgctcaatcaatattaatttaccaataagagaaacaatatggtacaaattaactgccaatttctctcaatcaaatactttgggtcctcactgaccccaagaaagccatcagaatgttctcataggaaactcactttgtaaattaaggcactaccagcaagactcaaggaacgaaa

SEQ ID NO: 135483 - DNA, 349 bp, Homo sapiens
gagaagaggcaaatctggttattagaagacatgtatgaaaaccaaacaaggtggcaaggacagcttgaaagaaaattccaaggctgctgacattcctagataactgcagctgtagttatgcctgctaaggtttgggcgcatggggcttggcttttgtcagctccctgggatttattttcccaaacaaagaaacctccaggttaggggcaccctattcattcccatcacctggcatgatttaaaggataattgcttagaattaaaatattgatccagattttttatattccccatcgctttttgtttcttctgggctgtagccagagatcattgattggcgctcaggaat

SEQ ID NO: 135484 - DNA, 178 bp, Homo sapiens
tccttctagatataagcatatcctcctgttcactgcacctagaaatcctctgccatgtttgtgtggcacaactataatgctgcttccacacttccgttgtttcattcttgttccaaatctctgatccctcaggatcactactttttctcaggatcactactttttctgggccaagcgc

SEQ ID NO: 135485 - DNA, 300 bp, Homo sapiens
  misc_feature (280)..(280): n is a, c, g, or t
  misc_feature (282)..(282): n is a, c, g, or t
aatatgatgaacggagagtctctcctcctgacgtcgttatgcacattgctgtgattcctaagcttgctttgttttaaatacacattcttgaatgaaacaagcccaaagttttgtggttaattatatattatactaagtgtgacactaatagcctttcagtttggagagactggttcttaaaactgcggactctggctggtgagtggcccgccctctccttgctgttctaagcaattttaaggtctccgttggaatatttgactggtttgttcatcatatnantggggccggctcgatcga

SEQ ID NO: 135486 - DNA, 118 bp, Homo sapiens
ttttgtgagcatcttgattttaaaactcatgactgccttttgcaaccccagtccaaatgaagtgattcaaaagacaacccttggccgtgcgcggtggctcacacctgtaatcccagca

SEQ ID NO: 135487 - DNA, 210 bp, Homo sapiens
tatattctgctttgctctttttggctcttattgtatttggtaggaatctgtgttcatgatagatgctatatgtggaatatgcattttggagaatgattttagacagcagtgagtgggagggaaaagaaaatggccctgacagatacaagtagtctattttgaattttgtaagttgaatagaattttggagagctatttgcaaggctgatt

SEQ ID NO: 135488 - DNA, 193 bp, Homo sapiens
gaacaaattgttttgaactcaatcctctttattttagaacctccctttattcctttccagagctactggtactctaattcctgagtcttttgagcattttgtgttgtaattagagttggctcttggttttcctaattactgacttagtatttagctcttattgcccaggctgtagtagctcttattgcccagg

SEQ ID NO: 135489 - DNA, 682 bp, Homo sapiens
gcgctctccagttccctcctggtcacctgctgcctgatggtggctctgtgcagtccgagcatcccgctggagaagctggcccaggcaccagagcagccgggccaggagaagcgtgagcacgcctctcgggacggcccggggcgggtgaacgagctcgggcgcccggcgagggacgagggcggcagcggccgggactggaagagcaagagcggccgtgggctcgccggccgtgagccgtggagcaagctgaagcaggcctgggtctcccagggcgggggcgccaaggccggggatctgcaggtccggccccgcggggacaccccgcaggcggaagccctggccgcagccgcccaggacgcgattggcccggaactcgcgcccacgcccgagccacccgaggagtacgtgtacccggactaccgtggcaagggctgcgtggacgagagcggcttcgtgtacgcgatcggggagaagttcgcgccgggcccctcggcctgcccgtgcctgtgcaccgaggaggggccgctgtgcgcgcagcccgagtgcccgaggctgcacccgcgctgcatccacgtcgacacgagccagtgctgcccgcagtgcaaggagaggaagaactactgcgagttccggggcaagacctatcagactttggaggagttcgtggtaagatgcgaacgcc

SEQ ID NO: 135490 - DNA, 721 bp, Homo sapiens
ctgacatgttgattgcacttcacatcacacacaataccgagggacttattctgtaaggtttctggccttcccctttatcataattgcagagtgtcacattgatctgatggagatggatttagaacagttgttgattggaagctcttgataaagacagggagttcaaacacagactctgcctggaaattcagcgtgaacatccctcatctatcataatttaaccgatgagaaagatcaagttaacctgccatccatcatatctatttaactgtactccagagtgaattaaattgtatttaacaacttttatcttacagggtttgcacactgaaagagaacagcacttcttcatcaagttgttgctctctgtttatcaatttaagattttgaaacttgttctaaaacattcaatatccagtaaattcctttcaaagactttatggtccttaattttcccccaagttttgttcttactggtaataatcaatatcagtttagtactatagcaatggagaagtattcttaggatgcaatggtataaaatagtatcttatccttgaaaatagacgtgctcaattgaaataagcttggttggtattgcaagtattaatttggagtactttcagacattttaagaggtatcgttttagggccatagaatagtagagttaggagggcacctgaagatctaatttaatcctttagtttgcagctaaggaaa

SEQ ID NO: 135491 - DNA, 281 bp, Homo sapiens
agtcttgaagcacaaatgggcattagctaggtgagtaaggcatcccatacaaagtgctcgtggcacttgggggaattactgatggtctgaggattggcagggaattgggtgctgctggcacgtgtgatgtgaggtggcgaaagtgtgttctccctttagattctcttcatctgtggccttgcctgtgagggctctagctggtcctgtatgcaatgtattagcgggacatttaggtgtctccttaggaggtgacggatagactgtgtgagtgggaagagaag

SEQ ID NO: 135492 - DNA, 494 bp, Homo sapiens
cactgtccgtccagcctgggggacagagcaagactcagtctcaaaaaaaaaaaaaaaaaaaaaaaaagttagatagttgtcttgaggaaattacttacgtaattatttgaattgcaagctgaactaactgctttcttcatgaaacaccatttttacttgaaagagtggctgacagacaaactatggttaaatagaattgggtgtttggtagatacattctttaaccaggagaatcttgtcacttcaagaaaaactattgacagtatttgttgccaattataaaaattttaactttcaagcaaaaattggaattttggaaaacttgtgtttgctactttgagcttgacagttttccaatatttcaagaattttctgggctgggcacggtggcttacgcctataatcctagcactttaagaggccaatgtgagaggatggcttgagaccaagagttcaagtccagcctaggcaacaaagtgagaccccatctctac

SEQ ID NO: 135493 - DNA, 124 bp, Homo sapiens
tcagcttcagactctccagactgccttcaactcttactggaagggaatttgcaggtaaatatcccagctccctcactccttgggtgggttaacactgtccctggtgggacttagccccaactgc

SEQ ID NO: 135494 - DNA, 483 bp, Homo sapiens
aataaagggatgcagaaaaatctatcaagcaaatggaaatcagaaaaaaatcagggattgtaattctaatttcagacaaaatatactttaaaccaacaacaatcaaaaaagaccggggcattacataatggtaaagtgttaaattcaaccagaagatataactatcctaaatataaatgcacccaacacaggagcactcagattcataaagcgagttcttagagacctacaaagagacttagactcccacacaataatagttggaggcttcaacactccactgacagtattagacagatcatcaaggcaagaaattaacaaagatattcaggacctgaactcagcattggaccacatggatatgatagagatctacagaactctccacccgaaaacaacagactatgcattcttctcattgccacatagcacatactctaaaattgaccacacaatcagacacaaaacaattctcagcaaatg

SEQ ID NO: 135495 - DNA, 320 bp, Homo sapiens
tagcacgtggtccacttccaggaagtggaggagtcagagcgccccacccctcatgcctcaaccttcagaactgacatgctcagcgcagaagggccacccctgggcatgagggtagaccatggtggtggtcccacactgctgagcgttcttcaagccttcctaaacatccctggataaaagagacagcatgagaatcacctagcctgacatgtgccggacacgtgcctgacacgtgcaatgttccttcagtgatctaaaatgacatcacaacataaagctcctggaagatgttctgggtagtggtgcctaaagtgatgccc

SEQ ID NO: 135496 - DNA, 432 bp, Homo sapiens
cctcagcctgtgcagtagctgggattacaggcgagagctcatttaattttcttgacagataatcttctgatccatgaactgatttgaatgtatcatttactagctctcttcttgggcaagctgctcaatatttgtaaaacatttttaaaatcagatatcaacctccaagagtgaggattggataaccttagaagggtgccagacacatatagagagcttaacaaaagatagtaaattttggtgcttctgagggccagagacagaccatgtccattatatctttgctatatattatagttgtgagtgatttttaaagcagtacttttaatttgcttgtgaacccccaaataatttttgtaaaactgtccctcttgcacacttttggttaacttacagcattttacatcatgcgttagttgaaaagaatgcagt

SEQ ID NO: 135497 - DNA, 131 bp, Homo sapiens
aattaaaagcatgaagcatgggtagtccaattgaggccattgaaccaaatccagccaggccttattttggagcccatgaacacagccacactcacacatttgcatagtgtctatggctactctcacgctac

SEQ ID NO: 135498 - DNA, 396 bp, Homo sapiens
gataaagaataaaaattggtttctaacagaccataaagtaagcaaacttacaccaaccatgatcaagtgaagtagatgggggaaggagaagaaatatgtttgaaatgacaaatagcacagaactgtgtactatgtagctctttatagtactaactttgaaacaaacagcataatttctaaaaaaaaaaaatactaattaccaaaattacctcagaaagaagaagaaatcctaaaagactataaaagaaattgaaaacagagtcagatatttagcctttaaaaaaaaagacaccaggtccagttgatttaatgggtgattttactgaaatttcaaaaattcaataattctaagaagcagattattcccaaattatataaataatcccaaatcccaaa

SEQ ID NO: 135499 - DNA, 218 bp, Homo sapiens
atagcccacttaaaataagcaacaatttaaggaagacttttatttaagtctttggatgtcttctgatttctgctttgccttttcaggcaacaaataaggagcctggcaagcagcaggagagagccagccccataagggagacaggctacaggctgcaggcaggaaggacagggtgccgcaattggaaattttatcctaaggttggaaataatgttacc

SEQ ID NO: 135500 - DNA, 708 bp, Homo sapiens
  misc_feature (475)..(475): n is a, c, g, or t
  misc_feature (494)..(494): n is a, c, g, or t
  misc_feature (708)..(708): n is a, c, g, or t
ggcctggataagcacgtctgaaattcacagggctgccagtgggaagggacaatggccagcagcaggctggaactccaggggcttgggtgaagctgtcatttcacaggtgaaatttctgtcttgaaacctcggtttttaagaccacctcactgcacccggccttggctttgttttgtttgttctgttttgttttgtttgttaagatgggttcttgctttgtcacccaggctggagtgtagtggcacgatcatagatcactgcagcctcaacttcccaggctcaagcgatccttccacctcaacctcccgagtaactagggctactggcgcatgccactacagccagctaattttttaaatgtttgttagagacaaggtctccttctgttgcccaggctggagttgaactcctgggctcaggcgatcctcctgccttagcctcccaaagtgctaggattacaggcgtgagccaacanacccagcatccatgtctgnttgttgttgctgtatgtacctcacacagggtctggcactcagtaaataatgaataaataggtgttacatttaaacaatgtgtaaaccagccgggcgcggcggctcatgcttaatcccagcactgtgggagaccaaggctggtggatcacttgagcccaggaggtggagattgcagtgagctgagatagcgcaatgcactgcagcctgggtacgn

SEQ ID NO: 135501 - DNA, 225 bp, Homo sapiens
cactcaaagcttactgccaatgtctgggcctttgtaaatttgatctgggtttagtcctgtctagagggactcggcttccttctctcccctgtagttttttagttgacgagcctttttgtttcctaagaagctttatgccagttccctttttcacaagaggtaacttgggtctctcagtcacttttggacatgaagcacctagtctttagacttagctatcgatca

SEQ ID NO: 135502 - DNA, 319 bp, Homo sapiens
tttgtttcttggccttttccccttctagctactggcaggttcaagtccacctctgaacctgccacttcagagggactattttccttattgagacacagtggaaagtcccagggagtggcagatgtaggccaagtttgggtcatgtacacatccctgaagcactgtgcccagggcaatgatgtttcatgattggctgagcctcagtaagggaccacctctgtgcctggagtgcagggcactgtgattagcaatgtcccaaggaccacagtggagggagagaggggctccctaaggactcaggagatggggattggatgtt

SEQ ID NO: 135503 - DNA, 368 bp, Homo sapiens
tggctgctgtggccttccttgatattgcagaatacactgagcaacatggtacacacgcttgctgtcagctgtcatactgccactaaacagcttccacttcagcatttgaaatgttccacttacagcctatgagtgattcagcctggtgccagtgaaacttttcctgccttgaactgctcaaagcccaagcaggctcctggacgttcaagggcacagactctctttgaatgtgcacgatgccaatctgacaggccagcgccacctctgctcgggtcccagctcaacgtctctgctgacctgctcacacgttcatgtacctctaaaacccagcattgcacgtctgaagctgcaatcacccctgcccctct

SEQ ID NO: 135504 - DNA, 320 bp, Homo sapiens
tgtacatcctaattaccgtggggtgttaaatatgcagatgctgattcagtaggtctgggataggggcctgggattcagcatttctaacaaactcccaaatgctgaagcaggtggtctttgaaccacattttaagtggcaagatttaagaagccctttaaaataccaattcctaaacactacctagagatttttatttaattagtctgtggtaggtcccaggtatcaatagtttcagagattttctaggtgattctaatgtaaagatcaagaaccactgggttaggagatctggatttcaataattattattttggcagct

SEQ ID NO: 135505 - DNA, 729 bp, Homo sapiens
atccttatcatccttcttttgctgtggcctgatcaaacagatttagattctctagacatttgttgaatactttctacataccaagttctgaaatgggtattttcacagcagcatctcattgaactcttacaccaatccaggaggctattctcattttctttctgttctttctctctttgttttttttttttttttttttgacggaatctcactctgttgcccaggctggagtgcagtggcatgatctcagctcactgcaacctccacctccctggttcaagcaattcccctgcttcagcctccggagtagctgggattacaggcacatgccaccatacccggctaatttttttgtatttttaacagagatggggtttcaccatgttggccagactggtctcctgacctcaggcaatccacctttgtctcccaaagtgctgggattatatgtgtgagctactgcgccaggcctacaatcacaaacttattgtataatgagtttgcaattttttttaacattgtataactttagataggggatcttttgattgaattgattgattaatccattgattgatttttagagacaggtctcactatgttgcccaggctggccttgaacctccgggctgaagggatcctcctgcatagctgcgattataggcacgtaacacggcacccgcttggataggagatttaaaaaaatatattagaaaagaagactcctgg

SEQ ID NO: 135506 - DNA, 242 bp, Homo sapiens
attacagttgtgagccaccgcgcctggccccaaatagctcattttctttaagaggtggcacacttggatttttctttctcttttgtaatattagagtcagagaatactaatatatggcgaaaccaatctaaaaattcttaagggcattgatatcagataaaaagctctgtgatgtgatctcgctgcagacattgcattgcaagcactctggtcttctgtgagggaagggtaccaaccagctc

SEQ ID NO: 135507 - DNA, 537 bp, Homo sapiens
aacatgcaacagtaatggctctaccacgcatattagcagcctcagaaaatatgaattaacagctaacaagaagcctcttagtacggttggtacaaaatatcagaaaaagatgtcaagcctgctattcaggggaaagcatgccagatattctgatgacagaagcacacaatctaaaatgtggctgacttaatgccgtgcagaaaaatggagggcgagagacagaggaaaaaaaaacacaaaacacacaagtgactgccagcagtgagtccttccgatcattcagtgacattagcctgaaaacctccatgaacctcagccaatggtatcgcaattgctgagataattattagacaagactgggaactcaacaatttaagtgtgaaagcactacaggatcaatattaatattgatagtaataagaagaaacaaacagatcattttcacatggagagctgcaagctttaagatttctcctattttacacgtgcccagcaatggggcagccaagacatgaacacaagtgcatgttaccatgg

SEQ ID NO: 135508 - DNA, 301 bp, Homo sapiens
aatgtctgcagacatttttggttgacccaactggagaagtgctgctggtatctaacagcaaggaggggccatgtatgctgtaaaacatatatgaaccctccaccccaacaacaaaaaaatctggcccaaatgtcaatattgaatgctccaactgaaaaaccttgcattagagcctaatttgctgctctacactgtgagattgagctttctataacaatagttgtctccatgtttactttttcagttaattattttacttcaaagatttttttttcttaatttttagagacatgttctcact

SEQ ID NO: 135509 - DNA, 470 bp, Homo sapiens
gtgtcttgactggctgagtgctggtgtgtggacgggaaccagcctaaggaaagcactcttgagactcttcatcctgcccgggtgtgggtagcctgggtctgtcactcgtgcccacacccggggccccactcctggcttcgataagcgacgtcaccaatgtctgccccagcacctggacagactcttgtggcccttccttctcgggaagcccagaaagaactgcagtgactgagacaaacccagcgctgctgcggggtgtgtggaggcatcttgccatagtgggtggggtgcacgtgccacaaacggctcactcttgatgatgagggtgactcacgcatccccttgtccccacagttctgtttcttggactttatcctaacaaaacaatcatgataagaacaaccagccccaaacataaagacacatgtgcaacaatgctcgctgaggtgttatttactatacaaaaaatt

SEQ ID NO: 135510 - DNA, 369 bp, Homo sapiens
catatgttgattgatgcctcatgtctccctagaacgtataaaacccaaccatgctctgaccaccttgggcacatgtcctcgggacctccggaggctgtgtcatgggcacgccctcaaccttagcaaaataaactttctaaattaactgaggcctgtctcagatattcggggttcataaaagcgtggtgggccacgttgagaagtgcagtaaagccaggagattcttcctctcccctagcaggtgagcgcaaggagatccacggtaacccaggcccacctccactgactctcaaatctgtactgtcaggactcccttccaggactgggccctgcagtgagggaaaaagctacagaagcagaatcacagtt

SEQ ID NO: 135511 - DNA, 244 bp, Homo sapiens
ctgttggagagtgctccttcaagattttgcacattttttattgagttacctgtctttgccttaaggaattgtagaattcctttttatattttggatataagtctttgccagttataaacatttgaaaagtctcccactaaatgacttttcttgtcactcttaaaattatgccctttgatgaatgaagttctaattttagtataagatttatcaatcttttgcttcataattagtggattggtat

SEQ ID NO: 135512 - DNA, 809 bp, Homo sapiens
taatggctgattgcgattctgcccactgcactgttccctacagcttggtgctctgtcacttccttgggtgtggaaaagaatactgagctatgagagacagagacagagacagacagacagagacaaagagagagtgggagtgaggaattaaagggctggcctaggaagaccacaggaaaatatgtggtgaagaatctgcttgagtaaagatttccatgaaaccaccaataacataaattgtttactaaccatgtagcttccttgcctcaagcagaattaggaaatggctttgtcagtaaaagattctttaattgcccaaggaaatgaatctaatgaaggagattctttctgtattgaggtactctaagataagaaattagcaaggaaaagttggtattcttagtattgataataaaaccaaaattattttctgtggattctttagaaaaaatggaaagtaagcatttatctgaataattaataggcttgatgaacaaggaatggttttggtttctacttgtagaaagtacagaagagaaacaggttttatttggaagttagcatataatctagctttgtgtgttttggctgtagtattttaattataactgtggcttggcaaaaattccatagcttagttcagtttgatttttctggggtagaaagcatgctaaagaatttggccagttatagctttgtcctaaaaaggtgttagctggtgggaatggatttaagaggaaataaagagagtaacagtgttttgtgggaaaagtacccatagtcttattccatagttgttatatgtggtg

SEQ ID NO: 135513 - DNA, 365 bp, Homo sapiens
acagcatttggagtataagtggtttttttttacgtggatgaattatatagtggtgaattctgagattttagtgcatccatcactcaagtagtgtacattgtatctaatatgtagttttttttaatccctagctcctcttccatcctctcctttctgagtctctaaagtccatcatatcagtctgtatgcctttgtgtactcatagcttagctcccacttataagtgagagcatatggtttttggttttctctgtagctctttagaatcccaaactgtagcctaagggaaaggtttccaaggtgctctccttattgcactccaaagtatgatttttatctccctaactctatgaatctagcaaaca

SEQ ID NO: 135514 - DNA, 335 bp, Homo sapiens
cctgaacacagaggcactcactagccaggcaacttataatgaattatttaaattctctgaatgtcagtttttgtgtctgaaaagtgggaggtcttagtacttatgttacaagatggttgtgaatataaataaaataatcgtcttagtgccaacacagtcccttatatatattagccaagaaatatttgttgacttgttgaattaagttttgtggcatgctgtgtcatcatgcaaattgaaatatgggttaagaagcaaagtgtcaaaagagctagtatttgagtaaagtaagtggattttttagtatttttggcaaagagtaaaatttttggcaa

SEQ ID NO: 135515 - DNA, 173 bp, Homo sapiens
tgggtttgaaatttgtccattaaatttacttgcaccgtgctgttaggcaagttacttaaggtttctgagccagtttcctcctgtataaagtaggatagtaaaaacaccgtcctggcagggcgtgatagctcatgcctgtaatcccagcactgtgggaagccaaggtgggaaga

SEQ ID NO: 135516 - DNA, 810 bp, Homo sapiens
atacacatggagccaaaacatagttcttgcttgaaaataaacaatataactttgtccttattctctaagaggaagaaaaaccaaataatagtaatgtactaggaaaatttccataaatacattgatatctcttataccattttatttaaatcttaagttgatacaaacacaaatagaatcatacaaaaattttcatataagaacaatttaacatatttcttatacagctaaatatattaatcccttctgtaagccttacaggatattttgcatattaatgtaactattttatagcacatgtttattcagtcatcagtgtaacgggtacctactgagctccaattacttgtgaaaatgacacagggctaatttgtccgtacttcatcatttatccaatttgttccatgaagaggtatgactgttggctgtatctggtgtattatgttgaataaccaagatagaaggtctaataaggcttgatttctgacattaagaaatgagaggtctagtgtatgtcttactttactactttaggtgaatatttcatgacaagtaaatattttttaaaaactttgacttctcaggccacagagaaactctcaagaaaaccaagtttagcttacaggtatttctagcatctgtgagttgttaaagactcccaaaccataaaattagatctttaaaaacatgcaaaaaggaacagacaagctgaagggttaataatgagaagcacgtgcttactctctgtgctttaaccacatggacactgttgtcactgctactaatgctcacgttttcaggtttctattt

SEQ ID NO: 135517 - DNA, 210 bp, Homo sapiens
ggagtttcaccatgttggccaggctgggcgcgaactcctgacctcagatgatccacctgcctcagcctcccaaagtgctaggattacaggcatgagccactgagcccggccatttgtgtgatgtttaatgcctcatcttccagttagattggaagctccataagagcaaggaccatggtgtcttccttaccgtcatattcccactgctta

SEQ ID NO: 135518 - DNA, 899 bp, Homo sapiens
ctagataatccatgaaaatttaaaggacagattttaacaactttatgctaaattgatagatctctaggatcagattgccatcactctcagatgcgaagcttccaaccacttataggttcctgatatcttgcttttatacagacctaatttctcttcctttaaactttcttttcctcagttgctatttgattgaaatattgagtcattaaaaatttccaagtgggaatttttgtgtttcttcatctatcatgaagctgctcaaataagtaggtgtttgaataggagtagaaacagtaataggctgaagccagaccaatacagcttcagctaaatgccgaccttgctaaagtctgggaggaccggtgtggtattctacaatgtacaagtctgtagccggtgcccttaatatgttggcttcatgtctcatgactctcttctgtaaatatgcagtttaaaaaatacaagttattctgctgtagaagatacatttgcaaaattgatgtatcccctctaagtaaagttggctaaacaataaggacatatttataattaatgaatttgagaagaatgctgacgatatgcattattctttgaagttaacatttttcaggtcctaaataaacaaaaagtaggttacttctgtctggagtgtatgcaaggggtaccatcttgtccttggttcctggctgctattccaaggtgctataaagtcagctaaagagagcaatcataatacattgatagcatccctcaatgtgtttctgagctacttgagaatcttatttttgaataggtagcaggaaaccatctttgcagggcagcatgggcaaagggattggagggactattattataaagatccactgaactgcttcagtatcataatatcttaaactaaa

SEQ ID NO: 135519 - DNA, 140 bp, Homo sapiens
acctcatgatccatccgcctcagccttccaaagtgctgagattacaggcgtgagccaccgtgcccagccaagcctatcctttaaagcacgtgttttaaatttcgatgaagcccaatttatctctcagtgtatgtttcttt

SEQ ID NO: 135520 - DNA, 199 bp, Homo sapiens
atcaaaattacagataatttatatggcagcttaaaggatctaaaatgctccaggtaaacttgaagaataaaaataaaacttttaaaacatttaaacaaccagacatcaagacttaattataaaccaacagtattgagacagaatgatatagatacaaagatagataaaatagagtaaattaatgtaataaaattttagc

SEQ ID NO: 135521 - DNA, 333 bp, Homo sapiens
gggagcctagatggcagagtattagggctgctttctcacttgccctctgggtttctgttctctaaaatccttgcaatcactaaatggcataactttttctacaaaagaaaggcaggaaattggggggcacaaaagagtcactgatccatactgactctgaaatctagcagggcaaacactgaaagttccttgattaggtctcaacactgggaaaagaattctccatgacttttgccttcatctctaggctcctgcttccaacctctgagtcatctttcccttttgatgaaaggtggcatgtgttagctcctgagcactttctcagcctgcttc

SEQ ID NO: 135522 - DNA, 412 bp, Homo sapiens
agtgacctcaccacagcctcgatttctgtaaaaggagacagagccctcccaggccactgcagctgtgccctccgtcccccacaccaggaggaagaacttgcctgccagactaaggctgaaaaatctctgtgtgtaaggtccccaggagggaagggaggagagggctcatgtgtcaacaatatacatttggtgagctgctgttatgccaggcacacaggtggtatatttcacactaggagtttctcacctgggatccccgttctatacaacctgtgcctgggcctatgtgttcatttttcctgggggaagggacacacaacttcactgctttatgaaaattataggatattactattcgggaggctgagacaggagaatcgcttgaacccgggaggtggaggctgcagcgact

SEQ ID NO: 135523 - DNA, 558 bp, Homo sapiens
gaaaaacaagagcaaggaaaacgtaatttcttagaggagctatataagttagaataaaatgcagactcttgaggatttgagcataatttgcacataggctagcattgaaacttcctggcttaaggaaagagcgggtagggggtgggaaaggtgagagaatgacagtctttctttggaagcctttagagaggaaagcaaggtttcatttaagctatgaaaaaagatacagatgtggagaaactagatgctgtttgtacgcatgcaggaaaattaagtaaaactcactctggacttttattggcttcttcctctaaatagttgggaagatgcaattggagatcctattaaattcactctatccaagtgatctatcttgattttctttcataatctttccttttgaaaataggaatgggctggatgcagtggctcatgcctgtaatcccagaactttgggaggccaaggtgggtgaattgcttgagctcagaagttcaagaccagcgtgggcaagatagcaaaaccaagtctctacaaaaaagtaaaaaaaaaaaaaaaaa

SEQ ID NO: 135524 - DNA, 461 bp, Homo sapiens
attttttagtagagacgagttttcgccacattggccaggctggtttcgaactcctgacctcagttgatccgcccgcctcagtctcccaaagtgtcaggattacaggcgtgagccaccacacctggccaagttgtcctattcttaaataaggatagcacatatagaattattatggggattcaggtgtaaccccagggctttgggaggcctaggtgggaggatcacttgatgccaggaatttaagttttcagcctgggcaacaaagtgaaaccccttctgtgagtccattttgtgttgctctagaggaatacctgaggctgggtaacttgataaacaagaggtttatttggcccatagttctgcaggctgtacaagcgtggtaccagcatctgctcagctctcagaggccttaggaaacttttactcctggcagaaggcagaaggagagcaggtatgacaca

SEQ ID NO: 135525 - DNA, 326 bp, Homo sapiens
ttgaacccaggaggcagagcttgcagtgagccgagattgcaccactgcactccagcctgggtgacagagagagactgtctcaaaaacaaacaaacaaaaactatccttagattaagacatggacgtggtgtacatgattgcttttgctgcatcttgccacctattttcagcgagggccagaataggaagccactggatggaattctttgctgtgcttcgcagctgttcagaacacgttctttacataatgccttttaaagaaatgaggttctatgggagaagcctctgtgtcaggactaattatgcttcccttggagacaagaaca

SEQ ID NO: 135526 - DNA, 160 bp, Homo sapiens
agaagaacagacatggggggaatcagaatgtccgcagaacctaaggctggtgaccactggacagtcttgaagaggtttaacccagacagagtaactaggtaagaggcaaggatcctaacaggcagagattgggaggttgacacctctgagcctaccagga

SEQ ID NO: 135527 - DNA, 586 bp, Homo sapiens
agaacttgtttccaggatcagaacctgggtttaagtcctggctctaccaccatttgctgagtgctcatggacgagtaactgaatcttgctgaaccacagttcctcatcattgggaactatttctgttggctcctgtgtctctttgacaaccccccattgtgtgattgtgtgtgtgtgtgtgctgtttgagcacctccttactttgtagtaccatgagatactccagcctcatttttatactccctgacccagccctaaaatcagacattactctaaggaaccctggtttcttttattggacaatggggtgggtatgctcattgctactggggcatcgttgcttctagacaaatctccagtgcagaagaatttcaaacaatttatggagaaactccctctcaaggaagtagaacataactccccaccccttaagtatgagctgcacgttgtgactttctgctaattagtacagtatgtaaagaaggaatgataaaagtcgcttcatatacagaaacctaagaaacacaaccccagccaggtgaacaaggtcaacatcaacagtgatagtcacattaatagtatgtac

SEQ ID NO: 135528 - DNA, 857 bp, Homo sapiens
gcaatcctcccacctcagcctccctagtagctgggactacgggcacatgtcaccacacctggctaatttttgtattttttgtagagacagggttccaccatgtttcccaggctggtctcaaactcctgggctcaagcaatccacctgctctggcctcctaaattgctaggattgcagacatgagccactgtgcctggactcagtgtcattttcatttgcattttcctgataacatgatattgaacatcttttcatatgcttacttgccatctctgtacatctcctttggacaggtatctgtatagggcttctgcccattttttaattgggttgttcatttgcttattgttgagttttaagagttctttgtatattttggacaatagtgggttttttttaatcagatgtgtcttttgcaaatattttctcctgggcttcttattctcttgacattatctcttgaaagagtttttaattttaatgaaattcaccttatcaattacttctttaatgggtcatgtctttggttgaatctaaaaagtcagtgtcataccaaaggtcatctaaattttctcctatgttatcttctaggagttttatagttttgcactttaaattatccatcttgagttaatttttgtaaaggatataaaatctcggtctagattaatttttatccatgtaggtgtccagttgctccagcatcatttcttataaagactgtctttatattgtattataggatatttaatttaggatattaaactaataatcctaacagctccattgtcttgcctttgctccttttgactatatttatgtgggtctatttctgggctttctattcttgcccatga

SEQ ID NO: 135529 - DNA, 548 bp, Homo sapiens
ttttaggtttctgggtgagattttatttttaacgttcctatgacctcaaatgcatactttgctcttccagaaccaaagagaccacaccacatgccagcattaaaaggagcataataagggcaccccgcctgtggccaggcttctgtgacaggcctgaccctgtagtccctcttctctcatccgcagctaggttagagagcacctctatggccattgcataaaggagaaaaccgaggctcaggtgggcagggggcgagggcagggcctggccactcaagtgatgaggttagagagccacccccacgcccactgggtaaaggaggaaaccaaggctcagatgggcagggggcaagggcaaggcccagccactggagccaggatctgatcttgacttcatcaaagcagggaagctgccacacgggcgccgctggccgagcctggggaaggatgtcctactgcaccacaagacagagccagttagccagttccatgtctggaggccaccaggctcacaatccagaaaggctgccaaatctccggcagaacac

SEQ ID NO: 135530 - DNA, 822 bp, Homo sapiens
ctcagttagctgcatttgggattctattatcaggcagtacttcattctattatagaataagcgtcctaggaaatcaagcagaggaagttggcttcataggcaaaaaaaaaaggactaaagaaagcagaaacaaagaaaaagtggattggtagtttcaaagttactttccttgtatggcaggaacaggtagccaaaaatataggttaaagatcagaacagacagaaatttattattatgccaattgaaactggcctgtttcggaaattaggctatctctctctcctgatttttctggcagtccggtaacaacttggttttagttatgtggaactttagcatgggcgacttcatttctgtgtgttttttgttgttgttgttttgagacagtttctctctgtcacccaagttagaatgcagtggcgcgatcatagctcactgcagtctgcctgccaggttcaacacattctcatgctttagcctcccaagtagctgggactacaggtgcacactaccacgcccgactaagtttttatattttttggtagagacagggttttaccatgttggccagcctggtcttgaactcttggcctcaagtgatctgcccacctcagcctctcaaagtgctgggattacaggcatgagccactgctcccagttgggacttcatttttgaagtttaggctggtcatcttgggcctcgtgcaggtgcttagtccaaaacaatggcctcctataatttttatttaataattttccccttttggtcaggccaaagcctgacctattgacctaggtcaatagtgctgctttcagttgtg

SEQ ID NO: 135531 - DNA, 867 bp, Homo sapiens
caaaaacagtaataaaagacaaagaaggttttatgtaatgataaagggatcaattcagcaagatatactctgggaaccctaccctggaacacccagagtcacaaaacaaatatttctaggcataaagaaatagacagcaatacagtagtaatagggacagcaatagacagatcattgagacagaaaattaacaaagaaacattagatttaagttggactttagactaaacggacttagcagacattcgcagaacattctacccaacaactatggaatatacattcttctcttcagcacatggaacattctctgagatagaccacatggttgggccacaaaacaagtctttataaatttttaaaaatcaaaatgatatcaagtattttctcagaccacagtggaataaaaactagaaattaataccaaaaggaacttcagaaactatacagacacatggaaattaaacaacatgctcctgaatgatcactgggtcaatgaagaaattaagacagaaattttaaattttttgaatcagatgaaaatgaaaacacaccatacacaggatacagcaaaaatagtgttaagagggaagtttgtggcattaaatgcctacattaaaaaattaacaacctaacttcacacctcaaggaactagaaaaacaagacaaagcaaatcccaagtttgcaaaagaaaggaaataacaaagatcagaatagaactaaataagaaatcccccaaaaatacaaaggaccaatgaaatgaaaagttggttattcaaaaagacagacaaaattgatagaccactcactagactaaccaagaaaagaagggagaagatccagataaacacacaatcagaaatgaa

SEQ ID NO: 135532 - DNA, 505 bp, Homo sapiens
ttttgtggcatcagttgtaataccttacttttcatttctcattttgttcttttgggtcttctctctttttttctaggtcagtctagcaaatggtttagcaattttgtttatattataaaagaacaatttttcatttcatcagttctttgtatttttttagtatctgttttgtttagttcttctctgacctttattatttcttttctcctgctaaattgtggtttggcttgtttttgcttctctagttctttgaggtgcatcattcgattgtttatttgaaacgtttctgattttttgacgtaggtgtttattgttataaacttccttcttagcattgctttggctgtaggttttggtcttgtgctttgattttcatttgtttcaagaatttttttaaatttctcccctaatttctttcttgaccctgtggtcattcaggagcatgttgtttactttccatgtatttgtacagtttccaaagttcctcttgttatcaatttctagt

SEQ ID NO: 135533 - DNA, 427 bp, Homo sapiens
aaggggcgagcccttgttccagggcattttctggatttcgaggtggaatgaaggaaatgccttctgaggcaggagacctgctcagccccacgcacggccctgggggctcactgaccacgggacgggaagaggaagagtggccggggctcacagctccctgcacggctgaccgtgggaagctctgcataaaccgggcttcggtgtgccggggccgatcctcaggcacgtcaccgggtgtcccatggtcaaggggaccagcaaagtgttcggtcacggccttgtctctgtcctgcacctgcagccatggccccgggacatcagagctctcaagacgcggggcagcctggtgcaggctgagcccccagctgtttgcacagtttgtgaggctcaggcttgccagacaaaaggaggttatttgcttttggta

SEQ ID NO: 135534 - DNA, 313 bp, Homo sapiens
gctgctccttagcaggaatcacggtggcacaaaattgttttagtaatcattttattcttcactgtcacacaatcacaggaggggaaaagccaatttcatttaagaatgtccgtcaagaggcagtaaaatatactaatgttttatatctaagcacttaacggtgcactattggacaaaattgtaactgcatattagccattttctgtggcaaacagatacaataattatcttgaggaagaagtaagtgtggattatttgagttgtgagacaaactagttgctttttgtttcttttacacacatggcctattact

SEQ ID NO: 135535 - DNA, 402 bp, Homo sapiens
tgtacacaatgcttagctcccacttataaataagaacatgcagtattcgattttctgtttctgggttaattcacttaagattatggcttaagtgccaatcctaagctgcatccatgttgctgcaaagaacacgatttcattcttttttatggctatgtagtattccttggagtacatgtatcacattttctttatctggtgccactattgatgggcacctaggttgattacatgattttgatattgcgaacagtgctgcaataaacatatgtgtgcctatgtccttttggtaaaacaatttcttttcctttgggtaggtacacagtaatggggttgttgggtcaactggtaattctatttgcagttctttgcaaaatctccaaactgctttccacagggatg

SEQ ID NO: 135536 - DNA, 688 bp, Homo sapiens
tatttttctctcatagagttgtgtttatttcatgcttatatttataaatagtcctaacaaatatacatgatctctatgaagataattagaaaacaatttaaatttaaatcaattaaaatggtgtaaacatttaaaaatccacttcctcaggtatatgatagccgctcgtggctaatgactattgtcttggacagtgaagcctttgagccttatggttacaggaaactaaagatattttttcaggccgggcacggtggctcacgcctgtaatcccagcactttgggaggccgaggcaggcggatcacgaggtcaggagatcaagaccatcctggctaacacagtgaaaccccgtctctactaaaaatacaaaaaattagccgggcacggtggcaggcgcctgtagtcccagctactcgggaggctgaggcaggagaatggcgtgaacgtggaaggcggagcttgcagtgagccaagatcgctccactgcactccagcctgggcgacagtgagactccatctcaaaaaaaaaaatttttcaaagtgtatttaagagaatcctaacatatgattagtaagactttcgagcctacaagtagtttacattttgatagaattctgtggatagaaagtggaaaggaacataaaaattttctgagttgtgcctgtatttttccttaatgataaatg

SEQ ID NO: 135537 - DNA, 654 bp, Homo sapiens
ataaatgaaattccagagctgggaaaaatatagcttgaacagaatatcaaagtataaaagaaggttaaaatatactataaaatagaaaacataatatgaagtatgaagtcacaactaagaaaaaacatgtatacactatcagtaaatgcaaatgacctaatctttcctaatattaagagaaaagcattatcagattggatcacaagcaaaaccaacagtaacagcagacttatttaacacacagtgattcagaaagattgaaaattatagaatagacaatgacgtaccataacaattcaaataccattatatcagaatggttacaaacagggcacaagtattaaatgggacaaaaaagaatctttagtgataataaatattgcattcttcaatgaaaacatgacacttgtgagtatctattaactaaaaacatagcattgacattcctaaagcaaaatcaaagtcaaacactcacaaaaatagacatagggttcttagtaatctttctctactaaatctatcaaagggctaagaggagtaaataaaaattaattgtcaatgtattttatgtatttttgcgtatgtgtgatcttttaatttacttttagtgacatctgttgtcaggtttagccataaaaattaagcaattcagaa

SEQ ID NO: 135538 - DNA, 1365 bp, Homo sapiens
aggaatttcccttatctccttcgcagtgcagctccttcaacctcgccatggcctctgccggaatgcagatcctgggagtcgtcctgacactgctgggctgggtgaatggcctggtctcctgtgccctgcccatgtggaaggtgaccgctttcatcggcaacagcatcgtggtggcccaggtggtgtgggagggcctgtggatgtcctgcgtggtgcagagcaccggccagatgcagtgcaaggtgtacgactcactgctggcgctgccacaggacctgcaggctgcacgtgccctctgtgtcatcgccctccttgtggccctgttcggcttgctggtctaccttgctggggccaagtgtaccacctgtgtggaggagaaggattccaaggcccgcctggtgctcacctctgggattgtctttgtcatctcaggggtcctgacgctaatccccgtgtgctggacggcgcatgccgtcatccgggacttctataaccccctggtggctgaggcccaaaagcgggagctgggggcctccctctacttgggctgggcggcctcaggccttttgttgctgggtggggggttgctgtgctgcacttgcccctcgggggggtcccagggccccagccattacatggcccgctactcaacatctgcccctgccatctctcgggggccctctgagtaccctaccaagaattacgtctgacgtggaggggaatgggggctccgctggcgctagagccatccagaagtggcagtgcccaacagctttgggatgggttcgtaccttttgtttctgcctcctgctatttttcttttgactgaggatatttaaaattcatttgaaaactgagccaaggtgttgactcagactctcacttaggctctgctgtttctcacccttggatgatggagccaaagaggggatgctttgagattctggatcttgacatgcccatcttagaagccagtcaagctatggaactaatgcggaggctgcttgctgtgctggctttgcaacaagacagactgtccccaagagttcctgctgctgctgggggctgggcttccctagatgtcactggacagctgccccccatcctactcaggtctctggagctcctctcttcacccctggaaaaacaaatgatctgttaacaaaggactgcccacctccggaacttctgacctctgtttcctccgtcctgataagacgtccaccccccagggccaggtcccagctatgtagacccccgcccccacctccaacactgcacccttctgccctgcccccctcgtctcaccccctttacactcacatttttatcaaataaagcatgttttgttagtgcaaaaaaaat

SEQ ID NO: 135539 - DNA, 7768 bp, Homo sapiens
  misc_feature (917)..(917): n is a, c, g, or t
  misc_feature (1047)..(1047): n is a, c, g, or t
ctcactgtccctggaatcttcaagggagttactgcattacatcatcagaaacaaggcatttctatattactatggaaagatttcgtctggagaagaagttacctggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggaggagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggggaaggcctttcagcctcccgccactctttgcgaacaggtctgtctgcctcaaacctttccttgagaggagaatcacctttatctcttcttctnggtcatcttcttccttcttcaagagctggaacccctgcaggctcaaggtgtacaaccccagtacccacccctcaaaacagtcctccttctagccctagcatcagccgcctgacctccagaagttcccaanagagtcagcgtcaggccccagaactactggtttcacctgccagtgatgatattcccacagtagtaattcatccgcctgaggaagacttagaagcagcgctgaaggcgaggagcagaagaatgaggaaaatgttgacttaactccaggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagacgatgatgatactgtgcaccttccatttgaagggggaagtctcttgcaaattccagtcaaggccctaaaatatagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagactatgtatttaatgaaatgctctctttgaagtgaggtacatggttcttaactattcaaatatttattctgttagaaaaaaaaattttctgttttgcaatagaaggatgtggagaaatgctttcagtctacttttcttaaatctctgttcatcagtggcaattcgtaaaaaccttaagtgatactttgtttatatgtttataatttttaggtgtttcctgaaattttcacatattatttcacttttgttagtgctttatgggaagaatagggagtctataccagtgctgtgggaaaaatggtaacatttcagggcttctctatttgtgtttcatttctgtagatgtccatcgtgtttcactaactggcgttttcttagccatagagatgactgtagaacaatagaaactttaataatgatagtttttaacttttatgtttaaattttttttaaatcttaaaaccttcatatctaggtatccattgtgacagacaagtaaaattgcaggtgatttgataattaagcacccataccatttataacttctgaatttaaaaagttatacaatgccagtttgcaatagttgattttgatgcctttgtagaatattttttctgaatccttatgctcttttaaagccaatgattcccactctgttctctgccttgtctctctttgtcttaaaatgctttagtttccatcaggttcaagttcttgactattattctcttataagtagtaggcgtaaataatcaggagttagaattctctcagaagggtctatgatcagtattactttattaagaattacctttcattttctctttatgttattctttcacttttgtagattacatttaatagcttgttacctgtgattttattttaaaatatttattttgatatgatgcttaaatattatataaacatttggaaaagtaacaaatagagtaaattgttaatgtaaatagttggtgcttactttcatttatgtttattatcttaaagcaattgatagattttacatctttgatataaagcactgccatatttatattttaaaaggaaattagacattttatatgtagctcagattaatgacatttttattttgtgtattagtttttgcttttctgagctttttaaagtctaacaaatctttttagtcatcttttatatacttttagttccacatgaaataaatgttgttaagcctgtaggactggatgaatggggttgtgaaactgatttgacaagagaataatttacaaaaatcaaatgagtattgagaagccacagaaatatcaaaaatggtgacatcactattaggatgaaaattttatgaaattccaatgctccctttaaccatataattaaattacaaaggtatacataattaatctaataaaggatcatgaggaatgccaaaagctgaaattttagcaagtctggtgttttaaattcattataaactatttattaactaatgtaatgtcctcctctaagaccatattgtaagagtcttgttaaaatgatggattcaacttctgcctcggatgagaggttggaaatgtagctgcttttctttagaaaatatgtagctgtcatcatttggtactgcctaaaaagagttagactctattggcaattgatagagtattacccacggtgcttattattgtttatgagcttccattgtaatgattcctttttatttgtagcagcataattatttccaaagaccccagtatttgctgctatttttaaaactcccctgatgtacctgaacaagaggatttcctcacatcatttccttgtgtctggacatcaggggtaacaactgtacttactttacaggaagaaattttaaaactgaaaactacctgggatcatagtgtttctgtgattttatttaattgtgtatagtaattatccagtgccagaaaaaccgtcacttgcaaaatactttgcactcaaaatgtttttacaatgcttctaaatgttactggtttctgctttcttttgactacttgactgacaaaatgatctgactactccatttaagagcaaaggtaactcatgtttaagtaattaactgcttgttttaagtgattatatttcttccactgtttttgaaaaataatcaaagatagcattcattgagagacagtgacagatataatttactacatatattgatttttaaataaagttgccttaaataagtgtatgtaagcagtagtagttgctatgtactgatttacctcaaggtgcaaaataattaaacctgtacatattccatttacaaaataaattcagccctgcactttctttagatgccttgatttccagaatggagcttagtgctactgaataccctggccacagagccacctcaggatattcttttctccaccctagtttatttatttatagatatctgtttacaaagtctgtagtaaatcctgatgctgaccatctgaaatgtactttttttctgaatgctgtttcaatctaaaatagcagcttttgagaaaacaatgatgtaaattccttatgataaaaggatgattctatatattctttaatgatattaaatatgccgaagccaagcacacagtctttctaaagtgtgtgtatgtttgtgtgaatgtgaatgatactgatcttatatctgttaaaagttgttttaaaaagctgtggcatcccattgttcatatttgccaagtcttctgtaaagatgtctaggacgaaatattttatgtgctaatgcatgtatttgtaaaccagatttgtttaccactcaaaattaacttgttttcttcatccaaaaaagtttatttcttccacgtacttaaattttctgtgtgggtataatatagctttctaatttttttctttcacaaaggcaggttcaaaattctgttgaaagaaaaatgctttctgaaactgaggtataacaccagagcttgctgtttaaaggattatatgatgtacatcagttctataaatgtgctcagcagtttaacatgtgaatcctgttttaaagtgctcagatttcaactgtgtaagccattgatataacgctgtaattaaaaatgtttatatgaaataacttaatgttttaaatttatttatgtagatcacatcatttttatcgtatgcagtgcaaatatgtgaaatgtcttttggtttattccaacaattatttattttagaaagtaagtttaaagactttaaggacattcaaagtttaaaatagtgttcaaattgcaaaatttggcaatcttcatataaattggtttcttttctaacttttcaaaaactaacattaaatgtcaattataggaaaacatagttggaaatgtaatcatccaaagatcatttttaaaatgaaatttaattagcacatattgaacatttgacttaattgttaaaccccagttttgttttgtttttttaatcagatttttgcacactgattagtttttgtgttgtggcttttgttgctttattattcaaggttttttttttttttcttccccatgggggagattgtcttccaatgtttaactacgtttaaataaataaaaattgaattttattgttcatttatataaaatctgataccttgatgtaatttcacaatacagttccaatttttatggcttttataattacaatgatattttcttctataataaaatccaaagtaaacatttaaattgtagaactgatatttttcatttatatgaagtataagcctctactgggtctatattgtgaatcatcctgcctttcaaatttgtttcataattgttagatgaaaactatttttttggagatgttactgaagttgattgagcaataaaagtctacttaattagttgttggctat

SEQ ID NO: 135540 - DNA, 7397 bp, Homo sapiens
ctcactgtccctggaatcttcaagggagttactgcattacatcatcagaaacaaggcatttctatattactatggaaagatttcgtctggagaagaagttacctggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggaggagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagacgatgatgatactgtgcaccttccatttgaagggggaagtctcttgcaaattccagtcaaggccctaaaatatagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagactatgtatttaatgaaatgctctctttgaagtgaggtacatggttcttaactattcaaatatttattctgttagaaaaaaaaattttctgttttgcaatagaaggatgtggagaaatgctttcagtctacttttcttaaatctctgttcatcagtggcaattcgtaaaaaccttaagtgatactttgtttatatgtttataatttttaggtgtttcctgaaattttcacatattatttcacttttgttagtgctttatgggaagaatagggagtctataccagtgctgtgggaaaaatggtaacatttcagggcttctctatttgtgtttcatttctgtagatgtccatcgtgtttcactaactggcgttttcttagccatagagatgactgtagaacaatagaaactttaataatgatagtttttaacttttatgtttaaattttttttaaatcttaaaaccttcatatctaggtatccattgtgacagacaagtaaaattgcaggtgatttgataattaagcacccataccatttataacttctgaatttaaaaagttatacaatgccagtttgcaatagttgattttgatgcctttgtagaatattttttctgaatccttatgctcttttaaagccaatgattcccactctgttctctgccttgtctctctttgtcttaaaatgctttagtttccatcaggttcaagttcttgactattattctcttataagtagtaggcgtaaataatcaggagttagaattctctcagaagggtctatgatcagtattactttattaagaattacctttcattttctctttatgttattctttcacttttgtagattacatttaatagcttgttacctgtgattttattttaaaatatttattttgatatgatgcttaaatattatataaacatttggaaaagtaacaaatagagtaaattgttaatgtaaatagttggtgcttactttcatttatgtttattatcttaaagcaattgatagattttacatctttgatataaagcactgccatatttatattttaaaaggaaattagacattttatatgtagctcagattaatgacatttttattttgtgtattagtttttgcttttctgagctttttaaagtctaacaaatctttttagtcatcttttatatacttttagttccacatgaaataaatgttgttaagcctgtaggactggatgaatggggttgtgaaactgatttgacaagagaataatttacaaaaatcaaatgagtattgagaagccacagaaatatcaaaaatggtgacatcactattaggatgaaaattttatgaaattccaatgctccctttaaccatataattaaattacaaaggtatacataattaatctaataaaggatcatgaggaatgccaaaagctgaaattttagcaagtctggtgttttaaattcattataaactatttattaactaatgtaatgtcctcctctaagaccatattgtaagagtcttgttaaaatgatggattcaacttctgcctcggatgagaggttggaaatgtagctgcttttctttagaaaatatgtagctgtcatcatttggtactgcctaaaaagagttagactctattggcaattgatagagtattacccacggtgcttattattgtttatgagcttccattgtaatgattcctttttatttgtagcagcataattatttccaaagaccccagtatttgctgctatttttaaaactcccctgatgtacctgaacaagaggatttcctcacatcatttccttgtgtctggacatcaggggtaacaactgtacttactttacaggaagaaattttaaaactgaaaactacctgggatcatagtgtttctgtgattttatttaattgtgtatagtaattatccagtgccagaaaaaccgtcacttgcaaaatactttgcactcaaaatgtttttacaatgcttctaaatgttactggtttctgctttcttttgactacttgactgacaaaatgatctgactactccatttaagagcaaaggtaactcatgtttaagtaattaactgcttgttttaagtgattatatttcttccactgtttttgaaaaataatcaaagatagcattcattgagagacagtgacagatataatttactacatatattgatttttaaataaagttgccttaaataagtgtatgtaagcagtagtagttgctatgtactgatttacctcaaggtgcaaaataattaaacctgtacatattccatttacaaaataaattcagccctgcactttctttagatgccttgatttccagaatggagcttagtgctactgaataccctggccacagagccacctcaggatattcttttctccaccctagtttatttatttatagatatctgtttacaaagtctgtagtaaatcctgatgctgaccatctgaaatgtactttttttctgaatgctgtttcaatctaaaatagcagcttttgagaaaacaatgatgtaaattccttatgataaaaggatgattctatatattctttaatgatattaaatatgccgaagccaagcacacagtctttctaaagtgtgtgtatgtttgtgtgaatgtgaatgatactgatcttatatctgttaaaagttgttttaaaaagctgtggcatcccattgttcatatttgccaagtcttctgtaaagatgtctaggacgaaatattttatgtgctaatgcatgtatttgtaaaccagatttgtttaccactcaaaattaacttgttttcttcatccaaaaaagtttatttcttccacgtacttaaattttctgtgtgggtataatatagctttctaatttttttctttcacaaaggcaggttcaaaattctgttgaaagaaaaatgctttctgaaactgaggtataacaccagagcttgctgtttaaaggattatatgatgtacatcagttctataaatgtgctcagcagtttaacatgtgaatcctgttttaaagtgctcagatttcaactgtgtaagccattgatataacgctgtaattaaaaatgtttatatgaaataacttaatgttttaaatttatttatgtagatcacatcatttttatcgtatgcagtgcaaatatgtgaaatgtcttttggtttattccaacaattatttattttagaaagtaagtttaaagactttaaggacattcaaagtttaaaatagtgttcaaattgcaaaatttggcaatcttcatataaattggtttcttttctaacttttcaaaaactaacattaaatgtcaattataggaaaacatagttggaaatgtaatcatccaaagatcatttttaaaatgaaatttaattagcacatattgaacatttgacttaattgttaaaccccagttttgttttgtttttttaatcagatttttgcacactgattagtttttgtgttgtggcttttgttgctttattattcaaggttttttttttttttcttccccatgggggagattgtcttccaatgtttaactacgtttaaataaataaaaattgaattttattgttcatttatataaaatctgataccttgatgtaatttcacaatacagttccaatttttatggcttttataattacaatgatattttcttctataataaaatccaaagtaaacatttaaattgtagaactgatatttttcatttatatgaagtataagcctctactgggtctatattgtgaatcatcctgcctttcaaatttgtttcataattgttagatgaaaactatttttttggagatgttactgaagttgattgagcaataaaagtctacttaattagttgttggctat

SEQ ID NO: 135541 - DNA, 4403 bp, Homo sapiens
ccttggagactagaaagaaactgctagatggctgtaacacagttcatccatttccgtgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagacgatgatgatactgtgcaccttccatttgaagggggaagtctcttgcaaattccagtcaaggccctaaaatatagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagactatgtatttaatgaaatgctctctttgaagtgaggtacatggttcttaactattcaaatatttattctgttagaaaaaaaaattttctgttttgcaatagaaggatgtggagaaatgctttcagtctacttttcttaaatctctgttcatcagtggcaattcgtaaaaaccttaagtgatactttgtttatatgtttataatttttaggtgtttcctgaaattttcacatattatttcacttttgttagtgctttatgggaagaatagggagtctataccagtgctgtgggaaaaatggtaacatttcagggcttctctatttgtgtttcatttctgtagatgtccatcgtgtttcactaactggcgttttcttagccatagagatgactgtagaacaatagaaactttaataatgatagtttttaacttttatgtttaaattttttttaaatcttaaaaccttcatatctaggtatccattgtgacagacaagtaaaattgcaggtgatttgataattaagcacccataccatttataacttctgaatttaaaaagttatacaatgccagtttgcaatagttgattttgatgcctttgtagaatattttttctgaatccttatgctcttttaaagccaatgattcccactctgttctctgccttgtctctctttgtcttaaaatgctttagtttccatcaggttcaagttcttgactattattctcttataagtagtaggcgtaaataatcaggagttagaattctctcagaagggtctatgatcagtattactttattaagaattacctttcattttctctttatgttattctttcacttttgtagattacatttaatagcttgttacctgtgattttattttaaaatatttattttgatatgatgcttaaatattatataaacatttggaaaagtaacaaatagagtaaattgttaatgtaaatagttggtgcttactttcatttatgtttattatcttaaagcaattgatagattttacatctttgatataaagcactgccatatttatattttaaaaggaaattagacattttatatgtagctcagattaatgacatttttattttgtgtattagtttttgcttttctgagctttttaaagtctaacaaatctttttagtcatcttttatatacttttagttccacatgaaataaatgttgttaagcctgt

SEQ ID NO: 135542 - DNA, 770 bp, Homo sapiens
aacccaaactttattccattctgttgtttctgatgtattttccactttctagtctccatgcttctcaatgtgggaaaaaaagaagttaaaatctaccacattgtataattgatttagtaaaatgtaagcatgaaattcaggatccttaaaaatgtatcctactctaatttctcagatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtaactgtgatataattttggaattctggtaatattcatatttttggtttttatttccttggtttatttcaaaacagtaatatattttttgaggttaatactccatgccaactggttaataaagaaattattcgtagtgaaaaatgtatattacgtgcctgagctcacagtaggaagatgatggtaccataagagttgctaggttagttgcgaaatgtgtttcttatatttttggaaagaattaaatataaatgtgtttcactgttaacattgtcactagttaaaagctccatttgtacgttgtagtgacaattttatcaataaaag

SEQ ID NO: 135543 - DNA, 386 bp, Homo sapiens
ctatcacattatcatggaaaaccatttaaaaatctttgccatttcacttctcactctgggatttttgaatggtcttctgtggatttaaaaagcttgtaaacataattttaaaagaatgcaattagctgtaatgagttcagttatttgagagaaagcagtctgttttatattttgttgccatttcaaaggatgcatataataggtcctcaatagattgtgatctcatgagtcaatgagaataatttgtttttagggtcctgatgaagaagctgttgtggatcttggcaaaactagctcaactgtgaacaccaagtttgaaaaagaagaactagaaagtaagttggtttaaaataacttacttcgcttagtaggataatttactaatt

SEQ ID NO: 135544 - DNA, 7788 bp, Homo sapiens
  misc_feature (829)..(829): n is a, c, g, or t
  misc_feature (959)..(959): n is a, c, g, or t
tagaacttatgacctcatgacgttttatctgtttgtatgttggtttctctacctctcgaagagagcagaaacttggctctgttttgttatttttaaattgctgtattcccaacacacagcggacgctcagtgaatagttaatgactgagtgggtcctgatattcatctgctggaacagttttgggggagaatatgaggtttggcaataaaatacctttacatcttaggaagccagtattattgaatattcagcttaatagaatttattgtattcatacagggaagcactttcagctataggaaggctattagtatataatagtagcctctttataaataatagtatttattaaaataaggcggtctttgtaattcatttttattggttggataatgttcatttctgcattgattatttgtgacagaataaaactttctagagctatttaaggttctaatttttgtcataaggtttcactcacagtttattcctatattatggtcatctgagtgtttagtaatttattttttttttcattgaatagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggggaaggcctttcagcctcccgccactctttgcgaacaggtctgtctgcctcaaacctttccttgagaggagaatcacctttatctcttcttctnggtcatcttcttccttcttcaagagctggaacccctgcaggctcaaggtgtacaaccccagtacccacccctcaaaacagtcctccttctagccctagcatcagccgcctgacctccagaagttcccaanagagtcagcgtcaggccccagaactactggtttcacctgccagtgatgatattcccacagtagtaattcatccgcctgaggaagacttagaagcagcgctgaaggcgaggagcagaagaatgaggaaaatgttgacttaactccaggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagacgatgatgatactgtgcaccttccatttgaagggggaagtctcttgcaaattccagtcaaggccctaaaatatagtggtgatccctcaattggtaacatatcagatgaaatggccaaaactgcacagtggaaggcactttccatgaatactgagaatgccaaagtaaccagatctaacatgagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagactatgtatttaatgaaatgctctctttgaagtgaggtacatggttcttaactattcaaatatttattctgttagaaaaaaaaattttctgttttgcaatagaaggatgtggagaaatgctttcagtctacttttcttaaatctctgttcatcagtggcaattcgtaaaaaccttaagtgatactttgtttatatgtttataatttttaggtgtttcctgaaattttcacatattatttcacttttgttagtgctttatgggaagaatagggagtctataccagtgctgtgggaaaaatggtaacatttcagggcttctctatttgtgtttcatttctgtagatgtccatcgtgtttcactaactggcgttttcttagccatagagatgactgtagaacaatagaaactttaataatgatagtttttaacttttatgtttaaattttttttaaatcttaaaaccttcatatctaggtatccattgtgacagacaagtaaaattgcaggtgatttgataattaagcacccataccatttataacttctgaatttaaaaagttatacaatgccagtttgcaatagttgattttgatgcctttgtagaatattttttctgaatccttatgctcttttaaagccaatgattcccactctgttctctgccttgtctctctttgtcttaaaatgctttagtttccatcaggttcaagttcttgactattattctcttataagtagtaggcgtaaataatcaggagttagaattctctcagaagggtctatgatcagtattactttattaagaattacctttcattttctctttatgttattctttcacttttgtagattacatttaatagcttgttacctgtgattttattttaaaatatttattttgatatgatgcttaaatattatataaacatttggaaaagtaacaaatagagtaaattgttaatgtaaatagttggtgcttactttcatttatgtttattatcttaaagcaattgatagattttacatctttgatataaagcactgccatatttatattttaaaaggaaattagacattttatatgtagctcagattaatgacatttttattttgtgtattagtttttgcttttctgagctttttaaagtctaacaaatctttttagtcatcttttatatacttttagttccacatgaaataaatgttgttaagcctgtaggactggatgaatggggttgtgaaactgatttgacaagagaataatttacaaaaatcaaatgagtattgagaagccacagaaatatcaaaaatggtgacatcactattaggatgaaaattttatgaaattccaatgctccctttaaccatataattaaattacaaaggtatacataattaatctaataaaggatcatgaggaatgccaaaagctgaaattttagcaagtctggtgttttaaattcattataaactatttattaactaatgtaatgtcctcctctaagaccatattgtaagagtcttgttaaaatgatggattcaacttctgcctcggatgagaggttggaaatgtagctgcttttctttagaaaatatgtagctgtcatcatttggtactgcctaaaaagagttagactctattggcaattgatagagtattacccacggtgcttattattgtttatgagcttccattgtaatgattcctttttatttgtagcagcataattatttccaaagaccccagtatttgctgctatttttaaaactcccctgatgtacctgaacaagaggatttcctcacatcatttccttgtgtctggacatcaggggtaacaactgtacttactttacaggaagaaattttaaaactgaaaactacctgggatcatagtgtttctgtgattttatttaattgtgtatagtaattatccagtgccagaaaaaccgtcacttgcaaaatactttgcactcaaaatgtttttacaatgcttctaaatgttactggtttctgctttcttttgactacttgactgacaaaatgatctgactactccatttaagagcaaaggtaactcatgtttaagtaattaactgcttgttttaagtgattatatttcttccactgtttttgaaaaataatcaaagatagcattcattgagagacagtgacagatataatttactacatatattgatttttaaataaagttgccttaaataagtgtatgtaagcagtagtagttgctatgtactgatttacctcaaggtgcaaaataattaaacctgtacatattccatttacaaaataaattcagccctgcactttctttagatgccttgatttccagaatggagcttagtgctactgaataccctggccacagagccacctcaggatattcttttctccaccctagtttatttatttatagatatctgtttacaaagtctgtagtaaatcctgatgctgaccatctgaaatgtactttttttctgaatgctgtttcaatctaaaatagcagcttttgagaaaacaatgatgtaaattccttatgataaaaggatgattctatatattctttaatgatattaaatatgccgaagccaagcacacagtctttctaaagtgtgtgtatgtttgtgtgaatgtgaatgatactgatcttatatctgttaaaagttgttttaaaaagctgtggcatcccattgttcatatttgccaagtcttctgtaaagatgtctaggacgaaatattttatgtgctaatgcatgtatttgtaaaccagatttgtttaccactcaaaattaacttgttttcttcatccaaaaaagtttatttcttccacgtacttaaattttctgtgtgggtataatatagctttctaatttttttctttcacaaaggcaggttcaaaattctgttgaaagaaaaatgctttctgaaactgaggtataacaccagagcttgctgtttaaaggattatatgatgtacatcagttctataaatgtgctcagcagtttaacatgtgaatcctgttttaaagtgctcagatttcaactgtgtaagccattgatataacgctgtaattaaaaatgtttatatgaaataacttaatgttttaaatttatttatgtagatcacatcatttttatcgtatgcagtgcaaatatgtgaaatgtcttttggtttattccaacaattatttattttagaaagtaagtttaaagactttaaggacattcaaagtttaaaatagtgttcaaattgcaaaatttggcaatcttcatataaattggtttcttttctaacttttcaaaaactaacattaaatgtcaattataggaaaacatagttggaaatgtaatcatccaaagatcatttttaaaatgaaatttaattagcacatattgaacatttgacttaattgttaaaccccagttttgttttgtttttttaatcagatttttgcacactgattagtttttgtgttgtggcttttgttgctttattattcaaggttttttttttttttcttccccatgggggagattgtcttccaatgtttaactacgtttaaataaataaaaattgaattttattgttcatttatataaaatctgataccttgatgtaatttcacaatacagttccaatttttatggcttttataattacaatgatattttcttctataataaaatccaaagtaaacatttaaattgtagaactgatatttttcatttatatgaagtataagcctctactgggtctatattgtgaatcatcctgcctttcaaatttgtttcataattgttagatgaaaactatttttttggagatgttactgaagttgattgagcaataaaagtctacttaattagttgttggctat

SEQ ID NO: 135545 - DNA, 4919 bp, Homo sapiens
ggttgcgcttccaattaggtgcatgagtaggtggcctccagtaatgttagcggttaggcgtacggcccgggctattggttgaatgggtaggctgatggtttcgggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagacgatgatgatactgtgcaccttccatttgaagggggaagtctcttgcaaattccagtcaaggccctaaaatatagtggtgatccctcaattggtaacatatcagatgaaatggccaaaactgcacagtggaaggcactttccatgaatactgagaatgccaaagtaaccagatctaacatgagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagactatgtatttaatgaaatgctctctttgaagtgaggtacatggttcttaactattcaaatatttattctgttagaaaaaaaaattttctgttttgcaatagaaggatgtggagaaatgctttcagtctacttttcttaaatctctgttcatcagtggcaattcgtaaaaaccttaagtgatactttgtttatatgtttataatttttaggtgtttcctgaaattttcacatattatttcacttttgttagtgctttatgggaagaatagggagtctataccagtgctgtgggaaaaatggtaacatttcagggcttctctatttgtgtttcatttctgtagatgtccatcgtgtttcactaactggcgttttcttagccatagagatgactgtagaacaatagaaactttaataatgatagtttttaacttttatgtttaaattttttttaaatcttaaaaccttcatatctaggtatccattgtgacagacaagtaaaattgcaggtgatttgataattaagcacccataccatttataacttctgaatttaaaaagttatacaatgccagtttgcaatagttgattttgatgcctttgtagaatattttttctgaatccttatgctcttttaaagccaatgattcccactctgttctctgccttgtctctctttgtcttaaaatgctttagtttccatcaggttcaagttcttgactattattctcttataagtagtaggcgtaaataatcaggagttagaattctctcagaagggtctatgatcagtattactttattaagaattacctttcattttctctttatgttattctttcacttttgtagattacatttaatagcttgttacctgtgattttattttaaaatatttattttgatatgatgcttaaatattatataaacatttggaaaagtaacaaatagagtaaattgttaatgtaaatagttggtgcttactttcatttatgtttattatcttaaagcaattgatagattttacatctttgatataaagcactgccatatttatattttaaaaggaaattagacattttatatgtagctcagattaatgacatttttattttgtgtattagtttttgcttttctgagctttttaaagtctaacaaatctttttagtcatcttttatatacttttagttccacatgaaataaatgttgttaagcctgtaggactggatgaatggggttgtgaaactgatttgacaagagaataatttacaaaaatcaaatgagtattgagaagccacagaaatatcaaaaatggtgacatcactattaggatgaaaattttatgaaattccaatgctccctttaaccatataattaaattacaaaggtatacataattaatctaataaaggatcatgaggaatgccaaaagctgaaattttagcaagtctggtgttttaaattcattataaactatttattaactaatgtaatgtcctcctctaagaccatattgtaagagtcttgttaaaatgatggattcaacttctgcctcggatgagaggttggaaatgtagctgcttttctttagaaaatatgtagctgtcatcatttggtactgcctaaaaagagttagactctattggcaattgatagagtattacccacggtgcttattattgtttatgagcttccattgtaatgattcctttttatttgtagcagcataattatttccaaagaccccagtatttgctgctatttttaaaactcccctgatgtacctgaacaagaggatttcctcacatcatttccttgtgtctggacatcaggggtaacaactgtacttactttacaggaagaaattttaaaactgaaaactacctgggatcatagtgtttctgtgattttatttaattgtgtatagtaattatccagtgccagaaaaaccgtcacttgcaaaatactttgcactcaaaatgtttttacaatgcttctaaatgttactggtttctgctttcttttgactacttgactgacaaaatgatctgactactccatttaagagcaaaggtaactcatgtttaagtaattaactgcttgttttaagtgattatatttcttccactgtttttgaaaaataatcaaagatagcattcattgagagacagtgacagatataatttactacatatattgatttttaaataaagttgccttaaataagtgtatgtaagcagtagtagttgctatgtactgatttacctcaaggtgcaaaataattaaacctgtacatattccatttacaaaataaattcagccctgcactttctttagatgccttgatttccagaatggagcttagtgctactgaataccctggccacagagccacctcaggatattcttttctccaccctagtttatttatttatagatatctgtttacaaagtctgtagtaaatcctgatgctgaccatctgaaatgtactttttttctgaatgctgtttcaatctaaaatagcagcttttgagaaaacaatgatgtaaattccttatgataaaaggatgattctatatattctttaatgatattaaatatgccgaagccaagcacacagtctttctaaagtgtgtgtatgtttgtgtgaatgtgaatgatactgatcttatatctgttaaaagttgttttaaaaagctgtggcatcccattgttcatatttgccaagtcttctgtaaagatgtctaggacgaaatattttatgtgctaatgcatgtatttgtaaaccagatttgtttaccactcaaaattaacttgttttcttcatccaaaaaagtttatttcttccacgtacttaaattttctgtgtgggtataatatagctttctaatttttttctttcacaaaggcaggttcaaaattctgttgaaagaaaaatgctttctgaaactgaggtataacaccagagcttgctgtttaaaggattatatgatgtacatcagttctataaatgtgctcagcagtttaacatgtgaatcctgttttaaagtgctcagatttcaactgtgtaagccattgatataacgctgtaattaaaaatgtttatatgaaataacttaatgttttaaatttatttatgtagatcacatcatttttatcgtatgcagtgcaaatatgtgaaatgtcttttggtttattccaacaattatttattttagaaagtaagtttaaagactttaaggacattcaaagtttaaaatagtgttcaaattgcaaaatttggcaatcttcatataaattggtttcttttctaacttttcaaaaactaacattaaatgtcaattataggaaaacatagttggaaatgtaatcatccaaagatcatttttaaaatgaaatttaattagcacatattgaacatttgacttaattgttaaaccccagttttgttttgtttttttaatcagatttttgcacactgattagtttttgtgttgtggcttttgttgctttattattcaaggttttttttttttttcttccccatgggggagattgtcttccaatgtttaactacgtttaaataaataaaaattgaattttattgttcatttatataaaatctgataccttgatgtaatttcacaatacagttccaatttttatggcttttataattacaatgatattttcttctataataaaatccaaagtaaacatttaaattgtagaactgatatttttcatttatatgaagtataagcctctactgggtctatattgtgaatcatcctgcctttcaaatttgtttcataattgttagatgaaaactatttttttggagatgttactgaagttgattgagcaataaaagtctacttaattagttgttggctat

SEQ ID NO: 135546 - DNA, 4818 bp, Homo sapiens
atggtgttgtgactgcttgatgagtgggttatcacagggctaatgatttcaattcctcaatagggccatcgtctgctggttcatgacttcagctcctaaatgtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagacgatgatgatactgtgcaccttccatttgaagggggaagtctcttgcaaattccagtcaaggccctaaaatatagtggtgatccctcaattggtaacatatcagatgaaatggccaaaactgcacagtggaaggcactttccatgaatactgagaatgccaaagtaaccagatctaacatgagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagactatgtatttaatgaaatgctctctttgaagtgaggtacatggttcttaactattcaaatatttattctgttagaaaaaaaaattttctgttttgcaatagaaggatgtggagaaatgctttcagtctacttttcttaaatctctgttcatcagtggcaattcgtaaaaaccttaagtgatactttgtttatatgtttataatttttaggtgtttcctgaaattttcacatattatttcacttttgttagtgctttatgggaagaatagggagtctataccagtgctgtgggaaaaatggtaacatttcagggcttctctatttgtgtttcatttctgtagatgtccatcgtgtttcactaactggcgttttcttagccatagagatgactgtagaacaatagaaactttaataatgatagtttttaacttttatgtttaaattttttttaaatcttaaaaccttcatatctaggtatccattgtgacagacaagtaaaattgcaggtgatttgataattaagcacccataccatttataacttctgaatttaaaaagttatacaatgccagtttgcaatagttgattttgatgcctttgtagaatattttttctgaatccttatgctcttttaaagccaatgattcccactctgttctctgccttgtctctctttgtcttaaaatgctttagtttccatcaggttcaagttcttgactattattctcttataagtagtaggcgtaaataatcaggagttagaattctctcagaagggtctatgatcagtattactttattaagaattacctttcattttctctttatgttattctttcacttttgtagattacatttaatagcttgttacctgtgattttattttaaaatatttattttgatatgatgcttaaatattatataaacatttggaaaagtaacaaatagagtaaattgttaatgtaaatagttggtgcttactttcatttatgtttattatcttaaagcaattgatagattttacatctttgatataaagcactgccatatttatattttaaaaggaaattagacattttatatgtagctcagattaatgacatttttattttgtgtattagtttttgcttttctgagctttttaaagtctaacaaatctttttagtcatcttttatatacttttagttccacatgaaataaatgttgttaagcctgtaggactggatgaatggggttgtgaaactgatttgacaagagaataatttacaaaaatcaaatgagtattgagaagccacagaaatatcaaaaatggtgacatcactattaggatgaaaattttatgaaattccaatgctccctttaaccatataattaaattacaaaggtatacataattaatctaataaaggatcatgaggaatgccaaaagctgaaattttagcaagtctggtgttttaaattcattataaactatttattaactaatgtaatgtcctcctctaagaccatattgtaagagtcttgttaaaatgatggattcaacttctgcctcggatgagaggttggaaatgtagctgcttttctttagaaaatatgtagctgtcatcatttggtactgcctaaaaagagttagactctattggcaattgatagagtattacccacggtgcttattattgtttatgagcttccattgtaatgattcctttttatttgtagcagcataattatttccaaagaccccagtatttgctgctatttttaaaactcccctgatgtacctgaacaagaggatttcctcacatcatttccttgtgtctggacatcaggggtaacaactgtacttactttacaggaagaaattttaaaactgaaaactacctgggatcatagtgtttctgtgattttatttaattgtgtatagtaattatccagtgccagaaaaaccgtcacttgcaaaatactttgcactcaaaatgtttttacaatgcttctaaatgttactggtttctgctttcttttgactacttgactgacaaaatgatctgactactccatttaagagcaaaggtaactcatgtttaagtaattaactgcttgttttaagtgattatatttcttccactgtttttgaaaaataatcaaagatagcattcattgagagacagtgacagatataatttactacatatattgatttttaaataaagttgccttaaataagtgtatgtaagcagtagtagttgctatgtactgatttacctcaaggtgcaaaataattaaacctgtacatattccatttacaaaataaattcagccctgcactttctttagatgccttgatttccagaatggagcttagtgctactgaataccctggccacagagccacctcaggatattcttttctccaccctagtttatttatttatagatatctgtttacaaagtctgtagtaaatcctgatgctgaccatctgaaatgtactttttttctgaatgctgtttcaatctaaaatagcagcttttgagaaaacaatgatgtaaattccttatgataaaaggatgattctatatattctttaatgatattaaatatgccgaagccaagcacacagtctttctaaagtgtgtgtatgtttgtgtgaatgtgaatgatactgatcttatatctgttaaaagttgttttaaaaagctgtggcatcccattgttcatatttgccaagtcttctgtaaagatgtctaggacgaaatattttatgtgctaatgcatgtatttgtaaaccagatttgtttaccactcaaaattaacttgttttcttcatccaaaaaagtttatttcttccacgtacttaaattttctgtgtgggtataatatagctttctaatttttttctttcacaaaggcaggttcaaaattctgttgaaagaaaaatgctttctgaaactgaggtataacaccagagcttgctgtttaaaggattatatgatgtacatcagttctataaatgtgctcagcagtttaacatgtgaatcctgttttaaagtgctcagatttcaactgtgtaagccattgatataacgctgtaattaaaaatgtttatatgaaataacttaatgttttaaatttatttatgtagatcacatcatttttatcgtatgcagtgcaaatatgtgaaatgtcttttggtttattccaacaattatttattttagaaagtaagtttaaagactttaaggacattcaaagtttaaaatagtgttcaaattgcaaaatttggcaatcttcatataaattggtttcttttctaacttttcaaaaactaacattaaatgtcaattataggaaaacatagttggaaatgtaatcatccaaagatcatttttaaaatgaaatttaattagcacatattgaacatttgacttaattgttaaaccccagttttgttttgtttttttaatcagatttttgcacactgattagtttttgtgttgtggcttttgttgctttattattcaaggttttttttttttttcttccccatgggggagattgtcttccaatgtttaactacgtttaaataaataaaaattgaattttattgttcatttatataaaatctgataccttgatgtaatttcacaatacagttccaatttttatggcttttataattacaatgatattttcttctataataaaatccaaagtaaacatttaaattgtagaactgatatttttcatttatatgaagtataagcctctactgggtctatattgtgaatcatcctgcctttcaaatttgtttcataattgttagatgaaaactatttttttggagatgttactgaagttgattgagcaataaaagtctacttaattagttgttggctat

SEQ ID NO: 135547 - DNA, 594 bp, Homo sapiens
ccttggagactagaaagaaactgctagatggctgtaacacagttcatccatttccgtgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggtgagataagttgtggcatccaatttttgctaacacttctactgtaacagctttccagtatgttacgattaacatttggggatatt

SEQ ID NO: 135548 - DNA, 7191 bp, Homo sapiens
ccttggagactagaaagaaactgctagatggctgtaacacagttcatccatttccgtgaagagatcatggggaatatgttcttcatcatcatcttcagtaccaaggataaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagacgatgatgatactgtgcaccttccatttgaagggggaagtctcttgcaaattccagtcaaggccctaaaatatagtggtgatccctcaattggtaacatatcagatgaaatggccaaaactgcacagtggaaggcactttccatgaatactgagaatgccaaagtaaccagatctaacatgagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagactatgtatttaatgaaatgctctctttgaagtgaggtacatggttcttaactattcaaatatttattctgttagaaaaaaaaattttctgttttgcaatagaaggatgtggagaaatgctttcagtctacttttcttaaatctctgttcatcagtggcaattcgtaaaaaccttaagtgatactttgtttatatgtttataatttttaggtgtttcctgaaattttcacatattatttcacttttgttagtgctttatgggaagaatagggagtctataccagtgctgtgggaaaaatggtaacatttcagggcttctctatttgtgtttcatttctgtagatgtccatcgtgtttcactaactggcgttttcttagccatagagatgactgtagaacaatagaaactttaataatgatagtttttaacttttatgtttaaattttttttaaatcttaaaaccttcatatctaggtatccattgtgacagacaagtaaaattgcaggtgatttgataattaagcacccataccatttataacttctgaatttaaaaagttatacaatgccagtttgcaatagttgattttgatgcctttgtagaatattttttctgaatccttatgctcttttaaagccaatgattcccactctgttctctgccttgtctctctttgtcttaaaatgctttagtttccatcaggttcaagttcttgactattattctcttataagtagtaggcgtaaataatcaggagttagaattctctcagaagggtctatgatcagtattactttattaagaattacctttcattttctctttatgttattctttcacttttgtagattacatttaatagcttgttacctgtgattttattttaaaatatttattttgatatgatgcttaaatattatataaacatttggaaaagtaacaaatagagtaaattgttaatgtaaatagttggtgcttactttcatttatgtttattatcttaaagcaattgatagattttacatctttgatataaagcactgccatatttatattttaaaaggaaattagacattttatatgtagctcagattaatgacatttttattttgtgtattagtttttgcttttctgagctttttaaagtctaacaaatctttttagtcatcttttatatacttttagttccacatgaaataaatgttgttaagcctgtaggactggatgaatggggttgtgaaactgatttgacaagagaataatttacaaaaatcaaatgagtattgagaagccacagaaatatcaaaaatggtgacatcactattaggatgaaaattttatgaaattccaatgctccctttaaccatataattaaattacaaaggtatacataattaatctaataaaggatcatgaggaatgccaaaagctgaaattttagcaagtctggtgttttaaattcattataaactatttattaactaatgtaatgtcctcctctaagaccatattgtaagagtcttgttaaaatgatggattcaacttctgcctcggatgagaggttggaaatgtagctgcttttctttagaaaatatgtagctgtcatcatttggtactgcctaaaaagagttagactctattggcaattgatagagtattacccacggtgcttattattgtttatgagcttccattgtaatgattcctttttatttgtagcagcataattatttccaaagaccccagtatttgctgctatttttaaaactcccctgatgtacctgaacaagaggatttcctcacatcatttccttgtgtctggacatcaggggtaacaactgtacttactttacaggaagaaattttaaaactgaaaactacctgggatcatagtgtttctgtgattttatttaattgtgtatagtaattatccagtgccagaaaaaccgtcacttgcaaaatactttgcactcaaaatgtttttacaatgcttctaaatgttactggtttctgctttcttttgactacttgactgacaaaatgatctgactactccatttaagagcaaaggtaactcatgtttaagtaattaactgcttgttttaagtgattatatttcttccactgtttttgaaaaataatcaaagatagcattcattgagagacagtgacagatataatttactacatatattgatttttaaataaagttgccttaaataagtgtatgtaagcagtagtagttgctatgtactgatttacctcaaggtgcaaaataattaaacctgtacatattccatttacaaaataaattcagccctgcactttctttagatgccttgatttccagaatggagcttagtgctactgaataccctggccacagagccacctcaggatattcttttctccaccctagtttatttatttatagatatctgtttacaaagtctgtagtaaatcctgatgctgaccatctgaaatgtactttttttctgaatgctgtttcaatctaaaatagcagcttttgagaaaacaatgatgtaaattccttatgataaaaggatgattctatatattctttaatgatattaaatatgccgaagccaagcacacagtctttctaaagtgtgtgtatgtttgtgtgaatgtgaatgatactgatcttatatctgttaaaagttgttttaaaaagctgtggcatcccattgttcatatttgccaagtcttctgtaaagatgtctaggacgaaatattttatgtgctaatgcatgtatttgtaaaccagatttgtttaccactcaaaattaacttgttttcttcatccaaaaaagtttatttcttccacgtacttaaattttctgtgtgggtataatatagctttctaatttttttctttcacaaaggcaggttcaaaattctgttgaaagaaaaatgctttctgaaactgaggtataacaccagagcttgctgtttaaaggattatatgatgtacatcagttctataaatgtgctcagcagtttaacatgtgaatcctgttttaaagtgctcagatttcaactgtgtaagccattgatataacgctgtaattaaaaatgtttatatgaaataacttaatgttttaaatttatttatgtagatcacatcatttttatcgtatgcagtgcaaatatgtgaaatgtcttttggtttattccaacaattatttattttagaaagtaagtttaaagactttaaggacattcaaagtttaaaatagtgttcaaattgcaaaatttggcaatcttcatataaattggtttcttttctaacttttcaaaaactaacattaaatgtcaattataggaaaacatagttggaaatgtaatcatccaaagatcatttttaaaatgaaatttaattagcacatattgaacatttgacttaattgttaaaccccagttttgttttgtttttttaatcagatttttgcacactgattagtttttgtgttgtggcttttgttgctttattattcaaggttttttttttttttcttccccatgggggagattgtcttccaatgtttaactacgtttaaataaataaaaattgaattttattgttcatttatataaaatctgataccttgatgtaatttcacaatacagttccaatttttatggcttttataattacaatgatattttcttctataataaaatccaaagtaaacatttaaattgtagaactgatatttttcatttatatgaagtataagcctctactgggtctatattgtgaatcatcctgcctttcaaatttgtttcataattgttagatgaaaactatttttttggagatgttactgaagttgattgagcaataaaagtctacttaattagttgttggctat

SEQ ID NO: 135549 - DNA, 8095 bp, Homo sapiens
  misc_feature (1136)..(1136): n is a, c, g, or t
  misc_feature (1266)..(1266): n is a, c, g, or t
ggtccgccggttcgctcagttctagcttcaggttccacgccgcggcctcgctctcctactagagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggaggagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggggaaggcctttcagcctcccgccactctttgcgaacaggtctgtctgcctcaaacctttccttgagaggagaatcacctttatctcttcttctnggtcatcttcttccttcttcaagagctggaacccctgcaggctcaaggtgtacaaccccagtacccacccctcaaaacagtcctccttctagccctagcatcagccgcctgacctccagaagttcccaanagagtcagcgtcaggccccagaactactggtttcacctgccagtgatgatattcccacagtagtaattcatccgcctgaggaagacttagaagcagcgctgaaggcgaggagcagaagaatgaggaaaatgttgacttaactccaggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagacgatgatgatactgtgcaccttccatttgaagggggaagtctcttgcaaattccagtcaaggccctaaaatatagtggtgatccctcaattggtaacatatcagatgaaatggccaaaactgcacagtggaaggcactttccatgaatactgagaatgccaaagtaaccagatctaacatgagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagactatgtatttaatgaaatgctctctttgaagtgaggtacatggttcttaactattcaaatatttattctgttagaaaaaaaaattttctgttttgcaatagaaggatgtggagaaatgctttcagtctacttttcttaaatctctgttcatcagtggcaattcgtaaaaaccttaagtgatactttgtttatatgtttataatttttaggtgtttcctgaaattttcacatattatttcacttttgttagtgctttatgggaagaatagggagtctataccagtgctgtgggaaaaatggtaacatttcagggcttctctatttgtgtttcatttctgtagatgtccatcgtgtttcactaactggcgttttcttagccatagagatgactgtagaacaatagaaactttaataatgatagtttttaacttttatgtttaaattttttttaaatcttaaaaccttcatatctaggtatccattgtgacagacaagtaaaattgcaggtgatttgataattaagcacccataccatttataacttctgaatttaaaaagttatacaatgccagtttgcaatagttgattttgatgcctttgtagaatattttttctgaatccttatgctcttttaaagccaatgattcccactctgttctctgccttgtctctctttgtcttaaaatgctttagtttccatcaggttcaagttcttgactattattctcttataagtagtaggcgtaaataatcaggagttagaattctctcagaagggtctatgatcagtattactttattaagaattacctttcattttctctttatgttattctttcacttttgtagattacatttaatagcttgttacctgtgattttattttaaaatatttattttgatatgatgcttaaatattatataaacatttggaaaagtaacaaatagagtaaattgttaatgtaaatagttggtgcttactttcatttatgtttattatcttaaagcaattgatagattttacatctttgatataaagcactgccatatttatattttaaaaggaaattagacattttatatgtagctcagattaatgacatttttattttgtgtattagtttttgcttttctgagctttttaaagtctaacaaatctttttagtcatcttttatatacttttagttccacatgaaataaatgttgttaagcctgtaggactggatgaatggggttgtgaaactgatttgacaagagaataatttacaaaaatcaaatgagtattgagaagccacagaaatatcaaaaatggtgacatcactattaggatgaaaattttatgaaattccaatgctccctttaaccatataattaaattacaaaggtatacataattaatctaataaaggatcatgaggaatgccaaaagctgaaattttagcaagtctggtgttttaaattcattataaactatttattaactaatgtaatgtcctcctctaagaccatattgtaagagtcttgttaaaatgatggattcaacttctgcctcggatgagaggttggaaatgtagctgcttttctttagaaaatatgtagctgtcatcatttggtactgcctaaaaagagttagactctattggcaattgatagagtattacccacggtgcttattattgtttatgagcttccattgtaatgattcctttttatttgtagcagcataattatttccaaagaccccagtatttgctgctatttttaaaactcccctgatgtacctgaacaagaggatttcctcacatcatttccttgtgtctggacatcaggggtaacaactgtacttactttacaggaagaaattttaaaactgaaaactacctgggatcatagtgtttctgtgattttatttaattgtgtatagtaattatccagtgccagaaaaaccgtcacttgcaaaatactttgcactcaaaatgtttttacaatgcttctaaatgttactggtttctgctttcttttgactacttgactgacaaaatgatctgactactccatttaagagcaaaggtaactcatgtttaagtaattaactgcttgttttaagtgattatatttcttccactgtttttgaaaaataatcaaagatagcattcattgagagacagtgacagatataatttactacatatattgatttttaaataaagttgccttaaataagtgtatgtaagcagtagtagttgctatgtactgatttacctcaaggtgcaaaataattaaacctgtacatattccatttacaaaataaattcagccctgcactttctttagatgccttgatttccagaatggagcttagtgctactgaataccctggccacagagccacctcaggatattcttttctccaccctagtttatttatttatagatatctgtttacaaagtctgtagtaaatcctgatgctgaccatctgaaatgtactttttttctgaatgctgtttcaatctaaaatagcagcttttgagaaaacaatgatgtaaattccttatgataaaaggatgattctatatattctttaatgatattaaatatgccgaagccaagcacacagtctttctaaagtgtgtgtatgtttgtgtgaatgtgaatgatactgatcttatatctgttaaaagttgttttaaaaagctgtggcatcccattgttcatatttgccaagtcttctgtaaagatgtctaggacgaaatattttatgtgctaatgcatgtatttgtaaaccagatttgtttaccactcaaaattaacttgttttcttcatccaaaaaagtttatttcttccacgtacttaaattttctgtgtgggtataatatagctttctaatttttttctttcacaaaggcaggttcaaaattctgttgaaagaaaaatgctttctgaaactgaggtataacaccagagcttgctgtttaaaggattatatgatgtacatcagttctataaatgtgctcagcagtttaacatgtgaatcctgttttaaagtgctcagatttcaactgtgtaagccattgatataacgctgtaattaaaaatgtttatatgaaataacttaatgttttaaatttatttatgtagatcacatcatttttatcgtatgcagtgcaaatatgtgaaatgtcttttggtttattccaacaattatttattttagaaagtaagtttaaagactttaaggacattcaaagtttaaaatagtgttcaaattgcaaaatttggcaatcttcatataaattggtttcttttctaacttttcaaaaactaacattaaatgtcaattataggaaaacatagttggaaatgtaatcatccaaagatcatttttaaaatgaaatttaattagcacatattgaacatttgacttaattgttaaaccccagttttgttttgtttttttaatcagatttttgcacactgattagtttttgtgttgtggcttttgttgctttattattcaaggttttttttttttttcttccccatgggggagattgtcttccaatgtttaactacgtttaaataaataaaaattgaattttattgttcatttatataaaatctgataccttgatgtaatttcacaatacagttccaatttttatggcttttataattacaatgatattttcttctataataaaatccaaagtaaacatttaaattgtagaactgatatttttcatttatatgaagtataagcctctactgggtctatattgtgaatcatcctgcctttcaaatttgtttcataattgttagatgaaaactatttttttggagatgttactgaagttgattgagcaataaaagtctacttaattagttgttggctat

SEQ ID NO: 135550 - DNA, 1127 bp, Homo sapiens
ggtccgccggttcgctcagttctagcttcaggttccacgccgcggcctcgctctcctactagagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggaggagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggtgagataagttgtggcatccaatttttgctaacacttctactgtaacagctttccagtatgttacgattaacatttggggatatt

SEQ ID NO: 135551 - DNA, 143 bp, Homo sapiens
agaagcagagttgaggcttgttcaggaaaaccttgtgaccaagagataccaaacaaccttatatttggccacaaactaaagggctgcctgagctcttacttccatgaaactaattaaaaaataagaagagcatggggtgatca

SEQ ID NO: 135552 - DNA, 705 bp, Homo sapiens
taaattcaacaagggaaagaagatgagaaaagtgagagaagaggtaacaggagatggaaaggggaatacacaggaagggtcacaggcacagccagagaagcagcagcaaaggacaacaccaaatgaaaacaagcaggagacaaaacagctccaccgacacgggaggagaaagtatctctggcgtgaggaggggactggacaggtgcactaactgtactctcaactttgtgcagaataacaaatatcagaaaatgtcctaactaggttaagctttaaatacatatttttaagaacatgatcaatcacataggcacagcatggaggaagaagctaacctggtatggttcatctggaggcagcaatgttcatctcaggattctacaggtaacatgacccaagcatgctacaaccagcccacgtatccttcaggataacagcagctgtggcttcacacatgaacaatgcaggaaacagaaacccaggcccctgcactggagacagggatgccacaacacattccagttcccccaaaatatacacagtataaagactgctgttatgaggacagtgaaacagtatattcaagctccaaggaaagaaagggtatgagccaaacatttaaaagaacccaagttttcctcagattataagagcaaagggcaggcattctcacctaggaagaaatcgtgaagcaaaccctcatga

SEQ ID NO: 135553 - DNA, 193 bp, Homo sapiens
cttaaattcaatgatttaaaacacacacacatactttagagataatcagaagcaaatatttttttaaatgccagaatatacacataagcatagttaaataaaaaaaaatgttcactctgttgatgttaaagtccatggactcaaatctctttggacaattgggttcaaaatttttcacactgagatatattta

SEQ ID NO: 135554 - DNA, 332 bp, Homo sapiens
ttgtgtcctctttgtgtgtgtgtgtgacaaggatacttaacacaagatctctctcaataaatttttaagtatataatactttactgttcactataggtatcacgttgtacaggagatctctggaacttattcatcttgaataaatttatatttattgagtaacagctctcgttatccccctgattccatgcccttccaccattctattctctatcgccatactgttgattattttagatgcctttttatacgagaaatcatgcagtatttgctgatattacctatctcctgttgttttcttgttaaaaagaaaacatcccttgtgagggata

SEQ ID NO: 135555 - DNA, 489 bp, Homo sapiens
gtcacaaaagggcaaatactgtgtgtgattccacttacatgaggtaccaacaatagccaaattcaggaagacagcaattagaatggggtctccaggccaggtggaggagtggggaattattcagagttactgcttaatgggtacagagtatcagttggggaagatggaaaagttctggaaatggataatggtgatggttgcagaacagtgtgaatgtacttcatgccactgaattgtacacttaaaatggttaaaatggtaaatttgatgttatctatatggaaccacagttttttataaaaggatgaaactcagaaagccagagtcacctcaaaggtctctgctgctgctcaggcgtcagcctactgtgaatggacgggattgtgggaacgaagccttagataaggtattagagctggttatatgccattccacaggaaaggccatcgtaatccagagggagtcaaaactaatgacaccttccgatgg

SEQ ID NO: 135556 - DNA, 520 bp, Homo sapiens
gtcttttcatttaatcctcacaaccaccctgcaaggtgattttcatcatgtctaatttacagaaggagaaactgtggcttgcccaaggtcacaaaactaacaaaggattcaaatccaggaacgtcagatcatgatgcctttgccgtctgcattgagcgccgcagccctaattggttagcttgcgccacctagtggcagaactaaaacaggaaccaggtcagcctgcaacaaatattaaagcagcaggctgcacccttcaacggggcttgtgaaacctggagaagcacaggcacgcctgtgacccacactcactccaaccccacaactgataaaagacaacgcaaggcccagaatcagataacctgggaaagtgtgttgtaaatgaagcatcatttcctcttgaaatacattttttgtcttcctgtactgggaacataaaagtccctcaccatccccttgacctctcagcatttccagggcttccctcgacctcagtctgctgtccccctcccggacccag

SEQ ID NO: 135557 - DNA, 483 bp, Homo sapiens
cgatgcctgtttgctggagaggtagactgaggcagggagaagtgaaaagacttgccttgggccatcagcttcagagtccgctctgcctgactccacacatccttctcctttctggctgtctcatttgtgacacttctacatttctcctgcttcgggctgggaattccccgagggacagccctgagccacctctctgtcttatctctgccagggatgcaggagacagggagccttggtgaaggtctttcgttttttcgtttgtttgtttttgttttgttttgttttgtttcagacagagtctcgctctgtcacccctgccagagtgcaatggcactatctcggctcactgtaacctctgcctcctgggttcaagcaattctccttgcctcagcctcccgagtagtggatcacttggggccaggagtttgagaccagcctggccaacatggcaaaatgccgtctctactaaaaatacaaaaatta

SEQ ID NO: 135558 - DNA, 184 bp, Homo sapiens
cattctgggcaggcagagcagccgcgggaaagggaccatctcattcattcggcaaatcagcaaacaccatctgagcgtatgctctgtcaggacgcagggcacgggtggcagaacggatgtagttgacagaaatgcagtgatctctactatcttctgctcttgtaaaaccttgattccttaccgc

SEQ ID NO: 135559 - DNA, 725 bp, Homo sapiens
tccacagcattggtgagacaaagtattggatctgcattcttttcttttctggctcagaagcttatgtagttagcatgttccttaatataagatcttccgaaacagtgctaatgcaatcaatgggaactgcatttatgtgtcgtcagtcccacatatactgatgcacatatttgtaaggaactgcttgagacactttgctgtcttcctcatgcaaacaagagcacaggtatatgttatcgaaagaaaccagaaatgatctagtaagactaaattgtgcctaaagtaatggaaagaaaaacagcaggccaaggcctggccattatttattgagtgctgacagagaactctgcactctgcccagtgccaggccagacatgagagaagacatgcttttctgcttagtggtcttatcatttcagtgtaagcacatagtgtaacaacttgtctaatgtattttgggctatctgagatctagaataatagattacctaagattcagatcatcttaattaggatgttagcagattgaaatggaatggggttcttgatgcaagcaaatgagtagtaaatacattatcaattctacctcttctgtgcagaaatatttctaaaagccagtatccgatctggttcctttcctgctgaactatataaacatagtcctgatttgcagtacctagggagaactctttctgctactgtggatttttcaatagccccttttt

SEQ ID NO: 135560 - DNA, 268 bp, Homo sapiens
cggtccttatacccgacgatcacagctgattttttttaatacacagatttttttttactattatttttcttacatcttatgatgatcctcattctaagtttttatggtctcctttcctgtctcttctcttacaacttttctttcctaccctattaaaccttcccaacctctaaaagtcccaaagaatcttctgccaactagctaaatcgtttgccttttaggtttgcaacgtaaggaagttcacttacggtgatcactaaggtttttt

SEQ ID NO: 135561 - DNA, 799 bp, Homo sapiens
tattgaaatgtcctcacaacacagcagtctgacttccctcagagcaagtgctctacaagagggaggcagaagttgcaatgacctaacaacagaaatcacaaaccatccttgccacgatattccagtggttacacaggttagccctgttcagcaggagaggggactacacaaaggcatgataccaggaggcaaggaccactgggccatcttggaggctggctagcacaccaaggcacttagaattaacatacatgcaccaaactcctgagcatgactttcaaaacccttcgtcatctgactcctactgcactctaacctcatttcatcccaccctttctcagcccaataaactccagccttcctagcctcctccttctcctcaaaggtgagggatttgtacctatttcagagcctttatattaactgctccctcagactggattaattctctccactcatcattttatcatccagatctgagcataaatagcacctcctcagagaggccaccaagtctaaaaggccatctatcctctttctgtcccagaactcaatttttttggcagaacacttatcaccgtctgacatttgagcacatctggctcagtgttaaactctctggcacaattagtcactacggttaacatacctttaaccttcaaatgcataacctagcccaacaccctggccttgcagttgtggaaactgctcagctcgaaggaccttgtccttcaatctgcctcactcacactctaccatcatcaaactcagctcatcttgtgtcaccaaattcaattca

SEQ ID NO: 135562 - DNA, 357 bp, Homo sapiens
cagggtctcactgtgttgcccaggctggagtgcagtggcttgattgtcactcacagcagccttgaactcctgggctcaagaatcctcccacatcaaactgccggtgttacaggtgtgccactgtgcctggctaatttttaaaaaaaattttgtagagctggggtctcactgtgttgctcagattggtcttgaactcctgggttcaagcaagccttctgccttggcctcccaaagtgctgggattacaagtgtgagccaccgtgcccggcctgttttttaacctgcaaagtcacctgcccactttctccattctttctttttcacttaaaaagccttcttctggtcaagttattttta

SEQ ID NO: 135563 - DNA, 114 bp, Homo sapiens
ggagcatttcaaggctgagtagcatctcatatatactctaaaataagtttgcctaatgactttttagcaccacttgatttatgttttggctaagagttctaaatagtagtagtc

SEQ ID NO: 135564 - DNA, 517 bp, Homo sapiens
ctggcaagtgacagagccaagatttaaacccatgtctctctgccttcaagcccaggcaggcacgttctttccaagacactacattggctctcactttccaagtaggtgcattccaagagggagggaggacatcagcgtccagcagaccccaggcttctcccatctcctctacttgccctatctacatgggacccactgcggtaataggggaaggggacaacctagaaagcagagtgaggattgcctgctcttccaggaagaggtaaacgtttaccaagttaatagcaaacacacttagctggaaagggggctgtgggtaaggggccccagggtagggaggctgagcataggggggcatgggtggctggggcccccccggatatccagggttggggggaggatagttgtccccagacaccaaaaaactcttttcatgggacatggcctcgggttccgcggtccgccccggtggccgggcgccgcaggccggtacgcacggtgtccgctgcgcggccgc

SEQ ID NO: 135565 - DNA, 296 bp, Homo sapiens
attcaactatctatctatctatctatctatctatctatctatctatccatatctttgcactgtatggtgagagcctagaggcaatgacattccagtaacaagcagcacatttggcacccagatcttggttactaaataacattctctggctgggtatggtggctcacacctgtcttccctgcatattgtctatgcctcctcagcacaggcttttgccaaaacttgaaccttagggaatgcaatgccaccaaattcacctgccccaggattgtcactgctgctaccctgcagcatct

SEQ ID NO: 135566 - DNA, 535 bp, Homo sapiens
ctcttattgctgatgggaaccttgtgaaaggacctgcatctcctggacaaaccaagacacctatggcagtgcaggccccaccccctgaaaagcatcacactacttgactgactgaccacgccagcactatggataaacctcaagccttttaggttaactcctgtctgccacagattctcaggaaaagagatcatctttctaaatgcagattcacaggcagatgacagtccatgacctgaataacctcttagtgaagattttcagattctgctccacattctgggatgcttaccagggcttcagatttaggaggagaaagtttattttattttattttatttttattatgacctctatccaggcctcctttccttgcatgcaaaatcagtgtgatagaaaggagaatgaacaacaagcatattgtggtattagtgaaagaagcacctaccatttggaagcccaaagaggaatgtttatttttttaatttttatttttacttgtaaaaataaaatatttaatttatgatcttgaaaa

SEQ ID NO: 135567 - DNA, 540 bp, Homo sapiens
ttagacaaatacagacgctggagctagagaagagttctgttcaatatgtacctcaccaggaaccgtaggcacgaagtggccagactcctcactgtggagtgagagagttgcagagaggcggagaactttaccctttgtgggtagtttcccgtcacctcccactcctcaaaagcaccccggccagaacgccaagtctggctgattttcaggaggtgctactagatgagaagagagggttctcctattatttatttttaaggttgagaagggctcatcggtgagggaactcagcctcaaacaatgactcgcaggctggtggatcaggtcctcgtttcttactctttttgggaagtagggatgttttagtctctccttgccctgctagatttcccattgacggagtgtccccagggccctttagagcatccttgcctgctggagagtaaagagcagccccattccttgcagggtcctgtcacctccaacctgccaggtggaatcctaagagctggcatttagggaacacattcttccccaacc

SEQ ID NO: 135568 - DNA, 589 bp, Homo sapiens
  misc_feature (6)..(6): n is a, c, g, or t
agtcgncggagactctctcttccccccgctgctctctgcggggctcccgagccccagcccgggctgtccgcctcttggggagtcggggaatcgcttccgaatatcggggcatctcgaagggaccccggggagaggaggggtggggggaagagagagttgcagagaggcggagaactttaccctttgtgggtagtttcccgtcacctcccactcctcaaaagcaccccggccagaacgccaagtctggctgattttcaggaggtgctactagatgagaagagagggttctcctattatttatttttaaggttgagaagggctcatcggtgagggaactcagcctcaaacaatgactcgcaggctggtggatcaggtcctcgtttcttactctttttgggaagtagggatgttttagtctctccttgccctgctagatttcccattgacggagtgtccccagggccctttagagcatccttgcctgctggagagtaaagagcagccccattccttgcagggtcctgtcacctccaacctgccaggtggaatcctaagagctggcatttagggaacacattcttccccaacc

SEQ ID NO: 135569 - DNA, 488 bp, Homo sapiens
  misc_feature (6)..(6): n is a, c, g, or t
agtcgncggagactctctcttccccggggagaggaggggtggggggaagagagagttgcagagaggcggagaactttaccctttgtgggtagtttcccgtcacctcccactcctcaaaagcaccccggccagaacgccaagtctggctgattttcaggaggtgctactagatgagaagagagggttctcctattatttatttttaaggttgagaagggctcatcggtgagggaactcagcctcaaacaatgactcgcaggctggtggatcaggtcctcgtttcttactctttttgggaagtagggatgttttagtctctccttgccctgctagatttcccattgacggagtgtccccagggccctttagagcatccttgcctgctggagagtaaagagcagccccattccttgcagggtcctgtcacctccaacctgccaggtggaatcctaagagctggcatttagggaacacattcttccccaacc

SEQ ID NO: 135570 - DNA, 859 bp, Homo sapiens
ttatgcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatgggcataataggtggttaacaacacaaaaactaacggacctctggggtctacaaaaaacaagacgaaaaagccagaaaagaacaaaaacgtttgtgcggccgcccgtgggcccctaagaaaaaggttttcttaaacacaactgtgttggggcgcccggcccccacagagggtaggtgaacgtaggggccaacggcgggtccccaggaagaccccgtgcagtgacagggtcgtgggttccccccacaaaaaaaaaggctcgggggcacggcgttctgcaacacccacaggggtcctggggcaagggacttaaaggaccagagcgatagccgcgcgggat

SEQ ID NO: 135571 - DNA, 606 bp, Homo sapiens
tttaaagatgcaaagtattgatcctgggtatgtctgtgagggtgttgccaaaggagaataacatttgagtcagtgggctgaggaaggcagacccacccttaatctgggtggacaccatctaatcagctgccagcaaatataaagcaggcagagaaaatgtgaaaaagctagactggcttagcctcggaacccacatctttctcccatgctgaattcttcctgtcctcgaacgttggactcccaagtttttcagctttgggactcagactggcttccttgcccctcagcttgcaaacagcctattgtggaatcttgtgattgtgtgagttaatactacttaataaactcctctttatatatacatatgtatacacatatatctcctattagttctgtccctctagagaaccccgactaatgcagggcccatctgatacttgctcaaaaaatttaactggaaatgcaaaggaatggaggtccttagtagtagtagctaaagctgaaaagtcataatgcagaagacaggaccatgacagaccatgtgcaagctaaattttggaggatataaaaagtattaataagaaggcagaaaaaaattaaccactg

SEQ ID NO: 135572 - DNA, 733 bp, Homo sapiens
tctttttcagctagataccttgacttttctgaaaaactaaaaccagaagcatttcacgaagctaagcacaggacagaaggtttgctgggatgggaaacctgctcaaagtccttaccagggaaattgaaaactatccacactttttcctggattttgaaaatgctcagcctacagaaggagagagagaaatctggaaccagatcagcgccgtccttcaggattctgagagcatccttgcagacctgcaggcttacaaaggcgcaggcccagagatccgagatgcaattcaaaatcccaatgacattcagcttcaagaaaaagcttggaatgcggtgtgccctcttgtcgtgaggctaaagagattttacgagttttccattagactagaaaaagctcttcagagtttattggaatctctgacttgtccagccgtacacaaccaaaaagcaccaaacagccatggcaaagggaacaggccctggcaaaaagaggacaagggggttagatatgggcacccgggaaaagaggtatatatacaataggttaacacctatcgaattcgattgaaagagacacgtggaaaagggaaaaaattgggaaagagagagggggcgaaaagcaaacgacgcaggggaccgtaagtgtccaaggaacacagtggaactttacaggagcgttaacgttaaaccaaggggcaaacacagagggaagacaaaccaggaaaaagaatgaa

SEQ ID NO: 135573 - DNA, 234 bp, Homo sapiens
catattaaataggtagtcataataagtggaatcgatgtggaaagaggttcatattgaatgagaaaagcaagttacatagcagtatatataatgatctcagttttgtaagaatagatttgattttgtgtgtgtttattatttttctcatttatgcataggaaattgtctagaatagtatgcaaaggaaaaaagccctgtttatcaagttatgctatttaaattacttgatttttt

SEQ ID NO: 135574 - DNA, 594 bp, Homo sapiens
gagcaagttcaggtgtggttacatcagggttcccaacgttttttccacccccacactcctgacagatccctcggtgatatagaatccctccacccaaggacatttatcaggatctttagggaacagcgcatattttgagaaaaagtccagggttggaaagtggggttcccgtctccccattgacattgagaatgactaggttagatggtatattcctagtggaagcaaaagtcttagttacagaaagcattatttgagcaaacctaaactaaaggagatgctttaacacctgaagaagctgggtaaagcggggggggggggtaaagaagaaggggggtgactttgatgaccaccattcctagtggtgctggtattaggggggcaccctcctgttagagtgtgagcttaccacatggttggtgagcctgggacacagatagctaatggtaatggtgacaaaggagatacgcgctgtgataaagggacaaacagaatgctgccagcatgcatgggataatcattccgaagtggtacttgagatggtctttgagtaagatttaggaaagaaatttcgggctgagagtaccatggcca

SEQ ID NO: 135575 - DNA, 722 bp, Homo sapiens
aggagagtgaaaaatatgaactttagtctttgttttattttatgtttgctgagaaaaatgctgtactttatttatttatttattatttccataggtttctgggggaacaggtggcatttggtgacatgactaagttctttagtgatgatttgtgagatttaggtgcacccatcacctgagcagtatccgctgaacccagtttgtagtcttttatccctcaccctcctcccagcctttcccccaagtccccaaagtccattgtatcattcttatggctttgcatcctcatagctcagctcccacgtatgaaagagaacatgatatttggttttccatgctgagttatttcacttagaataatagtcttacttccatccaggttgctggaaatgccatgaatttattccttattatggctgaggtggtattcctcatatatatatatatgtatgtatatcacggtttctttatccactcattgattgacgggcatttgggctggttccatatttttgtaattgtaatttgtttgagttcctcatagattctggataatagccctttgtcagatgtatagactgtgaagatttcctcccactctgtggttgtctgtatactctgctgattgttccttttcctgtgcagaagctctttagttaagtctcacctatttgtttctgttgcatttgcttttgtgttcttggtcatgaagtctttgccta

SEQ ID NO: 135576 - DNA, 496 bp, Homo sapiens
tgtgtctcaatttcctcatctgtaaaaatattaccacctaccttgaaagtttccagttaaataaaatgtaaagtgtctacactgatctgacaaaagcattacaattattaaatataatcaactttccaaaccttaaatcatcttaagtctaaactcatactcatagtgtggctcacaaaacagcagaatcagcatgacctgaaagcttgttaaaaatgcagaatctcagccgggtgcagtggctcacacctgtaatcccagcactttgggaggccgaggcgggcagaccaagaagatcaagaccatcctggccaacatggtgaaaccccttctctactaaaggtccctaaagttgttcacttgatctgtttcagagttctgatactgagtgaagagcacctggtagtttactcttaattctgaaggactcgagagactaacagagatcatctaatctataataattgcacctccaaaaggcagcttttcaaacctg

SEQ ID NO: 135577 - DNA, 752 bp, Homo sapiens
gtacctcacaacctctgtgtttagatttttcttttatttttataatagtcaatggcagccaacataggtagtttgtttttttttaacctaaaaagtgatttgttctttacattaatgatgtatgggggtaaattctgagaaaaaattcttttcaatttcagaattgttataattggacacttaaaatttttgacatgatttaaatttttttaatattaaaaatgttttaaaaattttaaaaatagtaatatacagtaaaaattctgccttctgtccctctccttcagctacctcctactttcccttccctctgaaagatggtatatgctttcagatactcaaaccttttctaattttatgtgtgtgtgtatttttctacctttgttacacaagtgaaactgtactattcacacttttttttcccttgataatcttggagatctttttaaatcagaacataaattatttttaaccttgcatgtattccattgaataaccataccaaatttttatttaacacagttccatggggacatttagttattgagcattctttatttaacttattttagatatttttgtgttgttgtttaaaaaatgtccagaatatgaaattgaaatgtttgctagtaactaaattacctggctcttgatgattttttcccgaagtaacttaaattttattaaaatactagaattgtcttgtaaatggatgtcaaggccttctgtgcatttggcacctcataagtcag

SEQ ID NO: 135578 - DNA, 296 bp, Homo sapiens
gtcgggcactaagagctactccagcctgggtaataagagctactccagccgtgggcaatgagaccaaaccctattgtagccatctctggagggcaagaagtagtgagagactagccctattccagaaacccccactccccccatttgtgttgctgatcaatgcagtggtttccatggtggcagttcacaagatgctgaccaacttttcctgtgcttgtttaggttcaaggcctagaacccatgctcaacccagcccagctcttctgtccattgtattctacgctcctcattttgag

SEQ ID NO: 135579 - DNA, 212 bp, Homo sapiens
gagaaaacaaaattgcttgataaaaatgccatgttaacaactgaggaaattgttttacatatattaattttaacacaggaataatatgtcaaaccaggatttctcaacctcagcactatcgacattttaagctgtatagtttttggtgtgggaggctgtcctgtatattgtagaatgtttagtggcagccctggcctctacccaaggggcca

SEQ ID NO: 135580 - DNA, 483 bp, Homo sapiens
tccactagtgtaggctttcagatctatatagcatactgggttgaatagtgtcatcccaaaattcatatctactcagaacctcagaatgtgaccttatttggaaatagggtctttgcagacataatgagttaaatgaggtttcactggattagggtgagccttaaatctgatgactggtggtgctggatttatgtgaatgaacacacacagtcatagggaagaaggccatgtgacagcagcagaagaccctggaattacatagccacaagccaaggaaggcgacgactgccaggagctactagaagccaggagagaggcacagaacagaccctccctaagagcctctagggaggcgccaaccctgcccacaccttgattttagattcctggctcccagaactgtgaaggaacacatttctgttattttaagccacccggtttgtgctaatctgttgcatcagccctaggaaactaacacggaat

SEQ ID NO: 135581 - DNA, 559 bp, Homo sapiens
catgtgtgttcctttgatgataatgcagacagaattaaaatgttgtctatagtagtatttcttttaacatgaggaaattggtgtcattataaatttcttttgtgatgtgtagaatggaaatggagctccagcctgggtgacagatcaaggactctgtctcaagaaaaaaaaaaaaaaaagtgaactattatttgacgtacaactaagaaagagaaaatgccatttaaccatgcacgtgccgtaagttttaaaatgcttcctaatttgaatgatgataattttttcttaaaaaatcatgagtgtcagatatatgagtactatccatatattccttgttaaaatgaatactatagacagtaactactttcagattttaaataaatgttccttatatttgtgggaagacacaagaagccttttgtatgtgtgtgtaatttgggaaatgctttgcattgcctgaaggacatctagagtctacataggtctaaggctaaaaagcagagtgattcagagaaagaatataagattattgctgaaaatatactatttactggtgata

SEQ ID NO: 135582 - DNA, 394 bp, Homo sapiens
aaaaaaaaaaatttgacctaatagattgacttctgggagtttaatgaaataattaagaatgtgctgaaatatttaattcaaggatgtctgtagtagcattatttataaaaatgaaacgtttgagggccaggtgcagtggcttatgcctgtaatcccaacaccttgtgagggaggctgaggcaagtggattggttgaactcaggagcccagcctgggcaacatggtgaaaccctgtctctacaaaaaatataaaaattaggtaggtgggtgtggtggcacacaccttagtcccagttgcttgggagactgaggtgggaggattgcttgagcccaggaggtccaggctgcagttggccatgatcgcactactgcagtccagcctgtctcaaaaaaa

SEQ ID NO: 135583 - DNA, 473 bp, Homo sapiens
aaaagctcagggtgggaaagaaatggcttatcaaaagcacatatacaaggaaaaatgaaacataacaagattacaacacaggactaaaaagaatgtgatgagcagacattcttataagctgagactgcactgagcagatgagcttttaggataactgaggggtatccctgggtcaccttatgttggtcagacctgaggagtgttgcttagtgcaggtgccacattttaaatgacaggcgaagcagaccaggaggataaataaaatggtaatatataaaaatggctaataccaccacacggatgatgcctgaaaacagtaccccctcagtaaaagaaagcagtcacaaaaggccacttattatatgatgccatttatatgcaatgtccagaataggcatatctatagagacaaaaagcagatgagaggttgcctagggctgctcaataaaaataaaaataaagaacctaattgg

SEQ ID NO: 135584 - DNA, 455 bp, Homo sapiens
ggaatgccaacagaatccttcgtgacagggctggcacaagcacagtggaggggccccctgaaccagctcgtggggtgtcagggaaggcctcctggagcaggtgacattttgactcgggtcttctaagaccaaaaggtgttggtcaagtggagaagcaggggcaggattcttctggtggaaggtgaggcaaagtggtgcagcccacatgcagctgacagagaaggaagggtttcactcagggaactgatggcagctttgtcttgggtggatcctctgaggaagtctcttctggctcgaggtgacagacaccctgaatagctcttagggaaagtctggaaactaatacaatgtaaatgaagactttccagtaggctcagaatttcagctgaggccccaaaggcagaaacaaggccagagttgctgatcctaaagtgaagctggaccacccacctagg

SEQ ID NO: 135585 - DNA, 558 bp, Homo sapiens
cagccgagccactctgttctgaagacgcccttgtcctccacccctttgctttgggctctgagcttcttctgcctttcatctctgtaggatgaagccccacccgcccttcaggatgccagccttggcaacattgtgagaccctgtttctacaaaaagtaaacgtgtagtggtgcacgcctgtagttctagctacttgggaggctgagatgggaagatcacttcagcctgggaggttgaggctgcattgagctgagatcaagccacggcactccagcctgggagacagagcgaaaccccatctcaaaaaaacaaagaaagtggatgcacgctgctcctgccattggatcatcgcagcatttttcttttctctgatatgcgcctttttcctcatcgtgggggctcatgtttttgtactttcctctcgctactagattgtgagctgcgtgaaggaaggttcatagttgtgttgtatgtacaggcacacaaaatttgtccttggatagacacatatcaatccgcttccttctcctctctgaagttctttatttaaaaaaaaaa

SEQ ID NO: 135586 - DNA, 334 bp, Homo sapiens
actctggctagtcaagaacaatatacctctgggacaccaggcttcacaccttttctttctctggctttggccctcttgaccatagtctcacgaacttgtttgtttcccacttgcctgtgccctaatgtaagtcttcccagagtgaaatgaaataggaggcaggcactaccctgctgtctgttcccaggtttgtcccatatgtccccagccagttgggtgagatttattgacttcaaacttcgatctcttttccagtacctcagtccatcttgacatttctatgttatcatacataactatgattttttgggggggctggtttctccttatttct

SEQ ID NO: 135587 - DNA, 674 bp, Homo sapiens
tttcaagtctgcaataatgatctttattcttttctatataatatttttcctatagtagcttttagattttctagttttcactaatttgattgtgaggtttgccatggtttgaatgtcccttccaaagctcacattgaaatttaattgccattgtaatggtgttaataggtattaataggtatattgttaagaagtgattaggctgtgagggcttcatcctcatgaattgattaaagtcataatctcaggagtgcatttgttacctcaagaatgagttataaaagtgggtttggccctctctgtctctttcttgcatggtggttctcttttccctctgccttttgccgtagtatgatatagctacagcatgaaggccctcaccagatgctagcaccttaatgttggacttccaccctttgggactgtgataagacatttcttttctttataaatttctcagtctcacgtactctgttgtagcagcataaaacagactaaggcaaggtttctctgtgtatgggtgtttgagatgtatgtttatagttgttcatcaaatttgaaaacatttcggctgctctatctttaaatattttttggtccactctcttacctttccttctaggacttcaattacacatatattagcactcttgatactgttccacgggttctct

SEQ ID NO: 135588 - DNA, 290 bp, Homo sapiens
tttgtttttgtttttgttttttgagatggattctcactctgtcacccaggtgggagtgcaatggcgcaatcttggctcactgcaacctctgcctcctgggttcaagcaattctcctgtctcagcctcccaagtagctaggactacaggcacgtgccaccacaccctgacaggcatcctgccatgaccctatcagagagattgctgggccagaccagggctgcactggacacccagaccaccagggacaggggaggaggcactgaagatacactgaggctcttttcagcat

SEQ ID NO: 135589 - DNA, 409 bp, Homo sapiens
aatgttaaaaagtagattgaaagcagaattaaggattggacaaagacaaagctggttttagggaaatgagtgagcaaactgaaaagacaaaagttaagatttgatgatctaaaaagattcactattggccggatgtggtggctcatgcctgtaatcctagcactttgggaggccaagacaggtggatcacctgagatcaggagttcgagaccagcctggccaacatggcaaaaccctgtatctactaaaaatacaaaaattagccgggcatggtggcacatgcctgtaatcccagctactcgggaggctgagacaggagaatcacttgaacccaggaggcagaagttgcagtgagccaagatcacgccactatactccagcctgggcgacagagcaagactctatctca

SEQ ID NO: 135590 - DNA, 254 bp, Homo sapiens
cgcaagcaaggggactccaatgctctcaggccatgaactaatgaggagcttcatgcctgccctcagtctttcttcatacccagggcaaagctggcccacagacttccagacatgctttcttcgtttgggtagagatggggatccaagtcccctatgtatttcctccagagccacctgtaaaacatgggtgaaatctacctgccctctagctcaccacttccaggtcaagcccactcatggaccactttaacagt

SEQ ID NO: 135591 - DNA, 379 bp, Homo sapiens
tatttatttccttaataaagaaaaagggtttaggaccaaaggctctttgttgcatttctgttgtgaacccagtattttgacccatgcttattttcaaaggtaggaaaatttgttttcattttttacacaaacttttaaatcttggttgcaatgctgtttatgaccaagcgaaacagataatgtggtagcaattccttttatcatgttattgcttttcttttcatggatattactcttacagttctagccaagagatagaaatagtaaattttacttttcactttctaaatgccaaagtcatctctcagtcatttatcagaatttggaggctcatttcttagtgatcatatatcttagaatccaaaagatgagaggattt

SEQ ID NO: 135592 - DNA, 524 bp, Homo sapiens
tcgcaccattgcactccagcctgggcaacaagagtgaaactctgactcaaaaaaaaaaagatgctattgaaggattgctaggtatgattggcaaactgcttgtatggctttgagaggctagcggagaagaggactaggtaattacactgagggttccagccatgttgattgctaggattatggggccccataacagcagagggctcttgtaaggaagggtcaggtttaggtggtaggatgatgaggttgggttggatgacttaagggagggctctccttatagggatgatcaaaggcatctcctggggcctctggggaaatgatctgtttttgtgtcatactgggactaggcacacgctgtaacaccaaaagtattacaaaatttactcatccgttatgtattggtgttttccccgattagactgcaagttccttgaggtcaagacctctgcttatttatctcggtgcattttttgcctggcgcactaaaggtgctcagtacatgggtagtgaaatattgggga

SEQ ID NO: 135593 - DNA, 345 bp, Homo sapiens
ggggaagacaagaggccccaaaggccctagtacacccccaaccaatgcgggaacctcacgagccccccagcactcctctgccttccgggaccagcccaagcagctctgcacactgggccgccatggtgtctgctcctggttcttaccatacataacagggtgaggaaaaacggtgcaaggcagagccgaggcaggcagagatcaagtaggcgtgagtgggcttggtgaaacctctcccatagaggagcgggccaggtggagggggcttctcttagcaagcatacctgggatggctgcagggccttctcatcaggtgtacccccgcaggccacccacccccaccgc

SEQ ID NO: 135594 - DNA, 310 bp, Homo sapiens
tcactacggtcttgctctatagggtctatcaactttccaagactggattttattcaattagaaggttctagccaccccaaactagacgttatgcctctattccacagcaatatttgatgactcgcccctccccacaaaaaggaaaagaaaacatattgtatctgcttttagtagaaatcccctacatttgtataaccctttatacgtagtacttctttaatccctctcacaaacatgtaatattcacctgggaggtaggcaatactcccatttgaaagataaggagagagaatgataccatttaagtgat

SEQ ID NO: 135595 - DNA, 569 bp, Homo sapiens
aaaaataaaaagtcacaaattaaaacacgctgctggagaaaatcacttaaccacaaaggaagccagtaagaaaaaagaaggaaagagaaagaaaggaagaggagagttacaaaacaactaaaaaataagcaacaaaatgacagaattaagtccttacttatcaatagtaacactgaatgcaaataaactcaatttttcaattaaaaggcatagaatgcttgaatggaattaaaaaaaaaaaagacccactatatgctgcctacaggaaacccattttgccttcaaagatatacatagtttgaaagtgaagaggtgggaaaagatatttcatgcaaatagaaacccaaagagagtagtatgtgctgtattcatatctgataaaatacatcacaaatctaagattttaaaaagagattaaaagattactatatagagaaaggagtcaatctagcaaaagaataaatcaattataaatatgcatccaatgctggagctcccagatatataaagtaaacattaatagatttaaagggagagatacactgaaatacaatagcagaggagtttaa

SEQ ID NO: 135596 - DNA, 333 bp, Homo sapiens
tctacaggcatgtgctaccatgcctggctaatttttgtactttttgtagagatggggtttcaccatgattcccaggctagtctcaaaatcctggactcaagcgatccacctgccctggcctcccaaagttctaggattacaggtatgagccaacacgcctgccatcttgcttctttattgtcaatatttttactgcttttgtttatctaactacattggctaatttcaaaaaatattaagtaacactagaacagtaagcccctttgtccagtgtgtaaatttaaaaaggaatttgttttataggcttcaggcttgagacacaaatatgaattt

SEQ ID NO: 135597 - DNA, 423 bp, Homo sapiens
aaagaggcctaaaggggacgttggcaagacgttaacatctgttaaatgtcagtggctcctggcctggtggaggtgggagtcggggataggatgttctattattttctgggcatttgaaatgtatcaaaattcaaaacattaaaaaggaaaaggcctgaaacaaagtggccaggaaaggacaacagcaggaaatggcactatagaaaccaagggggatggcaggtgtcttccagcgctgcaggatcagctgcttctcaccccatcctctaggcccaggagaaatgcgggaggaagccagcctgctatggccatggtttggccagctctgagaagtttggcaatgccttgtcactagcaggagggaaatgcgtatatggtatggggagggcgagactgaagtcacaggggatgggcaggagggtt

SEQ ID NO: 135598 - DNA, 359 bp, Homo sapiens
tgcatgggcattaagagctactccagcctgggtaatagagctactccagacgttccaatgcgcatcttaacattctcaatccaacctttaactaaattctgattccttttcaaagaacgctctcaagattccctctagtgtaagcagtttcccgagccatcttcccaaacactagctttcacctaactcaatccccaaaatgtcacactggactcctcacccacagcatcctgctaattagccgttcccaacaggtcctccgttcccgtctccctttttgcgcacgattacctcgttcctcacagagttgccgccttaactcacccaacccttcaggagcccttattgcctgtctctca

SEQ ID NO: 135599 - DNA, 294 bp, Homo sapiens
tccctcacttcacaccacttcaacatgaaccctcaactccagacgttccaatgcgcatcttaacattctcaatccaacctttaactaaattctgattccttttcaaagaacgctctcaagattccctctagtgtaagcagtttcccgagccatcttcccaaacactagctttcacctaactcaatccccaaaatgtccagcacagcgccctcacagtggtgcccccaggtcttcgccttgatcgtgttctcctgcatctagggttaagggctcccggagggttaagggctcccg

SEQ ID NO: 135600 - DNA, 425 bp, Homo sapiens
ggctatggagacgaggagaataggaacattctaagcaagcccagtcagccagtgagaaagtggaaccagggcaaagtgtcagagagtgaggcctctttaattaatgacactttaagaaatattaactatttcaggaaatcagtcctgaaaagagattttgcctcctgaccatgaggaataaatacagatttattatatttacaaagctgccttttcaagtggttgacttagaggatcagggaatctctgtctctttgtagaaattaacttcaaataataactaactccttttatgtatttaccaggaacatttttgtcttttggttggtttgttttttattgattggtgcttaatggaaggcccagtgagacatttgtagctaaatttgttaggagccacttccaattaaagttcatttgtaatg

SEQ ID NO: 135601 - DNA, 656 bp, Homo sapiens
attccaaagggtaaacacatatgcaccaagaagattttcttgcgttaatatttccaaaataatgtgtctggaattccggttgatattagcatctttataagaaactagataattgtaatatcactgtgtactagaagctgtgataaaaagtgatgcagaataatgtgacaattgattactgaatacacatatagtatttctcaatattcattttttatctcaatattcattcattttaaaatgaatattcatttttctcaatattcattttattgcaaagtatcaagatgtggttagattcatattattctgaaaacactgatgagctcatctttttcatgtctacatagaggccaaattgaccaggttcatgaccagtacaaacatttcagctattttagcagtcagtaccaatcactctagctaaattggtctgtccatgattaatatcaattgctaagctgaaaagtttatgtgaatgcttaggctgcagtcaagtggtcatgtgagttaggtaaacatcagtggggtaatattatcgataatatgttatctgttttcccattataatctttattggattaagagtctaacatatattaatagcttgattttttaattagaaaaaaattaaaaatgttttaacattatttaaa

SEQ ID NO: 135602 - DNA, 598 bp, Homo sapiens
tatgtttaaccatccgtacatctctggaataaatcccacctgatcctggtgatatgttttgactctgtgtccccacccaaatctcatctgaatttgtaattcccatgtgtcagggaagggccctggtgggagatgattgaatcgtgggagcagacttctcctttgctgttcttgtattagtgagttctcacaagatctggttgtttcaaagtgtgtggcacttcccccttcactccctctttctctcctgctatgccatggtaagacatgcttacttccccttcaccttctcccttgattgtaaatttcctgaggcttcccagtcatgcttcccattaagcctgtggaactgtgagtcaattaaacctcctttcttcacaaattacccagtctcaggtagttctttatagaagtgtgaaaattgactaatacagaaaattggtgcccaagtgacctattgctataaagatactgaaaatgtggaagtgactttggaagtgggtaatgggtagaggttgcaagagtttagagggttaagataggaagatgggggaaagtttggaagttcctaaagacttgttgagtggttatgaccaaa

SEQ ID NO: 135603 - DNA, 749 bp, Homo sapiens
ggctctcttcttcatcactcaagctttattttctccagggagcctcctttctgaatctgcatttggggaatttcccctgccatggcagtcacagtaccatatgagaattgcctgttttcatatgggtaaccctactaagcctgaagttacctaaagttagatattcttctgatttatgtgtcattgtgtcacttgtcccatcagagtgcctggcacataatggatgcctggtaaatattttcagtggaacaaaaatgttaatagttttacaggatgaatagcagcccactgcagaatgtcttatatcataggcttccttgccaaaaggaattaaaaattgcttttgagtgtgatgtggttagagaggagaaaaaggttcaactgcttgggggaagattatcaatgatcttaaatggtaaaggccagcagtctaaagagtgtttgggaggctgtctcctgagtgttgattagctggtcattttggtcaggcacgggtcaccattttttactcttgctaatggattatagacagcagggctaaataaacagcagttctcagctggaatctagaggtgagttatagcctcagggaatgctcacctttttagagttaatgctttcaggacatcttgatagattcttaagaccactaactggttgccggaaacccaggattaaattgagttgaacctcggatttctgctgaactaagcagaactaaggcatgagcctttacagcttgagaaggg

SEQ ID NO: 135604 - DNA, 133 bp, Homo sapiens
cccaaagcttcataatgcacactcttttcaagtgtacgtggtggtatgttcatcaggagagaccatatgctgggccatgaaacaatcctaaatacattgaaacagacagaattaatacaagggtatattctcg

SEQ ID NO: 135605 - DNA, 104 bp, Homo sapiens
ccaaggagcccagagaacaccaagaggtcagtggtgggagagcatatttgagtacacacatttgatttgtgtgaacagagagaaacctgaaaaacaggcaggag

SEQ ID NO: 135606 - DNA, 381 bp, Homo sapiens
cagcctcccaagtagctgggattacaggtgcccaccaccatgcccgggtaatttttgtcgttgtagtagagacagggtttcactgtgttggccagtctggcctcgaactcctgacctcaaatgatccacccacctcggcctcccaaagtcctgggattatagacatgagccgccacacctggcctgagttgtgaatttctttatttagctttgaaatctctagtctcctagtattgttaacaatcaaacattttgaagaagatagatattctataggaaatacattctggaaacttttgggaatcgtctttaaagcccgtgttacaaagcgtgttatatgaaaaattgcttttgattttccctagctagagtaattttctg

SEQ ID NO: 135607 - DNA, 478 bp, Homo sapiens
cttctaaaaaataattataatctgtcaaatttcgggacagataatcttggcctcccagcccaagatttgatttgatttcattttattttagagacggagtctcgctttgtcgcccaggctggagtacaatggcacagtctcagcttactgtaaactccacctcacgcgttcaagctattcttctgcctcagcctcttgagtagctgggattacaggcgcgtgccaccatactcagctaatttttgtatttttaatagagatggggtttcaccatgttggtcaggctggtctcgaactcttgacctcgtgatccgcccacctaggcctcccaaagtgctgggattacaggggtgaaccatcccgcctggccaagtttttattttaacaactactgtgtgtgagagaagggggtgggctagagtagggtaatatgtacacgctatggctgaaacagaaaaatggtaactttattttctac

SEQ ID NO: 135608 - DNA, 414 bp, Homo sapiens
gctgggattataggcgtgagccattgtgcctgacgtcaaactattcttaaactttaattcccatgtttctaacattttaaaatatggtgttcaaagatattaggtctactttaaaaaatgttctataaatgtataactgacagtgatttaatgttttgataaaaattgtaaaggtcatggaataatcgaaatatttcacattgactattaagatccttttgtagatttcaggttttattagcatttttacagtcccatactactgtgccaagtgaggactacttgtatttaaaacattgtaaaatagagcttatgccttggtttcatgttttaggtgaaagagatgactaaatctaggatttttatttcttccatgggttatgtgaaatccaaatatatacttgggtaaactcc

SEQ ID NO: 135609 - DNA, 399 bp, Homo sapiens
tccaaacaccatttccaaagagctgtgctggttccctgactctctaaaggaacgagaaactccccttctccagaaggctcccacgacactggaagcacatactaaggactgagtctttgacacgtgaatgttgctgggtctaaggactgagtctttgacacgtgaatgctgctgggtctgctgtcccacacgctgcatctctttcgttaggatacaagtcatcatagtcaaagcactagctggacccagactgactcggaatttataaaacgtggttacgatactgaccaaagctgccggttcttcgtggcagcgcagagcctggagggtgtttaaagtcctcccaaggctactcagatgcatctcctgagggagcctgggacgggatctggttacagg

SEQ ID NO: 135610 - DNA, 111 bp, Homo sapiens
ttgagtcagatggacctggattcaaatccctgttccctcctcttactgtttgagggactttggacatgttacctgacttctctgaacttgagcttcctgatctgtaaaata

SEQ ID NO: 135611 - DNA, 362 bp, Homo sapiens
aacctggttctggaatcggcttgaatcattccagcctttcatacttatagctgtgtggccttgggcaacttacttaactttatctataaaatggggacaatagcttctcttcctcatagcatggttgtgaggattagatgaagttctcagtggcattccttgtaagctctagggagatgttagctgttactaatgtttggcaccatgacaaatgattagatggaactttggagcaattaataatacaaattaaaataaggggacaaagccagccaaggagaaaagtaaaagatcaagaataggggcatataatggctttatttttccttgagtctagtgtgattctaacacctgagtccaac

SEQ ID NO: 135612 - DNA, 511 bp, Homo sapiens
aaaataagaaaaaataataatcctttgcctaggaaattccttccttcttcaagggaaggcactccgaacacctccatgagctacacttccacacagctcaggggaggcggcaaggtcctcccagtacaggtgttaccagcagagggcacactcctctccccagtcctccaccaggctccacaggaaacgccagggcagggtttaaaggaaggtttatcaccccgactttacataaccaggtaaacagagtcacagccagaattggaagcagctttcccagggaatgcacaatcaggaaaagagtgtgggtttccagcatctccccacaagccactgttcgctcaatgactccaggaatggtcctggtgacaaagttttaccagtccactcaaaatgagaaaaataccagcaattgcatgtatattcaacagtatatttaagagtgtatattgcttatatacaactgtatatgggtgtctgtgtgtgtgatgtaaattcttctactgccctt

SEQ ID NO: 135613 - DNA, 428 bp, Homo sapiens
aggcaggagaatcacttgaacccgggaggcggaggttgcagtgagcctagatcatgccactgcactcctgcctggggaacaaagtgagactctgtttcaaaaaacaaacaaacaaaaatgtaacacaggcagagaggagaaaatagcattccaggcagtgggaaatagattcgaagaaggcattgacagcaccaggtttctctaagacatagcctgtctggctgggatcaaggctgcttgctgagaggcgtggaaaatgaagctaggcaggctgggaccagatcatggaacctatggtgattgttttgttctccatggcctctcattttttccctcttcctctgtctctctctctttttgtttttgtttttttccaagacagagtctcgctctgttgcccaggctggagatcaatagtgtgatctcag

SEQ ID NO: 135614 - DNA, 352 bp, Homo sapiens
tatcactaactttcaccgaagtgatcaataataccacttcagcctcaactcactgaggcattcacatcagcttcaactcactgagttgctatggatgagagaactaccctagacgacttctttgtggaccaagacagatcctgctatacctgtattaatgtctcaggccaaagagataaaagtatggaatgagggaaagagagaagaaaacacgtaatgctctgctacaataatacgtatctaactgaagtcataattttaaaatacgtatacacatctatatacacacacacatccccacagaaccatatcccttagctctactaaaaaggcctcaaagcaataatactac

SEQ ID NO: 135615 - DNA, 202 bp, Homo sapiens
aaaaaggcacgtcataggctaggagaaaaaatttgcctaccacatatgtaaccaaggactagcagctaggacatctgaagaattctcaacattcaacggggtagaagaatgaacgattcaatagaatatgggcaaaagacatgaagaggcattttaccaaacatagggtgctatggtccgaatgtttgcattctcctcaaat

SEQ ID NO: 135616 - DNA, 421 bp, Homo sapiens
aggtcaagtctttgctatggaagtctccaataagataactcctaacatcttttactaactccagcttcttaggtttgaattgttcacaatattttgggggtattttgttttgcctttggaaaaaacgttagcctctagcaaatcccatttaaaaaaaatctcacagtatctataggaacataaaattcatcagagtgcttcttctataataacaggtgatttggtttaaagtattaaaagctatttgcccacaccatcccagcactcagtttagcaaccttctgttggataacattaaactcagtctattagtgagggtgtcttgcaactagcattattttttcagagctgtgtgtgttaattcaatgtcttaattgagtctattaggaaccactttatttttgttttgtattagcttatg

SEQ ID NO: 135617 - DNA, 285 bp, Homo sapiens
aaaatttaaaatatgcatgtgtacatatatgtaggtagggactatcaaaagagatgtcaaaaccatctatttattctcatttttggatacagtacacattaccaagttgttacaatgtggttatttaaatatcatttgggccaggcacagtggtgcatgcttatagtcccagctgcttgggaggctgagttgggaagatcatttgagcccaggagatcagtgttggagtgtgctataatcatgcctgtaaacagccactgtactcccatctaggcaatatctctt

SEQ ID NO: 135618 - DNA, 298 bp, Homo sapiens
ttttattaatttctcttgctgaatttttgaccctgtaaagaaaaaaagatgcattgtaccaaaccacgctacaagacaggctcctccagacgggctttttccttcctgctgaaggacatggatatcggctttatgagctggttacagtcagctttatcgccaagccagtagattttcttaatatacttattgctgttctgtaaatagcacaaaggcaatcatgaatctgaatcacttatggggtcacagtgagattgataaaggtaatcttgggaagaaagtgttgagtagcctaaat

SEQ ID NO: 135619 - DNA, 423 bp, Homo sapiens
tggtaggcatagaaatggtgaagtgatcttgggtgtattttggaagttgagcctggaggatttactagttggatatggagtgtgaaagagaagttaagaacaactgaaagattttgtgacctgagtagctagagaaaacagaattgccatttactgaaattggaaaaagctttctctttctgcttatatgaccactgttaatatttaaaaactatgaattacagaacccatgtgcttgggaatagaagtgtctgaaaatgaggtcggagaaaattgtcagttaagaggctgaaagttctgtttgtggacagttctaatatgcctttttatagacagatgggtggtattactagggcatatagccgtagataaagaaatctgtggtgcttatttgcagatggtcgtgatggtgatggcggagac

SEQ ID NO: 135620 - DNA, 256 bp, Homo sapiens
cgactctcctcctcctgccgttctacgaaaagtcaatttctacagcttagccaaccaagtgattccctttttctatgtgcaaagtgtaaaacagcattgccatctctccttgccacggaattatttcaaacggtttactacagcagtttgtctttacatgcagagctgcctagaacaaacaaaagaaagatccaatgagtgaattttccaatgtagaggattccaggggtagatatgagggaagggagagagaact

SEQ ID NO: 135621 - DNA, 545 bp, Homo sapiens
cctcccaagtagctgggaccacaggcacacaccatcatgccgggctaatttttgtattttttgtaaagaggttttcaccatgttgcccaggctggtctgtaattcctgggctctagtgatctgtcacctcggcctcctgaagtgctgggattacaggaccacagccaacctctgcctctccattgacgaggttgataaggtggtgtagacggctagcactcgatggagacctcctgaccccatcaaagggaaggggaaaacacaggaagctctcccactgtgtggtcagggctagtaccagctctgtccctgggccttgacagggcctggagacacctttgggaggagcagttccagcccaaactcctgcaagggagggatggagaggggagaggctgaacacaacccacctggaacccggggctgggcccgatgctttgaataccaacttaatcttcacaacagcctgtgaagggtgtgtgtatgcacgcgcgcgtgtgtgtgtgtacaccaatttcttgctgagaaaaaggaggctcagagag

SEQ ID NO: 135622 - DNA, 654 bp, Homo sapiens
taaattttatttaatcaatgcctcagaaagagaggttcagggacctgccaaggtgccaagggactcaatctcaaattgactatgctttgggtctattatgaagcaaaggtgaggcagccaccatctgagatgggcaacctaagaaaaatgccatccctccttctgctgctttcttccaacttctatccttttatcatcagaactctagagaataaagtatgtggcctacttttacttagctttccataacacactgttcatctatcactctggatgtaaatttgatataaaaatgaccaaattattaaataaatgagtgctgtttgacacagcatcctctctgatccctttggccttgtttcccaagaaggcaggaccgagctgtgcctttgtggctgcctttaactgcatttccttctccctctcccttcccagcacatatatttctgagctctcctagtgtttacttctaaccacttaaggaaaatgtagatttcaaaaatagcattaattaacatatttttatttccaatcatttaaaataaaaattattcctttttctagacttttctaatttgaataatactgacacaaaaagctgcctacaatcccctttgaaattcactgtgatttaaataagaaataaaatagatc

SEQ ID NO: 135623 - DNA, 415 bp, Homo sapiens
cagtgccaatgactttgttttaaggggaaactcttgaaggaatggggcctacttgttgctataccccaaggtgatgcaagtaccccaaggtgatgcaagatttagttcccttgagaagggtgctaaggttatagcactagccccttaccaaccatctttagacacaagctaaagcagtgccaagtccatggtgaaatgcaatagactcctactgctttagagagagaaaccaggtgggcatcaccgcagggttcacatgttgagagtggctgacagcagagacactgtctgtctcccctaacacaagcagatgtaacacaaactctcacacacacaacttggtggtaaagcaccaagaacagggccttgtttttacatagcacatgcataagaaatacttgtgtttctcaactcc

SEQ ID NO: 135624 - DNA, 411 bp, Homo sapiens
gaatcaaagatgaagcacaagtatctgccttgggcaagtgaaagatgggtagggccattcattgagatagaatgggggttgagggaagtaatcttggggatgaaatagaggttgggaatttcaagttcagtttaagacaggtatttccaagtatctttggataagcatgtagaaaataccagcaggccattagatgtacaaactcagtatttaaattaggaatctgggctacagattaatacttaagagtgctcaggagggagaaaaacagacagaaattagagctatagtaacacaaagtactgcttaaggcaaatgtgtcaagaagatcaataataaatccttaaggcacaccaataattaagagactgccttgagaggtgggttaaaaactagaggtaggtcagggac

SEQ ID NO: 135625 - DNA, 357 bp, Homo sapiens
cgatggctttttataactccgggttctgcgcctttccccgggcttggaagggaaggggtgggggaggtgggaggcggggaaatgagctaaattttctggccttttcaaaaggtgccatcctcctaccgcgcactagtgatttcggggggttcccctgagcaccccctgcatgtagggctcacgccttagccccagaatggggattgcgcgtcccctcaggcctcagcccttgcctgcctcccaccccgctcccctccagcctggagctgcggagcccgagcagaccaacaggccgagctgcggcaggcaaaccccctgtccgtgtccccatgcacccccacggaaggccgtacgccc

SEQ ID NO: 135626 - DNA, 288 bp, Homo sapiens
atgatgcgcaagtcaaatgatgtcaactgtcttgcaacattctccaaaacttaccagttggctccaacacacctgtaagtctgcatcacttctctgttcagtcctgaaaaaccttcaatgtttctgccttgcacaaaggctaagagccaaatgtttcagcacagaccagggtggtggcagtggaggtgatgggaagtagttggattctggatatattttgaaggtagagccaatgagatttgttgatggtttggatgtgggatagaatcatggattacttcaagattt

SEQ ID NO: 135627 - DNA, 319 bp, Homo sapiens
ctgatgtacctttcttgattttcccttatctaaatcctgtctgaaaacatttagatgaggcaagtgttctctccaacttaatcccaacgcagagccttccaacctgacccacctgatggaggttcgtctgtggctggtgcccagctgccatactgcaattgtccttcaccttcacccttccctttgcctctcttctgcgttggatctctgcttctcattcttattctcagactcctcttgttggatttctcccttgtttcgtggaaaactcatccagtagcctgctaagaaggggtgaatgaaaggtatagtttttgaa

SEQ ID NO: 135628 - DNA, 743 bp, Homo sapiens
ctcagcaggtttctaaactatcacctctcatttgactttactcaatccttgtcgtatcagcatatactatttgcagtaatgcaataaatactttgaaatatacaataaataattaactacagttacactattgtgctactgaacagtagatcttattccatgtaagtgtattttcatacccattaactatctggaattgaattggatttttcattaacacaaataaatgacaaatgcttgaagtgttggatatctcaagttaccctgacttgatcattacacattgtatgcatctatcaaaacatcacatgtacaccatacacatttgacactaatatgtattaataataattaaaaataaaaaataaaaaattgaattttttcatgtaattgaaacaaaaaaaaaaaaaaaaaaaaaaaaaaaaaaaaaaaaaaaaaaaaaaaaaaaaaaaaaaaaaaaaaaaaaaaaaaaaaacacaaaaaaacgaaacaaaagagaaaaaaagaaccaaacaaaagacaacaacaacgaaagcaggggcgcgggggcgcgacgaggaaaaaaacgaagagcaacaccaagcaccgacgtaggggcgggcggcgccaggacgacagagaccaacgcggaaggagacaggccgcagcgaggagcaaagcggagagaaagaaggcggatggcgagcgccccacacaagaaagacaaagcagggagaaaagagagaggaggagaaaaaacgctg

SEQ ID NO: 135629 - DNA, 280 bp, Homo sapiens
aattcatgaattttagctaagttactctagctaagttgatcttgcagtcttgagttcaaaggctggaaacctgagctcaatctgtgttgcagtgtagaggcagaattccctcctcttaaaaagacctcaggtcttcagctgattgcatgagacccacccacattatagagggtaatcagctttacttctaaagtctactgatttaaatgttaatcacatgtaaaaaatactttcacaaaaaataacaatgatccttttaaaaagtaactaggaataaaaa

SEQ ID NO: 135630 - DNA, 475 bp, Homo sapiens
actgagtcaatctctgctttagaagtctcccacaaaaaggatcctacataaattactgtgtgtttaaaggtttctgattttaatctaataactgaaatatcaaactatattttaattcaggcatttgggcatcactaccacgtgttctcatcagatttaggaaccctgcagcaagatttatcagtgtcaaaatgctaaaatcctaaatttagtgccagaatccctctcaaatggcatttatattttgatagcttaacctactttgaatcccctgagcatcttgtctgtttttattagtagattttgctgatcttttttaacttttcaaaggctctttaaattatcctgaagtcatatatttaccatgagaaagcaggtgtctttttagagtgtagatgcttaagtcgctcataaaattaatttcctcgggttaggagaacattttgaaactctaatttgaaaaactctaatctgg

SEQ ID NO: 135631 - DNA, 429 bp, Homo sapiens
cacacaaaaaaccctcatatccaaaagtaaaggataaccagacaatctctaagataagaactctcaaaagtatggatccgcctttcctatcgctcagcctccttagtcttgacagcagagtgaaaactgttttctacaggtgaaagccctaagtcttcatcaaagccataccagggacggaaaggtagaaaagtattaacgctaaaatctcacgcctaagctttaacacccttccggaacagtaagacagaactaggcccatcagaaattctacataaaatcagtgaccactagtcactagtctcctagtgcttgaaactctgagaaagcaatcaagcagtccctcattttcctgagatttttgggctggcctgagcacacacaagaccaacggagtcaaattaagttggcaataaaacaagcggttcc

SEQ ID NO: 135632 - DNA, 374 bp, Homo sapiens
agttggtttaggccctacagctccagggaagtcactgataaggaaggagatggctccagccaatgagtaccagcctcccctaccccacaccaaaatgccaagaaacttagatattttcttatgtctgattcctcctcccttattcccaccctagccctccacagagatgtcagaatcactagggaagatcaatttggtaaactagctgggacacagccctgggccacactgacttccatcctgccctttgcggtaacacccagatggagggaggggaacagagggcagcacactatgtggccagcccatgcatccagggacaccctggcccacaacagtgccccagcagctgtcccaccccctctcatagaaaa

SEQ ID NO: 135633 - DNA, 711 bp, Homo sapiens
gtttctccattgccacatcatgccatagactaccagtaccctcttcacaactgagaattgtctttaatacctttaaatttaatcacattagagaacatattccaagaataacagaaccaaaccaattcataaagcttatccttaaaaattctattcttatggaaccactcttagggcagaaatctgtatgggtcagtcagggctccaccagaaaaacagaaattgctctgacataactttaggtgcaatttatggagaatgtacatgtatgtatatacatacctatatatatatgttgtgtgcatatatgttggtttgtgtgtgtgtgtgtgtgtgtgtgtgtgtgtgtgtgtgtgtggagagagagagatttattgaaaagaattgatttatgtgattatggaggctggctgggcaagtccaaaatctttagggcaatctgcaagctgggaattccttggaggaaacttaagctgcatgttttcttcatcagggaaagcactcatctgttcttttgatgattgagtcaaacccacccagattattgatgataatctcctttacttaaatcaactgattatagatgttacatatatctacaaaattcctttaccacaccacctagattaatgtttgattgaacaactggggcctatggcctaactaaacagtagtttaactttgctctggatgactcagagtcatcccaca

SEQ ID NO: 135634 - DNA, 446 bp, Homo sapiens
tacaggcactgaaactatttccaaaagccaatacaaccccaaatcctaaccctaaactgctgctcctctcatcatctttaatttttgaaaaactagtcaacaaatatgtctaccacattcttcatatccagtttcccgttaccactgtcactatttacaaccccacgatcacagatacacttgtaaaatgaaacttgttcataaattgggaattgttagtattccttagtgctgtcttgcctttctttaattagtttattaaccatattatccaaaacatattatcaggaggctcgctttgtattgttatttaggtaaatacctgtgtaggggacataagaccttcattaatatccaagaaaaagtgtatttatcaaagttcttgcgaactaaaatgttttaagtaattttcttttccttttgtattttcaaaggagctgcatggt

SEQ ID NO: 135635 - DNA, 395 bp, Homo sapiens
tgatctacccgcctcagcctcccaaagtgctggtattacaggcatgagccaccacgcccggctgtagagatgtatttctacatcatccttttagattgctccattgcattcaggaatttaaagaacttgaatgtcttctcaaaatcgggttctgtcactgcagtcttgtggcattaccaatattttgatagatggtgtgagctactgagctgaaaataagtttatttttattttttattttttattttttgagacggagtctcgctctgtcgcccaggctggagtgcagtggcacaatctccgctcactgcaaactctgcctcccaggttcatgccattctcctgcctcagcctcccgagtagctgggactacaggcgcccctcaccacacccgg

SEQ ID NO: 135636 - DNA, 331 bp, Homo sapiens
gggaaagggtatcctgatgggaatcatcaggcctccttggtgccagccctgaccctgttagtatcttgctgtcacttcacctccctgcatctcattttttaaaaccatggaatgaggagattggaccagatgatcattttccagactgcttagttgaacacaagcatcccatggtatattattaggttttcgttaaaacagagggtttcatggtttaataaattagaacacttcccattttattacttttttgaagaagaatttgcctatttaagttctggaaaattcggatgtaacttctccaaaaactgaaccacagagtacttatttc

SEQ ID NO: 135637 - DNA, 451 bp, Homo sapiens
actccgtccctccaggctggggtcattagagcagtgaagaataccaacaggcagatgccagtgaacagctgtgggctggttgtgccactgctaggtgccatcctgccccacctaacagagcccagatctattaggctctgctgacagccaggcagggaaccccaaggaaccagcaccatgctcccgtgccctcacagatcccgtgttccttcaccctcatatttccatgacaggtttttagcagaaggtcagtgtatttctaaatgaaatataacatgctaatcttttttgttgtttaggcaaacttttctcttttttttgagacagagtttcgctcttatcacccaggctggagggcaatggcacgatcttggctcaccgcaacctgcgcctcccaggttcaagcaattctcctgcctcagcctcccaagtagctaggattacaggcatg

SEQ ID NO: 135638 - DNA, 503 bp, Homo sapiens
ttgatatgcagtttcaccataatgtatctaggtatggattgtttttgaaatttattctgtttaaggtgatttatgttaaattacgccttctctatctgagagtttatatttttcattagagctggaaaattatagtgttatctctttgaatatttaatatcctctattttctcctatttttatgtcctccagttgaaattaggtcgatttttttttatcctttcattttccttacacttttttgtttctttcatatcttgtgaaagactatctctaagtctttaattgtatttaatttgccatgtaattgatccattgagtatataatatatatatatttatttcaatagcttttagagtacaagtggcttttagttatttggatgaattgtatagccacacttgtggctgactgccgcagttactacttgagatggtcactacagcagttactactgttactacttgagactgtcattacagcagttactactgttactgct

SEQ ID NO: 135639 - DNA, 181 bp, Homo sapiens
actcaaaaacatcatgaaaatgaaaaaagtatgcagagaaaaaaaatcaaccaaatgccaatttgagaggtagctctgagcctcatagtattttttgcacagctctctccagtttattattttaagcatagttgagatcccactgcattaatacttttggaaactacatataatgaacgta

SEQ ID NO: 135640 - DNA, 378 bp, Homo sapiens
tattcaaactcagagttccagccacgcttgcatccagggctcagatagcagagggacctgcctgaggcttgatttagaagggtccacctgaggatgtggatgaagcgtgaattcatttctggcaggggtggcagcagaggcagacagctctgtggaggcagaggtggggaaattctggtgtctccttcctagtgtggaccatcgcgcctgtgttgagcagtggagatagtggggtctttcctgcagaggcctccatggtagggctcaaacattgttctagctggggtggcctccaagcctaataccttgaccctcttcgagattctctgcactgccaaatatcttctaataaattccttctctgcataaaccaactag

SEQ ID NO: 135641 - DNA, 208 bp, Homo sapiens
tgccccatttgttatcatttgcacattctctctctcccactctctgcctctttctctctctctcagacttttattctctgaaccacctgagagtatgctgcacacctcatagctctctgctgccaaaccaccccatgtgtaccttttaagagttaagaaagctgttaattttgtagaccaaactcttgtaagaattatgaaataacaa

SEQ ID NO: 135642 - DNA, 744 bp, Homo sapiens
aggcttttaacagtaatttctggcttcacgtatttagtttcataactcatgatttttcaaaaacttctggtttgaagacaccgattgccgaaagtccattgtgctgcataattacacttggtccacgtgacagcactaacatgttctgaaatgtttttagaagtagtctcagcaaagatgaaggattcctccctgtttgaaaagaaaatattctttgttttttctttgatctaagctctaagactagcagctagcatctgaaacttttttgacgagagtgacaaaccaactctaatattaaaggcaattgatgattatgggcactgaagggaaggtaaccccaggctggtgccccggaatagggatgggtcacaatgttgaggacatttcgcctgttgcagaacccacctgcaacacagtgtggcccttgccatgtgacttgtgtgtgtgcctgtgtgtctgtgtgtgcgtgttttaattttgacttcataagtactctagttatgagcttatttaacattgggttttactaataggggtatgtgttgagaaaatttcaaagttttagaatatggttcacccacatgttgcttccctgtaaatataatttttaaaaccagattctgggccgggcatggtggctcacctctataatcccaaaacgttgggaggccgaggcaggcgaatcatgaagccaggagtttgagaccaggctgaccaacacggtgaaacccagtctctact

SEQ ID NO: 135643 - DNA, 290 bp, Homo sapiens
tatcattggctgtttttttgtgtaaagtggcttatggaatgttctgtcatgttgtttatcaaataaatcaccttttaaaaatgtaaatatctttaaagattaaaaaattttttttccagaattatacttttaggattacaatgtttaggatttcagctttagggcttctgatcttttaggatttcaacattaaggattagggagttcaggactgtatcttttgggtatatgattggctaccctccattaccatcttaactgttgataggatcaagaaagtaaccattttt

SEQ ID NO: 135644 - DNA, 194 bp, Homo sapiens
tatatccatttaatcctcacaataatattgtgtgggctctttagctttagctccccactctacagatgagaataccgagggcacagaagtgaggaatttgcctaagtagacaaagaatcagtggcagcaccaggcattggatccagacagtctggcacttgggcccttgctcttacccactgcaccaggctgag

SEQ ID NO: 135645 - DNA, 397 bp, Homo sapiens
agagtccgccgggcttcgcagaacgcagactttttggtctggggagcccctgggaagatgatcgaccttccaagggaagagctagagggataggacattcctgggatgggaggtaagctcaggacaagcactgtcagtgccttccctcagagctctgggcctctgcagatgaagatgctgttggcattttctgcacacctcctccttggctggtgcgctgccagatgctttcagaacggcgatgaaagtacaggagatggaattgggctttgttcttcctgacaggggcccactcagcctccccagtccttattcccctaatgagcacttaagctcacacctggaatcctcggccctggactcctcctctagaaaacgcagatggtgacagctgtct

SEQ ID NO: 135646 - DNA, 253 bp, Homo sapiens
atacattatcctctaggtagaagttctgacacatgttataacacagatgaaccttggaaacactatgccaaaggaaataagtcggacacaaaaggacaaatattatatgattccgcttatatgagatatctagaataggcacattcataaaaacatagagtttctgtgtgaggtgatggaaaagctttagaaataggccggccatggaggttcacactcataatcccagcactttcagaggccaaggtgggac

SEQ ID NO: 135647 - DNA, 523 bp, Homo sapiens
gaatctggaatttctcagggatgtttatgtatggatagaaataatatgatttctactttgttaatgtccagtttattaatcttcaaacaaccaacattcctctaaatattcagacactagttacacaatgattaaataaagaacttaggaatttaacaaatttgatttctcccaaatttaaatattgattgcaaattgaattcatatgggcacgaatctagtcttataagatactcttggttgtttcaaatgagttaagaaagagctaaaacacataagcagcatttcaaagattgccaagctattttaattgtacctgattttaaaaagggcaccaatgtgctaacagcggtttaggtttgtgactccgttgtctgtattttcattcctctattgtattcttgtcattatctttaccattattgtttctctgctcaccaaacctaaccagggctgctaacaattcagtgctattgtgtgaatgagaaacagcagtacttcctcaagtaagaaaaaaaaagaa

SEQ ID NO: 135648 - DNA, 370 bp, Homo sapiens
gcaggattcctatctcatggtgcgagctgccctgccgtgcgtccacgctgtggcaggccctcccgtgccctgtctcctggctgggagcttctgggcagtgtcggtcagcagtgtggtcagaggccccaggcctggcctgcgatgatgcttcttaggcaggagcctataggcgtgaggcggggccttctgctcctggtgtcataggtgacgtgacctggaggcctggtcaggcccgtccaccatgagttgaagtctctccctctgtggtgtgtgtgtgtgtcttggaagagacgtggagactgcgtgaggctgtttctctcagcccattgtccatgcgcatcgctgtccacggctctcgtctgcagcagtc

SEQ ID NO: 135649 - DNA, 138 bp, Homo sapiens
tcctgggttggaagggttctagtgatggctgtagacaaagaactgtgtcatccatacaatgggggaagatggggaagagtagaaggtggaaggtcctgaatggaaaagagagatatgtgggcaagtaaacaccatgtt

SEQ ID NO: 135650 - DNA, 229 bp, Homo sapiens
ttaatggcatgagaaaaggatcacattaagtagttataaagaggctgtagaggccgggcgcagtggctcatgcctgtaatcccagccaggatgcatacttctgatgctgacttttccatatcatcttccctgaccctcctgatctccactgagtacccacgtgatgttcatctccacgagtgtgacggacattactggaatgttcaggaagatgatatggaaaagtcag

SEQ ID NO: 135651 - DNA, 558 bp, Homo sapiens
aaagtgctgggattataggcgtgagccactctgcctagcctgcaatgatgttttaaggctgctctaactataagcatgactccgtaatctttggttgccactcctcctttgtgatctttgtctacagagacactgcttgtctgtgggaggtcttcttagcctctctggtgttatgaagagtaacatgactattttatttgaaagcctactgtttctatacttgaggagcacccagattgctttgggttcttaggtatcctgcatctggtattttatggtatcgatagatgtagggattttctcaggttctttaggctcttaacttggtaggaattggggaatgtgcctctgcttcatctctcgtgatttttataaccaaagcttcattacctctggccagtaagtgaagtttgaatatggcagaagaaaactgggatgcttccagtttgggataggggataaataaacagtattgttttgttatttccttcaatggaaagagtggggagagagtgtcctaagcaaagttgaatatcaagagaaattgtctttctaatg

SEQ ID NO: 135652 - DNA, 772 bp, Homo sapiens
aaagttaggattttttttttcttttttgagacagagtcttgctctgtcacccaggctggagtgcagtggtgtgatttcagctcactgcaaccttcgcctcccagcttcaagcgattctcatgcctcagcctcccaggtagctgggatttcaggtgtgcaaccaccacacccagttaatttttgtattttggtagagatagggtttcacatgttggccaagctggtcttgaactcttgacctcaagtgatccacctgtctcagccttcccaagtgctgggattacaggtgtgagccatcacactcggccaaagctaggatttgaatataagtttgtctgaccctcaaaacccatgctccttcctctgtgttagccaacttcctgcatagccaacttcccagggtcatggaaagaatcattaacgcaacccaggaatgctctcccggagtgtggctatatctagagaaattgtggaaagaggccaggcacggtggctcactcctgtaattccagcactttgggaggccaaggtgggagaatcatctgaggccaagagttcaagaccaacttggacaacatagtgagaaccctttctctattcaaaaaacaagaaagaaagaaagaatttgcctaaatagaacagaaaaggctgtatgtgcaagacagttactgcaggttttataatagtaaaaagctagaaaaaaactaattattcaacagtacataattaagcaaattaaaatacatatattcaataggatattaagcagcca

SEQ ID NO: 135653 - DNA, 761 bp, Homo sapiens
ttccggcatgctgggaggctgaggttacaggatttcttgagcccaggtgtatgaggccagcctggacaacatggtgcaaccttcgcctcccagcttcaagcgattctcatgcctcagcctcccaggtagctgggatttcaggtgtgcaaccaccacacccagttaatttttgtattttggtagagatagggtttcacatgttggccaagctggtcttgaactcttgacctcaagtgatccacctgtctcagccttcccaagtgctgggattacaggtgtgagccatcacactcggccaaagctaggatttgaatataagtttgtctgaccctcaaaacccatgctccttcctctgtgttagccaacttcctgcatagccaacttcccagggtcatggaaagaatcattaacgcaacccaggaatgctctcccggagtgtggctatatctagagaaattgtggaaagaggccaggcacggtggctcactcctgtaattccagcactttgggaggccaaggtgggagaatcatctgaggccaagagttcaagaccaacttggacaacatagtgagaaccctttctctattcaaaaaacaagaaagaaagaaagaatttgcctaaatagaacagaaaaggctgtatgtgcaagacagttactgcaggttttataatagtaaaaagctagaaaaaaactaattattcaacagtacataattaagcaaattaaaatacatatattcaataggatattaagcagcca

SEQ ID NO: 135654 - DNA, 128 bp, Homo sapiens
tgatttctcagatgagtgagatgaggggtagcaccatatttacaagaatcttataggtctgtaattttttgatgctattatttctagtctcccagaaagtgcattagtttccaatatttgtaggaggg

SEQ ID NO: 135655 - DNA, 356 bp, Homo sapiens
cagcactaaggtctcacacaggcttttacagctggtgaggaacaaggtcggggctggcaatactgggagttcctaaacacaaaaggcattctcctctatcagtttgcctcccaagttttaaatgatgtcctttgaacatcagatcgcctttatcaaaaaatttttaagcctgaattttaaaggaatgagatggagtgaattagtgtgaagtctttttttctgagcttggtgtttattctttattttgttttcaatcgtataacattttctgtaatgtcccatttgagtaaagttatcattatcctctataggcatatacttattaagtacctaccagttgtgaaaccctaaatagt

SEQ ID NO: 135656 - DNA, 466 bp, Homo sapiens
taggtagccaaacaataatgtcagcgttcaccccatttcttctgagaagcttcaaaatgcatatctctgattaagcatgcaataaaagtgaagatgagaatcacaattgggcttatggcatacctctttctaagaactgaagtcaaacgtctaaggaaaattcataaatattctcaccatttctcaagtaacgacaacaaaatatccgtttccttgccctctacgtgtcagcaaatgacagcataacccagtaatctggaagtttgcaaacttttcccataagggaccagatgacaaatattgagactttgcaggtcacatatggccacatatattctctgtcgcatattctgcgtgtctttctcccacttttaaaattgtaaaaaccatttttaacccatagattattaataaacgggggaaaaaaaacaggccgggcgtggtggttcatgcctttaatcccagc

SEQ ID NO: 135657 - DNA, 124 bp, Homo sapiens
tgggttaaagtgccttgttaaaggcatagatgttctttcaggttggaacaacaatccaaatcaaaccttcctctattcaatgtatgtgtcatactcacagccactcacaaatgttaaaagcagc

SEQ ID NO: 135658 - DNA, 381 bp, Homo sapiens
ttcatgagagaatggagttggaagagttttgcagattgtaaagtgctatagaattgcaagtacccacaggcatttatgcataaaatgcttattactgaagtatgtatagcagcaggaaaaaaacattggaactagctgaaatatccaacaattgggatatggttgagtaagcattctgtttaccgtcacacatgatgggtttgtaataacacaaggatgtctattttatcgttcacctgcaagtaacaaaaacttgacttacaatggcttcatcaaagaggatttcttgatcatatacaaataagcccagagagagacagcctggcccagttctggggcccagtagggccattcaggaaccagctacctctgttcactgct

SEQ ID NO: 135659 - DNA, 379 bp, Homo sapiens
cctacctggaaactggtgtttggtgctttctctgctttctccctctgctctaaactgttcagagggatgaaagagaactggaaacacagctctctagttatggacaggtcttatggttttttgggagaagagattgatgagcaaatgtttggggttaactatgcgtttagatgtttctcagtacttctggtgataggtcacctctaaagagatacaagcacttttcacacctcattttaggcctcatttaagtaatgagaagctgagtaggttttccccattttataggcatggaagttgaggaccacagaagaggaattattctttcctctgcacttatgcagtattctacttttttttttttttttttttttttttt

SEQ ID NO: 135660 - DNA, 133 bp, Homo sapiens
attttgatttcaaactatttattacagggcgcgaggctgtgttccgcctcctccagctcctcctgataaccttttggttatcaggcgtcaactggagacaacaatcagttaaaatccagtaaatttggggtta

SEQ ID NO: 135661 - DNA, 563 bp, Homo sapiens
tgtgtgctaatatgaaatgatctctaagacacaatataggcgaaaaatgcgctgggactagcctccaagctaagagtatgctaccatctgtataatgtcaaagggttgcaaggaaagacatatatagttgtatatgcataaaatatcagcgaacaaatactcatgaaactggaaacagtgatagcctcaagcagggggaactagggggctgaggatcagaaaagtagagactttcactactacattttgatatggtatgaatttaacctactcatattttgtcataagaaataagcactgcataataaaaactgcataatataaccacaaaaacttaaaaaactggaatgaaaggttaccttaggctcctagtttaccaaagccaaataaagaggcttatgaacaacaaaatacttattttaatcaagcatccttttgagatgttttcacctgttaacagtgcctgtcaacaatgctcatatcctaaacatgaaccaaaggtgcttccatgcacaacaaggaaaaaccagctcctgtgaacatgggagaagagtctgcaagta

SEQ ID NO: 135662 - DNA, 327 bp, Homo sapiens
ccaatgaacatattatcacttcatgtagttatcatttctttgtggtgagaacatttaaaatccactgttttagtcattttgatatatgcattattattgactacaatcaccatggtgtgcagtagatcaccacagcatattcttcgtgtcttacttgaaaccttccaccagcatcatctctttcttggtctactcccactgccaccctgtggtaaccaccatcctactctacttctggaggctcattcttaatgttcctttacaggggaaatacaatgggtatgggtggtgccttggggctaccagtaactaagcgcaccctgtagg

SEQ ID NO: 135663 - DNA, 361 bp, Homo sapiens
gtcagttttggcttttcagattttgaagcgtgtttgtgggctgaatcttgcccttatcacccatttctaggatgctttttgctccactcattctttgtcttgcttcacttgactttgaactgtatacttttttccatcgttttactttcagtatcttcatacatgtatgtttttgtacgcctctcttagaacagtgtatggttttgtaaaaattcagcctgtagcttttacctgcctccttcatgacctttataatccccttggttctcagcctgccactcacaggacttttccctgtgctgcgttcccagtgccccctccccgcccccacctgtgctttttgttggattagtagaattgc

SEQ ID NO: 135664 - DNA, 283 bp, Homo sapiens
aattagagaaaaatgaatatgtcaaaatgaagtacactatttccaaataatagacatcttcatttagtataatatttttacatctgtatatttccattagtaccaggacttaccaacataaagaagtgggaaatcatcaagctgtgaagatgcaaagtgactgtaccattttgtattccaaccagcaatgaatgaacttgttcattgcttcatatcctttccagcatttgccattgtcagtgttcacatattggctataatgtagtttggccatagtaggtgt

SEQ ID NO: 135665 - DNA, 561 bp, Homo sapiens
gtaagcaatgaaaaactcatggaagtagaaaacttttaaaaaatttgttgttggatcttatttattagttttaaggtgtcttataaagaaaatactattctgcttttcaacaaaattagaggcaaagtaatcttactgcattccacaattgggtgatcccttgggtgaggaaactcagttactcccctcaaaagctgtccatcacatttctctttaacaagttttccatgcttggttaccttgagctactttagaccaaactttatgggcaggtttaaactaaacctgaggatggtagtttgttttcaagcatcttattcacattttaaaaagctcttcacaacctcttcccatctgcccatttgtcccaagtggaatagctttttttttataacttctgattgcttgattctttgtctttaaagccttcatttaacctcttttttccttatggtttttgcaaaaattgaaaatgcatcgatattacagttaattttttcagtgtgtatgtggtattaggcttagaactataacacaggaagtttttagagtatgtccact

SEQ ID NO: 135666 - DNA, 252 bp, Homo sapiens
ggccagagcaggtccgggcctataaaggtggcggcggcggcgacgcgcccggctcctctcagcggcggtggcccaggtagaggggtccgcgctggcggcggcggcggcgctgttccccgcgcggtccgcggagcggggtccgggctgcgcgacgtggggcggcggcggcactgcggccccggcccaagcccgaccccgggtcgctctcggctgccggggcgaaggcagaagaggaaggaagcaaaaaagaga

SEQ ID NO: 135667 - DNA, 275 bp, Homo sapiens
gttttggatgaggaaagtcatgttttctaagtcctctcccctaataaaacctacccaacaatagtgctttgaaaagtggtagttatcttgaagatagatactcttgccaaatgcaaagataaacattctttttgtctgctttataaatatgaaatatgccagatctatagtattttaatgtgcatctactttaaatgagtcatcttggggtttttataattcccttacattcttgcccctctacacttgaaataacaaaatgccttaattttata

SEQ ID NO: 135668 - DNA, 204 bp, Homo sapiens
tcatctgaagaggacataagtctgagactgtgggaagatatgtgcagtgtcactgtgggtaacgggaaggcccgagtgagaccgtgggaaggtgtgtgcagtgtcactgtgggtaatgggaaggtccgagtacatttcagttaggaaatcatttgtgcctctattaagtttatatactatgtttactggcctcttttatgcttg

SEQ ID NO: 135669 - DNA, 123 bp, Homo sapiens
actggctggctttgtgggctactatctctctctagcttttagagtttggtttttcagaatatttccaatcatcttgcacctgctccataaaaacattcccaagtgccaccccatttaaaatgt

SEQ ID NO: 135670 - DNA, 285 bp, Homo sapiens
ctcaggatgtaagaggcagagtcatgatctaaagcttcatttagtcgttgccataaataattagggttgtatatgtaaatgatctctggcccagtagaagggataatgtcagcttctttccttctcttcagtggaccagatttgaaaagctatcagaaataaggaagtggggaaagatggaccacaacagagagaacactgcctgcagccccaggtcaggaagctgggagcagaccctcaagaaagagtcacaggccccagaccagagagctccacacccacccc

SEQ ID NO: 135671 - DNA, 287 bp, Homo sapiens
gagcaaaactctgtctcaaaaaaaaattttttttttttaaagaagcagcattaatgcaagtggtatcagcacaatgcttctaaatgtatcccagtgcttccaacttaggtgactgaaggggtggtgaccgggaatttgccgaagtgaagcccacagcacagatttgggatgaagttatgtgggatggtgaattttggacatgttgactctgatgtccatgttttgcaatgtgaggagttcacttgagaattggaaaacagattctgacgttcagggagaggctgggc

SEQ ID NO: 135672 - DNA, 221 bp, Homo sapiens
tactaactacaatttcagacacccactgcggggcttgggccatgtcccctgaagataagaggggactacggtaacacaatttatcaaaaacacattgctcccagacaccaagaactttgcagggattcacatccttttacttcataatcccacttctaggactttatcctaaagaaataatcagaggctgggcacggtggctcacgcctgtaatcccagca

SEQ ID NO: 135673 - DNA, 620 bp, Homo sapiens
gtcagcatagaggctctgagaaaatgagaaaataacagacctattgttttgttttgaggatcacttaagcaaatatgtaaaatcagatcacatagaataattccctgacctcagtgagtcttctttctaaactgcttcctgtctgcctcacccatctatttctgcagttccacccactgcagttttaaagtgactttggatagctgggtgaaaaggaagagggcaatacattaagactcagttaatataatttgcataatgaaattgtcaaagtgttcttggcccaaaaaacttgtttataaatgaaagtgaaagggttgaatggataatttgaagagagtgccttttcggctctatatattcaatcataggatgtcttgccactgagtcagcaaaggtttttctccaacctactccattaaattttattttacgcattctttttttaatacatataagtatttaaaattttgaaatgtcttagttgtgcttcttaaatgtaaagtgcatgctatcccatttgatagcaatttctgcataagcctgtaggtgaataaaacagaacttcataatacgtggaatatatcggatatacacatttgtggtaaccttagatatta

SEQ ID NO: 135674 - DNA, 415 bp, Homo sapiens
gggtggatggatggatgagtggatgggtggacaggtggatggaagagtgagtgggagagagaatgggtggcaaacctaccatgtgcatgtgaaatatgcactccagggccagagaaatgagcagtgtttcagcgcccagagagacactgtggagaaggtccaccaggatgcctacctgccttacacaagagcctaactttggcacacctgtggcacacctgtggagagctgttctggccccggttgtctggcaggcctgggctactccgagcaggggaactggggcacagtggctgcacctccggctataccctggtttttccagttcctgatgcccgcccctcaggtggcagcatgaggtgactcagggacagacgcccttatcgtgacgcaagtccagcccccagtggagccc

SEQ ID NO: 135675 - DNA, 710 bp, Homo sapiens
gctgtggtttctgtcctgtatcattccaagtagactggtgccaagtgtggcccatgaaagtcttgtcggtatgaatgtctgactgaacttaaaacgaccctgtggtgggtgctactgacttaacagtaagaaatatattttactctgtaatcagcatgtgcctatagacatgtatctctaaaacaaaaactttctgaaatagagaacacagtatgtgctatgtactcttaatagttcatattctattctattcattttatttaaacactctggttacaatccactaaactgctttcacaacaagtgggtcatgatccactgtttgaaaaacatggactaaaccttagattccttaccctaaaaagagtaatacctatttgcatagggttgttgtaacaattaaaatggatactccatgtaaagtgcctagcatagtacctagtatgtagcaagattctctcaacattggttattaccattattgacaatgtcttaactgttcttcctgcccacagtcttgaccatccccaatttattctctgcacagaggcaagaaggaattttctaaaacataaatctgaccacatcaagtgcttgcttgaaaatgctttaatgaatgcctgctgctcctaggataaggcccaggttcttgcatagcctacaaggttccaccagctctggccctagtggacttctccaacctcagctct

SEQ ID NO: 135676 - DNA, 110 bp, Homo sapiens
ctctatataatgtgttttgttttcctctggctgcttctaagatttttttgtcttctaagctagttgttagccgtttgaatataatgtgacttttaggtgtttgtttttgg

SEQ ID NO: 135677 - DNA, 251 bp, Homo sapiens
ctggcttcaagtgatctgcttgcctcagcctccccctgggattcaggcatgagctactgagtctagccaattttcattcattattatatctaatctggttaggttaaatattggatttccttaacataaaagtaatttaaaatctgaactttgatactacatgaaagcttgaggctttaagcataatgaattatttatataattgtttgtttttcatttaatgagatcaactcagaaaaggcattcgtgga

SEQ ID NO: 135678 - DNA, 440 bp, Homo sapiens
gacagaatgagaccctgtctcaaaaaaatgaaataaaataaaataaaacaaatcaatataatgcacatgctatgagtgatgtttctgattgtgtgttgtgctaattttgaataattaacaagggttttaagttgcatttactccatgaaagtatgtactctgtgtgaaaatttttaaagacacaaaaaaagaaaaaaataaaatcatgtctttcattcagagacagccattattaacatttcaatgcatgtatttccattttaaaaaattgttttgagtcaggtgcaatggcacgcacctgtagtcccagctacttggaagctgaggcaggaggattgcttgagcccaggaggtcaagaccagcctggacaacatagtgagaccttgtttcaaaaaaaaagaattaattgaaaattaatctcgcttgattagaacaatga

SEQ ID NO: 135679 - DNA, 462 bp, Homo sapiens
gcagagccatgtcagatgcagcagaaaacagtgactgctatgcctgcagcaagatggagaccagagtgccctgtaggccagcacgcagcacccactcagggcagtgacctggagcttcctcagatccctctaaggcagacgttctgaatccatctttgttagcagtctgggagacgaacttagctttggtcaaccggcaacagcaaggcaggctggttgtagggaaggtgggctcagacgtggccccagaggtacccctcacccagcatccccagccgtggctgactcttccctgggagttgtgatcagaaatggggtggagcccagcgcggtggctcacgcctgtttccagcactttgggaggctgaggtgggaggatccttgaggccaggagctcgagaccagcctatgcaaaatactgagatcctatctatacaaaaaattagctgggtatgatagtgc

SEQ ID NO: 135680 - DNA, 287 bp, Homo sapiens
ctccaggttaataccacattgcccctttaggccaataatgaattctgatcaattccacttaagaatcgttcattgtttctttgtcactgctctaacctcatggcaaatgctgagatatgtcttgaggtgatttatcacaagggtttctgaatcatgatatatcacattcattgcatccttcacttaccaggcacccatttccaaaatattacatatttatctccatttttaacactacagattaggtcaatggtgagtgcctttttttaaaagtccctactaattag

SEQ ID NO: 135681 - DNA, 402 bp, Homo sapiens
gtggacaaattcgtttctgtgtccacaccaactgtcaagcacattagatcagtccaaaccatgcagattactaaaacctcccacctttaggattcttcaatacagtatcttccatctgacccctccacaaacaaaaactcatgtaactgccccctcaattaaatttttttaaaacacttccagctgaaaagttttgatgaaagagtcaagaaacccatactttagattccttgactccaaacttccagttctcaaaattcagttatttcttacttttatcaatacacttacaggggctctcttttgatctcgcaccagtagacaaacctcctgtctcaaaaaattacagcctacaatttactgaagtcaagaatttccttttatacaataaatgcttgtccc

SEQ ID NO: 135682 - DNA, 406 bp, Homo sapiens
caggatttggtcctgtcttcttcccctccccgaattggtaaagagaccaaaatgcttaaagatacatgggtgttataaaactgctttgtaacacaatgtattaccatgatagaaaatatggggctgggcatggtggctcatgcctttaatcccagcactttgggaggccgaggtgggtggatcacctgaggtcaggagtttgagaccagcctggtcaacattgtgaaaccccatctctactagaaatatttaaaaaattagccgggcatgatggcgggcgcctgtaatcccagttactcaggaggttgaggcaggagaattgcttgaacccaggagacggaggctgcagtgagctgacacagtgccactgcactccagcctgggcgacagtgtgagattgcatccc

SEQ ID NO: 135683 - DNA, 454 bp, Homo sapiens
cagggacccgtcaactagagaaagtataggtggatgctgggctgtgaaaccctagatttctgccacatcagcctttcactccttctctcaacgaatacctaagcactcacaacagactttgtggacctaggtgtgaaagttactgtggtgaacagaaaggtccaggctctgccctcagagagcatctagctggtcttgtgccagggcttgaaccatgccatggtctttcagctgactagatgtctttactgagcacctactatgtgccaagccctggaaacagaaagatgaggaaagccagggcctctcccttgagcagtatagagcagaagaacgatggtggtttcaggagagcctgaggcactaaggatgctagcacttcacatctttctctgctactgttcattttatctggtaggattggattctgttggaactcaggaaacccaaaata

SEQ ID NO: 135684 - DNA, 390 bp, Homo sapiens
ctcaatagatgttagggaggtacttgacaaaacttaacatctatcccttctaaaaagaaaatcccttagtaaaaggattgaaaggtgttttccatcttaacatagtcaaaggtgtgttgcaaattaatagtcaacatcatttatgacagtgaaaccctagaaacatttaagcttcccaaataaggttgttggcaacaccattaaaaatgttctgttctttttttttttggatgtgcgatactttacttggcactaaaaagtaaatactaaatgacaagagaaagcaaaattgttatttgaagatattatatgattagaaaaacaaaggtcaacagacaaatggttagaagcaatttaataaaagtgcttgttcacaaattcagtgtacaa

SEQ ID NO: 135685 - DNA, 670 bp, Homo sapiens
aactcagttgctattgggtatagcgagcataacttacatgaaaaggctaaaaccctctatacagctgacacaattaagaatttctccatcttattcctaacagctccattttatcccattgtacaccttaaaaatatttaagaaaatacatagtcaaggatataattaagaagtatttacgaaaactccaaactccatgttttataactaagagaattctcacttatgtatagctacaattcatgtaaagaaacagcttttgcttagttattgatgatttcacctaatttgaatccaaacaaaaatcctgaatgacatatttaatttttacctcgacaatgactgaaacattattactgaatacttacatatttaaattgtgtatttcacttatgagaaaagtaaaaatacaaatttcaagatctcaaagcaagaaggctcaataaaacattatataaaaatgttgatctttgactattttataactgttatgctaaagagaaacatgaaacctttgcattgttaatattagatcaagtaagtagaaagcttaaatattaacatttaccttccttggtccttcatcgcatgttacttgctattcaggccacatgagtttattgtctgtgatattagaaacacacttatataacctaatgggttacgatcc

SEQ ID NO: 135686 - DNA, 399 bp, Homo sapiens
taaaaaagttgttgtaaaacttgtatatggagcacacacatgctctttgaaataaaccagttaaataaaatctgtgaataaatatatggagttggcaacatttctctatactgttttccacagttgtctaaggtattgtcgtcgacatctgttgtgtgacttaaaagggctgcacattgttcagggccttctctctcattgctttttgtcttatgtttttgctggggcacctcacttcttacaagtctttgtcggaaaaagttgaaattgatatgtgaagactgctgtagccgttctgcctatcaactgtcttctctggattgtccagagttgttagagttgaaaatatgtccagaatctgcccgcttcttaccacctcctctgctaccactttggtcc

SEQ ID NO: 135687 - DNA, 490 bp, Homo sapiens
gaaatgtgataggtcttattaaggtttttttgaaaagatttcttattttatgtaggtaaacatacatgcacgttgttcaacaatccccaaatctatagtagtatgaagtatagttagcttagtcctggtccagagttttacacatctgatttgttagggcttattgtgtattgtaaagaaattagaataagaacatttaaaaaattttaggccaggcgtggtggctcatgcctgtaatcccagcactttgggaagctgaggggggcagatcatgaggtcaggagatcaagaccattctgcccaacatggtgaaatcccatcctactaaaatacaaaaattaggagggcatggtggtggcaggcacctgtagtccaaactactcaggaggctgatgcaggagaatcccttgaaactgggggacggaggttgcagtgagccaagatcgcgccactgtactccagcctgggcgacgagcaaaaactccatctc

SEQ ID NO: 135688 - DNA, 579 bp, Homo sapiens
gcgacagtgagactgtgtccccccaccgccgctaaaaagtcaatgaagattaagtgagatgacatctgtgaaaatcctggaattgtccttacctgagttacctacactacaaattatccataatttgtttcactcaagctaactttcccctgctctccagcagtttgctgggctacctctgtctcaacatcagtcatgatgataccagtgagggcaaatggatttttaaagcaactgaaataagagcaaaaccctgtctctatacaattttctttctttctttctttctttttttgatacagagtctcgctttcacccgggctggagggcggtggtgccatctcagctcactgcaacctccgcctcccgggttcaagcaattctcctttgctcttaggatatagacaaaaccacttgcatggcaggcaaggtcttgtatgatcttgcctccgctcagcactagctcgactcaatcccttgttctcaatcccttgttttcccaagtagctgggattacaggtacccaccaccacgcccagctaattttttttatatttcagatggggtttcaccatgttg

SEQ ID NO: 135689 - DNA, 423 bp, Homo sapiens
tcatagactgacattcagcttctaagcagggtagggtctccagcctgacacacgtcttcgtggtcacccaagcccccgaaggcagtgttctgtgctcatcatccctctgcgcctgtggtgacccgcacagctcaccccgtccatcttaacgccctctctcctctcacctgctgcccctaccctcccggctgtcccctgtgtaggcttcgcagcttctccgcgtccatcagctctgaggctcctggaggccttctctcttctccttctccccctcctcctctccttcccctctcccaatctcccgctctcccagtctctttacacaacatctgtgcaccagaaattttaaatatgatcctgcagtccctaactgtgcccaaggggcagtctcatcatgggctgtgttctgcacacctcctggcc

SEQ ID NO: 135690 - DNA, 201 bp, Homo sapiens
gtagttattaacaccgctcagcagcaagcgatgaaaccacaagaagcatagtcatagcctgtgggaggcagggagcagagaaatggaagggaaatctttgctaatccagatggcacaaatgagtccctgatcagagacgagtggtgttatcactcagcctacctgtgccctgttcagtgataaactgagcagtcaaacccc

SEQ ID NO: 135691 - DNA, 304 bp, Homo sapiens
ttgctttttcattcttatatcagttgtgtaagtatgtgtgtgtgtgcaagtgctgttgtcttttgttgttctgatattacataaatttatagtcatcttgtctttgctcttgagttttttatgtttcaatttgttgaatttggtgcacagtttgcgtgatttttttttattcaaacctttatgacgttctcgtttctgtatttgagcttccctgttgacttgtttgtgaatacttactgtttgccatagtctgcttctggtgatgaagaataagaatgacgagtccttaggtagggcaagttga

SEQ ID NO: 135692 - DNA, 432 bp, Homo sapiens
tacctaacctggcatatttctgacaatccctatattgtgcttcagcaatagtgaattattactagtttattgtgtttttcaaagcctctatgacttgaacatgttatttcctctgaatggaagtcctctcctattatgtctacctaacaaactcctgcttcaaagcccagttcaaatgctacctcccttggtaagccttccctgaaatgctctggatctcataagaatacagatgtgagtcaagtaccaatagaaatatagctatcattcctgccccctcctattcaggtggaaacacagtcctctgaaaagaacgccttgagcatttagggctggaatctcacatgctctcgtgagataactcattttatccaggcactgccagcagagaaggcttctgggagtggagacttgtctgctgcattcagtgtt

SEQ ID NO: 135693 - DNA, 262 bp, Homo sapiens
tcaccaccatcttatgcattcatgtctcttcctggagagaaacacctgccacattcacaccactccacacagtcacagattggtcgttcacatgcattagttggttttcttccccatgttcatgaactgtatgcctaacctcatccaatcatctggcaaatgaacactgttgtccacagaggaagctacgtgaggggggtccatttgcaatgcaaatccgtcatcattgctagaaaagcaattcgaagtagcatgatttttt

SEQ ID NO: 135694 - DNA, 125 bp, Homo sapiens
ttttccaaagtggaatgtacgattttatattctcaccagcaatgtgtggcagatctgaaaacttaaaaaaaaaaaagacaggtatgggctgcgtacggtggctcatgcctgtactcccaacactt

SEQ ID NO: 135695 - DNA, 756 bp, Homo sapiens
gccgggtttcagccgtttgacatcactgatatcagtataattgcctgcatcaggatcatccatattaatggcaatgactttccagtcggtttccccttcgtcaatcatagccaatatgcctagaactttcacaccaattatttcacctcttgcacataccttgcttccaatttcacacacatcaattgggtcattgtcaccacaacagccagtatgtttatcattgtgccctgggtcttcccaagtctgagggatggcaccatagttccagacatatcctttatacgggaacaaattcgcaacatagcgaagttttctttttttcacatcttgtttaatggggtttaaagggtcctttgtagcaacctccatttttgcattagaccacagtggtacttcaactaccacgtggaacacatccttatctgcataaattggaatatcttgaaatggagacatatattgtcctttctcatttttgaggaagactcggtacttcagggagaagggcgtggcgcgctcctcagtgctgaagccgctcatggtgccggagtccagccgccaccactgccacagagccaccagcccacatgtggcgccgactgacagcctctcccatttcaagaaataagtcggcatacagagaatcctaaattacacacaacttcacaagattcagacatcatctgctgcataagatgagacctttaaaagcctattctagaactagccacccttgccaagaataaattggaa

SEQ ID NO: 135696 - DNA, 177 bp, Homo sapiens
aaaaacatgcaatcaaagtcaaaaagagaaaagcctaacgaactggggagaaacagagaagatttctcaggagacaagttttaggaattatttcagggtgcttgagatagttattaggtagaccacatctgctcctggtgggggtgatctagatctagagtgctgtgcaatgtagga

SEQ ID NO: 135697 - DNA, 427 bp, Homo sapiens
aattagctaggcatggtggtgcccttgtagtcccagggagctactcaggagggtgagatgggaggattgcttgagcccaggacaggaggttgaggctgcagtgagctaagattgatcctgctactgcactccagcctgggagacggagcgagatactgtctcaagaaaagaaaccaaaaaactttttctggagatctaacatacaggatagtaactgtagttgataataaggtattgtgtgcttgaaatttgctgagacagcagatcttaagtgtgcttgtcacaaaaaggtaactatttgaggtgatagatatgttaattaactggactggtgatcacttcaaaagacgtgtgtatataaaacatcacactgtataccttcaacagatacaattttaattacaccacaataaagtggagggaaaat

SEQ ID NO: 135698 - DNA, 417 bp, Homo sapiens
ctgagtgcagtggctcgtgcttgtaatcccagtactttgggaggccgaggcgcacggatcacctgaggtcaggagtttgagaccagcttggccaatatggggaaacccgtctctactaaaaataaaaaaattagctgggtgtggtggcgggcgcctgtaatcgcagctacttgggaggctgaggcaggaaaatcacttcaacctgggaggtggagattgcagtgagccgagatcacaccactgcactccagccagggtgacagagcgagacactctcaaaatataataaacaaataaaaataatatgagaataatgggatggccactttgggaagcagctgatagttcctcagaaagttaaacacagaatcaccatttgatctggcaattccactccttgttatatacccaagagat

SEQ ID NO: 135699 - DNA, 825 bp, Homo sapiens
agaaagcttctgttgtccccagcacttcccagggatgcgggaaggaaagcgccattagaagggaagaaaatgcatgagcaggtgtgtacaaattgtattatgggcggccagacgggcagagttccaatcatcctgcaaatccctgtggaacctctgggccccaccggagtgtcccagcctcttctgtgtccccttctcctcactgtgaaagcactgggccatgggaagcagtgggcttcctacgtattttccctgggaggcccgagcagcagccaccctgctctatatagtgcagtctgaggggcatccagggagtaggggccgtgtcagggctccctcctcactggctgcagcagaaggatcccaaccacccagtttttcagtcagtcccaggcatcatgggcccccgaggagcatgggcactcagtgccacttaccaagcatacctactccaggcagaaggctcaccagagtccaactagagagagcaggtgaggtctcactctgtaagagtgaaagtaagagtggttctcactcttgcaaagtcctctgatgtgtccacctgtagctagctgaaggatgtgtgcttgcatgtggtgtgttttaagaacaaaacatctgcacgacagctacgggcagttcatcaacacaggagatcttgaataataatcaaggattaattaagtttaaagcgtatcacattttgtaccagtgtcagaatctgggggaggaagaacaattaaaaaagaattaggggtttttattggtaaatccaaattcattcctaaatcaaatgatgaaaatatttgtcgttgttaatactct

SEQ ID NO: 135700 - DNA, 124 bp, Homo sapiens
aataacatttaatttaaataaaatgttgcttggtctgtccctgaggctaaagggctaaagggcagtggcataatccgaactcgctgcagcctccaactcctgggctcaagtgatcctcccacct

SEQ ID NO: 135701 - DNA, 245 bp, Homo sapiens
tagagaaggggtttctccatgttaccaaggctcgtcttgaattcctgggctcaagcaatcggccagactcagcctcccaaattgctgggattacaggcatgagccactgtgtcggacagtattaaagtttcttgccaggggccatccaaaccttcaaattcctctacctttcttgtttgtgtcttacatctatgctttgagtctcccctttgtgatgatgctcagttatgattaccccgactgaa

SEQ ID NO: 135702 - DNA, 727 bp, Homo sapiens
cgttttaaaattttaagagagtttataggctatgttgccatgactctaatcttcaaggcttgtttgctttaaaagtgtgagtttctgattataacagtaaagctaatagtttgtaagatatacaagaaatcacctgggaaatataaatcctctattaacccattacttggagataacccctattaccagtttattgtattcttcagtcttttttcctgtatgtactctgtgtgtgtgtgtgtgtccatctgaacatgtgactgaaatgcctatgttgaaacttttgttccccccttatcaccaccaaatagtacagtgttgaagagtccatcagtacaagccaaacataatatcttactattcgtaatgtacatgttttatttctatgggatttagacattttccatactcattaaccatttgtatctccttttgttatttacctttatttttatccttggtccctctcttttgtttaatttttattttattggcttataagaagtgagaactgatattaatcttttataatctcaccagtatcctttttcaatttgccatttccctttttataacagtgagggttttttttttactaatagaagttattatttttcattttgtgcatgtatgtgtggtccaaactgtcagtcttttttttattcttctgatttcttccaagtttgttgttatgtatagttgtacagagttttgcttttttgacaag

SEQ ID NO: 135703 - DNA, 216 bp, Homo sapiens
cctaagacataggagattctgcttattgatcggcttgttgcctgtctgctctgcgaggacaggaaatttttgtctgtttttgttcatgcaatatccctagcacctcaacagtgcctggcacatagtaggtgctcaagaaatatttgggttcctttctttctttttatttgtttagtttgttttttgagacagggtctcaccttgtgacctaggctg

SEQ ID NO: 135704 - DNA, 670 bp, Homo sapiens
aagacaggaataactggtcagagaacaaagtacgatagctgctaggtgagcagtatgacaaagcaccactagggacagttcagaaagaacagtcacctcttttgaaggatcagtggagactttgtaagaatttagtctgaccttgagtaggcaggagacacttggagttaggcattcattctaggtaaaggtatgaaccttataacccatgtcttggctgggcgtagtggtgcatgcctgtagtcctggcttcttgggaggctgaggctgggggtatcacttgagcccaggagttctgaactatagtgcgctatgctgattgggtgtctgcactaagttaggcatcatgtgatgaactcccaggagctgggggccaaccaagtttcctaaggagaagtgaactggttcaggtcggaaacagagcaggtcagaactcccatgctgatcagtagtggaatcacacatgtgaatagccccagcactcccacctgggcaacaaagtgagaccttgtcttttgagatggtttgctgagtcctgtctcaaggttggggtgagaattctggggttctcaattctgcttttgagattgcagacttgactgtaaagtttgtaaatgtgatactgggagccttcctaagccttatagggtattcttaggataggtttgcc

SEQ ID NO: 135705 - DNA, 730 bp, Homo sapiens
aagacaggaataactggtcagagaacaaagtacgatagctgctaggtgagcagtatgacaaagcaccactagggacagttcagaaagaacagtcacctcttttgaaggatcagtggagactttgtaagaatttagtctgaccttgagtaggcaggagacacttggagttaggcattcattctaggtaaaggtatgaaccttataacccatgtcttggctgggcgtagtggtgcatgcctgtagtcctggcttcttgggaggctgaggctgggggtatcacttgagcccaggagttctgaactatagtgcgctatgctgattgggtgtctgcactaagttaggcatcatgtgatgaactcccaggagctgggggccaaccaagtttcctaaggagaagtgaactggttcaggtcggaaacagagcaggtcagaactcccatgctgatcagtagtggaatcacacatgtgaatagccccagcactcccacctgggcaacaaagtgagaccttgtctcttaaaaaaaagtcgccagaatgtcctcatctgagagaaaccacaagtatacatactcagtttgagatggtttgctgagtcctgtctcaaggttggggtgagaattctggggttctcaattctgcttttgagattgcagacttgactgtaaagtttgtaaatgtgatactgggagccttcctaagccttatagggtattcttaggataggtttgcc

SEQ ID NO: 135706 - DNA, 803 bp, Homo sapiens
aacaaattgacagggactctcccctgagtatctcagactcacctctgtctgcagcatgtattactcttgagtgttagccagctttgacaagttaaaattaaaaatgtaaacaggccgggtgtggtgaccaatacctgtaatcccagcactttgaagccaaggaggagcacttgagcccaggatttcaagaccagcctgggcaacatggcaaaactctgtctctacaaaaaatagaaaaaattagccgggcgtggtggtacacacctgtagttccagttacctagggggcagaggtgggaggatcacttgagctcaggaggtcgaggctgcagtgagccgtgattgtgccactgcactccagcctaagcaacagagtgagaccctgtctaaaaaagaaaaaagaaaaagtaaacaagatcgagagagagatgctaccatcctggaacctgtgtttgattagcttttgtaggtaagaacaggtatgtggccagcagcagttactgagttgccctttttaagaagagatggaacagggaaacccccattagtatgcagggttgattccagtacatcagcctaggaattgttaagcatctgcccaggaattgttagcagtaatagtggctccttcttccaactgtctcctagtacctcaatattgagtgaattctgactatttcatattcatttactgaactatttacattgtgggagtgaaacataaccaggaaccattaggatctgacagttgggaggctatgttagatattgtcccagaaagcaggtgattttcggaaagtgaa

SEQ ID NO: 135707 - DNA, 254 bp, Homo sapiens
tactcaggaggctgaggcaggaggatcacttgagcccagcagttcaagtctcagcagttcaagtccagcctgggcaatatagcaagactgcatttcttttcttcttcttttttaatacctggaataaagaactcctataaaatcactaagaaaaggggtcacttaagaatctcattaacaaaaagaatttgaatatttttccaaggaagatatgcaaatggactgtaagcacatgaaaagatgcagatcaggga

SEQ ID NO: 135708 - DNA, 560 bp, Homo sapiens
ccccacctataacaaaccacttcaaaatcctacataaggtaaaaataatctcaagatacaagaatgtttaatgctcttcttagattctgtatttttcccctctgattttatactaacatacacacattttcactttaaagaatctcatttaggaggcttcattttaaaggagtatatggcagtatttgttcatttaaaaaatggcatggggaaaacaaaactgactttgaaaaattccctttattaacttactgattacctttcaggaaatgttccagccaccctctcctttttagttgttgtaagtctgtgacacaccattaaggaccaaatcatgcaccatgtgcttacagcatagctcctcttcctaaccttttcctttcttcctcgcccaactgactgatacatgcaacccaatccagaaatcaccacacatttggtggtaattcccctgaattttacttgcaaatgacaaaaatgcaaaaatgtcaatttgcttaattttcctaaagacaagggcaacttcacacccgccatctttttaggtttagagctaagag

SEQ ID NO: 135709 - DNA, 750 bp, Homo sapiens
cccccgggttcatgccattctcctgcctcagcctcccgagcagctgggagtacagatgcctgccaccatgcccggcctcagctgatgttttgactgcccttcagttgaatggtcaaaatcctgaaagtgccaactatttttatttcatgtggaactgcagcttccaccttgctacaagattctaaacatagctctcattaactgctagtattccctgtgagtgatttgacattccacctgcattttcctgagacctggtgaggatcatcctgttaaggttttatatcattacagtttcaaccaactaactggtaagagaagacatagaggtgccaaacctgagagcaatcaaacacaccgctgagctacagggtgatagaatcagctctccttaggggccttgcattgtggagtctgatcgggattgctgcactaagttcagccctgggttttatttgataaagaaggcctggcacccttgtgcttctctgtggccctgcattctaactccaggtgcccaatttatcagtcttttatttttccttgcatgattctccacacctttcacttgctttatttttcacttcctagatgatcattttcggctctgttcacaactctgcagtaatatctcaaaagagcttacctcttaacctcaccccagtcatctataggtgctcttttgtcgatctgagtacagaatcccaccccagagtggtactttacacttgcaccacctccagaaagctt

SEQ ID NO: 135710 - DNA, 267 bp, Homo sapiens
catattggtcaggctggtcctgatctcctgacctcgtgatccacccacctcggcctcccaaagtgctgggattacaggtgtgagccaccatgcccggcctcagctgatgttttgactgcccttcagttgaatggtcaaaatcctgaaagtgccaactatttttatttcatgtggaactgcagcttccaccttgctacaagattctaaacatagctctcattaactgctagtattccctgtgagtgatttgacattccacctgcattt

SEQ ID NO: 135711 - DNA, 301 bp, Homo sapiens
tgttcctatttggccatcttgtaaccacccccacttttttcttttgttcctcttctaggcagttcccaaccctcagaggtgaacactgttttgattttctgttaccataagactagtgttgcttgttcttgagtttcatgtaaaatagtacagtagtacagtcaggcttgtttcgcttgacataacgtttttgagatttgttcatggtgttttgtgttttggtagtttatttgtttattgctaagtagtattcctccatgcaaatatactacaatatgattatctcttcctgtgttgatga

SEQ ID NO: 135712 - DNA, 146 bp, Homo sapiens
ggtgtgttcattttcccaccaacactcctacttcataaccttattttgtgcagtgaacaaaagaagatgtgattgtgtccttcacagtggggcaggttctgctcatcctttttgtagaggttggaaaaggtgagtgaaagggcgca

SEQ ID NO: 135713 - DNA, 606 bp, Homo sapiens
gtgagaacacagcaagaagtgccatttatgaacaaagaagtggccctcaccagatgctaaatatgtgggtgttttgatcttgaacttctcagcctcccaaatggtgagaaataaatttctgttgctaataagccacagaattttgtggcttgcttgtggtatttcattatagcacactgaatgaactaagacataacatctttatttattaatttactcatttacataacattactgtgttctagaagacctaggctttgggtaggttcggtgaccacttcaaggttagcttctggaagatctgagatcagatcttgattcagtactcactttattatttattacatatttaatattttatcacatcacagcaataattataatttggtgatcataatttcattttttaatgttttcattttaatgtataggattgcctaggctgctttaactttttaattctctaggatttttatgaaattaaaaaaaaaatctcaacccgtaacttccttatgtgagtgttttctcctaaaccctcatgctacgtagtagaacacttgttctggtttcagtttacaaactagagaacccattaataatgactac

SEQ ID NO: 135714 - DNA, 807 bp, Homo sapiens
caagcctgtacctcttgtgcttacccaatttttgaccacaatctcttacctgctctagagggaatggaattctgcagaccctactcaaactgtgtctttactgactgatttgcactgatagaactgtgtctaataaatactcatgtaataatttggattgatttataacacttacaaattattggaaactcatgtatgtcataattccataccgaggaccatctctagcacaaatagtacctttgtgtgaattaacagaaaggtgcccggccggctgcagtggctcacgcctgtaatcacagcactttagaaggccaaggagggtggatcacttgacatcgggagttcgagaccagcctggcgaatgtggtgaaaccccatctctactaaaaatacaagattagccaggcgtagtgctgcacgtctgtaatcccagctactcgggaggctgaagcaggagaatcgcttgaacccgggaggtagaagttccagtgagctgagatcatgccactgcactccaacctgggcaagagagcaagactccatctcaaaaaaacaacaacaaaaaacaaacaaaaaactcagaaaggtgcccctctaggtagatgaattacaaaagctcaaagttaagctcaccccaggcctggctggattttaatctctacttgcccccttacagcttttaagatttctccccttttaagtaccattaagactgatgaatcttaactgaattgtcagattgtcatttgagcctttaaactggctcctttgtagactttctgacagaaacaagatctagcccca

SEQ ID NO: 135715 - DNA, 669 bp, Homo sapiens
gagaaagagcacatgtcaaacatttttatgggcctgaagaaaacctctctgttgtgcacagttgtaccctatttcctcagtttcagaatgcagcctcgtgcctttatgcactgaattgaggctaggcaaagtgctaccacatgactctatggtgaaatgggctctgaagtgggaatcgtcgctctgcccataggaaggagcaagaaacatgggaaaaggcagaagaaaagaaaaattggccacagggtttagatgaggtgctggcaccatctgtgctggtcagggttcccatttgaactcctgagtcatgaaaaagatttacatattatttacataaagataacagtattattcttattgtaaaactaatggaactgttcgtagaagaatgccgcaatcctgataacccaacatatctgactcttctagattttgtccatgtgctgattatttcactagatataatagtataatacagttagcttcccatattcatgggttctgcattcttagattcaatcaacagcagattggaaatatttggagggggcagggcgcagtggctcacgcctgtaatcccagaaccttgggaggccaaggtgggcagatcacctgaggtcaggagttcaagaccagcctggccaacacagtgaaaccctgtctctacta

SEQ ID NO: 135716 - DNA, 320 bp, Homo sapiens
aaaacaaaaaaagccatacaagtaaataacgacagcagaaaacagggacttgcagtaacacagacagtatattccgggtgccgacactcaggcagcacacgccggccctatggggcttagggctatcagggtgtacactcacagctcgtggcaagcccactgtggctggatcagggataccgggatagggaggggaagaaggattcaggggccaagtgcagcctccgggaggtcttaaaggaaaaactataaaaccaaagtaggccaggtatggtggctcatgcctgtgatcccagcactttgggaggccgaggcaggag

SEQ ID NO: 135717 - DNA, 341 bp, Homo sapiens
ctggggcaaggattcacctttctcttctctttccaaatgtcccaatacaatttactgagtacagcctagctttccccacggatttctgatcccaccactgctgttctgtattttaatttcttagatccgtgagtctctttctcagtccttcatccgggtttccttggtttgcctattcctgtcagtccagaatattttaatgactcctgctttacagacggcagtatgtctttatatcaacttcactacactcaagcatttattcttctagagaaaaattttcaatttatttatctaatttccctcaagactccacaattttacctgcattaacatcaaca

SEQ ID NO: 135718 - DNA, 475 bp, Homo sapiens
gagggtctatacttatttcatctccttaccagactctcctttctctcttcaggcctaggcattaacacaatttttatcactacattctgatgactgcagacatgaacatcactaagctattctttagtgatgatcttaagatcttaagccatgcaaggccatgattacaggttcctaatctacaaagtcagtggggaaaggatcagtttacccaacatgataaaagattgatttcttcactaatagtcagaaaggtaaatacaatccctagctagcagggagaaagggatatctctagatattctttggataggtatccctgtaatttacaccataatcctaaagagaggtctccagatacactaaccaaggggaactcaactttagcttttgggtttcactgaatgcctagggctttccagtctgcagttttgttttctctataagtatagtcttctttaggcttacacataca

SEQ ID NO: 135719 - DNA, 502 bp, Homo sapiens
accatgcaacacaccccaagatacattgaatttgaaccacattgtctcttgttttctagatacctcacgtttcttcctctaagcctttatgctgttgttcccacaacacactgtggctttcttcctccatgttttatgcctgaaaattccttctccttcaaatttcaacctaaatatcccctcttttagaataccctcctgttcccttaccgctagcctcctagagtagagaaaaagaatgtctgttactattattaaatcacagtgacattagaatagagacaacttgaaacagaagtccttttatgaataaaccaattattggaaagcaagagtttatataatttgatatatatgactttagatgaccacaatgttgtaggagatggcctaaagttctttttttagtatacccttttctcaaggaatggcttatcagattttataaatatttatgccaataattgtagtatagctgtcctaggtgtgtagtactaaaata

SEQ ID NO: 135720 - DNA, 258 bp, Homo sapiens
ttcagattaactgtttctgtccaaagccaagaagacagaagtggtggatgtgtctatagctgcctcgggcctctagtgcagggcaaagatgcccctcagaggagtcaggtgaggctgaaatcgagcccacatgtcacctacctgttggtacgtggtgtgggaattcgtcagactgacaggaaagggttgcttgccaggctctgcacccctgaagccccatcaacccagaggggttcctcttaataaattgcacaaaag

SEQ ID NO: 135721 - DNA, 339 bp, Homo sapiens
ggaccgcggtatggccaggccaggcttggaagagctgggggccgcgcacatgtgtggcagcagagggccgggcttggaaagcctgggggacaccgtgcagcttgtgtggcagcagagggccgggcttggaagagcctgggggacaccgtgcagcttgtgtggtagcagagggttgaacagtgggatgctggtttaaatgggctttcaagaagtttcagaaacaaagccgtgtgcaacttgtgtcttcctgggcacgggtttctgggctgaggtcccaggtaccccttctcgtatttgggaagagtgaggcattaatgagagggacaggcaagcagaccc

SEQ ID NO: 135722 - DNA, 96 bp, Homo sapiens
gcaaaatgacagttctgtgatcaatgacaaaacatagtggagaatgctgttagaacaagcatgcacccccagctttgctctgtgcaacacggtaag

SEQ ID NO: 135723 - DNA, 334 bp, Homo sapiens
ttgcagtatctcgttttgctcacaacttcatggctttgtcatttttcctgttttagtgtactgtattgtgtgtttattgctaaacgtttttagaagaacaaatatttcgaaataaatatgcatctctaatttagtcatctttaaatttcctcaagcagctttcaaacaaagtacaaacttattttcatattttgatacagtaaaactttaagccgttggtctctgcctgtgttttcagtattgtttctttcttcttcttctttttttttctttttttttttttttttgagatactaagttaaaaactattattctttggttcttttttattgat

SEQ ID NO: 135724 - DNA, 221 bp, Homo sapiens
gagtctacttgaaaaactattccttctgttgtatgtaaactctaagtttcctcttctacattaatatttaatcatattcaagtctctcccatttaaaaatcactgtcttcccattaagacccgtgatataattttccattgtttcaaagatctctcaaaaatttaagttttctttttgaaaatacttttttttccagttcatttgtgggcattttctgtat

SEQ ID NO: 135725 - DNA, 846 bp, Homo sapiens
  misc_feature (836)..(836): n is a, c, g, or t
gctttttttccttttttgcttttttctcttcagccaatggagatggtgttgttggacacagactttctgatgtaaataaataccttcgttattataaaacttattttcatgacttatctgcatttgcagtatctgactttccactcataatatgttaaaacgatgccagagagatattttctggatgcactgatttagctttaacaataaaattattgttacttgttctgattagtggtagagctcattaaccgtgttccttctttttcttactgaaatgatcctgtttaaaagctcagtgagccacactttcttctaacacaaatattaaaaatgacctactgtcacttgatgatagttgtttctcatgcacatatctattgactcaaaatgaccacaatatgtacacccggaaagcactatttttattagtctaaataaaaaattgcattacaaatttatattcaacgtattaggaaaaattggacttcaatatataaagagactgaatcttttctttctgcccagagataaaaaggcaaacatatttacactcatgtaatcttacactcatgcatcatttgatgaaaaacatgtattgaagcttacagtaatagtgatgttaaaatctttctctttacaatctatccacatctctctcctttttgattacaaaggcttatatgatgaaacggttatgtagcattcaaggaaaaaagcctttggtgaaaaggaacgctgcggaaggggcccaaggaaagatgtctcccaaaaagggggggcaagctggggaaggcccataactcgattacacggcacacacatttgctctttanagaagagaca

SEQ ID NO: 135726 - DNA, 170 bp, Homo sapiens
tttgactttaggaaggcaaatcgtcctctttttagcttgcacattcaaaatagtttgtgtctcataaagtggagatttgccttgataagtaacagaccttgagagctcttatctcccaaccattcatccaacaccatttaaatctttattttaagaacagatttctggca

SEQ ID NO: 135727 - DNA, 220 bp, Homo sapiens
tactttcatggggctaaaatatatgtataatgaatctgtttcaggagtcagaaaggctttcttgggcaccaaggattttgaattctagctcaggggtgaggggactagagtaagatttaggaagtttaacagttcctctctcagccccagaaaccccagtgagggaatctcaaaagtctgggactcccaagaaatcccagactgtcaaagccaagaatta

SEQ ID NO: 135728 - DNA, 652 bp, Homo sapiens
ggataaataggcaaagcacagatttttagggccgtgaaatcatcctgtataatgctacaatgatgggtacacatcattatacatttgtctaaactcatagaatgtataacaccaagagggaacccaaatgtaaactgtggactttgggtgataaagatgcgtcagtgtaggcttattgattaactgtaacagatgtaccactctggtgcaggttgttgacagtgggggaaactatgtctttgacgggcagagggtatatgggaactctctttctcctcaattttgctgtgaacctaaaactgctctttaaacgtctatttttaaaaacagaacagctgtgatatgaaactgcatggagacaggtcaaataactaaggactactggtctaaattcagaatcaccctcagctgtataggtatttatgtgttcacttgtggcttagcttactgctgcttaatgggaaagttttgcttcccttcctcacctctgttttttgtttttttggtttttttctttacagtgatagtgaacaattacagtccttggaaagactgaattatagcttaatgaatgtacagatacaaatgtctggatgtttatattgccaggggtagaaatgacgagggaaaacatgcaacccccacaattaaa

SEQ ID NO: 135729 - DNA, 828 bp, Homo sapiens
actgcactctagcctgggtgacagagggagaccctgtctcaaaaataaaaataaaaataaaaataaaatgggcaacaacagagaaggcaaatcaaattcttcatctttcatggaagagagttaacagatactgtttcaagttttataaataaaaaaaacatgtttaagattatttacagagttttggaggtaaacagcaaaacaacttaaaaaaaaagtggctatcttgaacaactggatgggctgattgagaaaggccataacaaatcatattataattttgctttagtctaatagtcataattccagatgttgaaagtcacaggtggctttcatatgcataatcgctatgtcaaaaaattttagcagggccgggtgtggtggctcacgcctgtaatcccagcacttcaggaggctgaggcaggtggatcacttgaggtcaggagtttgagaccattctggccaacatggtgaatccccgtctctaataaaactacaaaaatcagccaagtgtggtggtggctacctgtaatcccagctattcaggaggctgaggcactagaatcctttcaacctgggaggtggaggttatagtgagccaagatcgtgctactgcactccagcctgggtgacagagcaagactctgtcttaaaaaaaaaaaaaaattgagggtgtggtggggcgaggtgcttgtaattcccattacttttggaggctgaggtgggaggattgcttgagcccaggagtttgaggtcagcaacatagtgagacccctgtctctacaaaaaattaaaaatgggccaccagacataataaaacatataata

SEQ ID NO: 135730 - DNA, 174 bp, Homo sapiens
gccaccactcctggcccaaaatatttaaacttaacaattttttaaaatataaatggtaatttgcttggacataaagaatttctataacgtgtgctctttaatgaaaggcttttatatggaaaccacccacctatccagtagcacagagaaaacatgccgacatttgcaaatttg

SEQ ID NO: 135731 - DNA, 318 bp, Homo sapiens
ccgagatcatgccattgcaccccagcctaggcaacaagagtgcaacttggtctcaataaataaataaataaacaaacaaataaataaaaatgaaaagaagaagacgaagagttcatcccagcctcttctccaccctgggctaggaatagctctctataagatataggatttagacaatggatcctaaattggagattaggtaaaaacaaaagaagtgctccaggactacacttctgaaaggaagttttcctagcccagtaactgcaagataggtatagagctataggtcatcatcagctccctttacaagtcacatgg

SEQ ID NO: 135732 - DNA, 202 bp, Homo sapiens
ttggttcggagtggaaagattaacatgaaaaaagctggagtggtaggcagaaaggcctagagaagatctgtctgtctgtctgtctgttttattcccccaacccctccccaccagccacacccagattgaggagcaccagcagccatgggctggcatgtgacaggctggtcagtgtgctgggaacacagttctgggcagagga

SEQ ID NO: 135733 - DNA, 513 bp, Homo sapiens
  misc_feature (325)..(325): n is a, c, g, or t
  misc_feature (412)..(412): n is a, c, g, or t
acatagtgagaccccatctctacaaaataaataaataaaataaaataaaaacagctgatttcgaactacataagatttaaaacaggagttaacaaaaacaactctcattacaagataaaaatgaagtaataaaaacacattcaatcttgttttgtcaactttgtgcaaacccaagaaaagttgtgaataaggaactaaaaaccttttaaaacttttaacaatgcccagtcacctagaaccagaggtggacattttctcctattgctagctgtgttatttgcattcttttgccatgttgtgcagcgagtagcagcagatcaaactngtcatgggccaagctctctgaacccggtaggaaccatggtaatgctagctgtctgtgctctcacgtggagaaggaaatcattccctngaatcttctagcctcatcactgtacaagacactgaagtgctcagcgtgaagagcccagacctgctcttgtaaggttaagaagaataaaagaagtgctatca

SEQ ID NO: 135734 - DNA, 661 bp, Homo sapiens
aacagctataaaatcagcttgatgcaagtgaaattacagtaaaattacacacttaagtaaggccaggtttcctggtttctcccaatcctgatagtgattctatttaatttatgtatgtatgttaggtagacatgaaataggtctcatgggcaagagtttctgacttggatgagcaagagtttctgacctggaatgtcagttatttcatccctgtttttcagcatatgtgactcatggctggctacacatgacagaacttacaaacctggattctaaaattggcagagcagtagaatggagtattttcatttagcatttatagcttacaagtcatagaacaagcagacaatggaacattattataaatgatttactacatgtaaattatatacattatttggtgcattcagtgatgatgaatattttgtcctccaagaataagtgaggcttaaaccttttttttttggaaaaagtatattcactgtacaagcatatagattgaagcaaagaatactgagttttctctttaactgaagagtataagctttgatcagaatatactgatctcaaacaatttctctagtgctgtttataagacacacctatgcaacagttagaaggaataagttcagatgttcagtagcagggtggggtgactata

SEQ ID NO: 135735 - DNA, 396 bp, Homo sapiens
ctcattccaagaccttaacttttaagagccctttgttccaacgttagtgtggacgatgctcttgcaggatgcctttccttttgggtcttagacaggtaattgtttctgcacggatcgggtttggaagggaagaaggggtgggagcttgtttattgtactactgctttgggtggagggaatattttagcaaatgcctctcagttagaccaggccagctcccacacagaactttccagtctcccttcttgtttgctagttgctccttactttcagagccaccgtgttcttaaccctctacgtccccgaggtttctctagggctgaccagttctgattttccatcagacactgtaaaactgctttggaaacttcacggagaaacagctgaagaatgggg

SEQ ID NO: 135736 - DNA, 330 bp, Homo sapiens
ctcattccaagaccttaacttttaagagccctttgttccaacgttagtgtggacgatgctcttgcaggatgcctttccttttgggtcttagacaggataaggaagcctgtgtgggtaccaacaatcaaagctacatctgtgacacaggacactgctgtggacagtctcagtgctgcaactactactatgaactctggtggttctggctggtgtggaccatcatcatcatcctgagctgctgctgtgtttgccaccaccgccgagccaagcaccgccttcaggcccagcagcggcaacatgaaatcaacctgatcgcttaccgagaagccc

SEQ ID NO: 135737 - DNA, 503 bp, Homo sapiens
  misc_feature (406)..(406): n is a, c, g, or t
  misc_feature (480)..(480): n is a, c, g, or t
aaccgttcgactgagctccaagggaaatcatgcatgtgcttggaacagtcctggcacacaataagggttgcataaatattggtgacaattactgctactgccatcttttgtttttttttttggaaacggagtctcgctctgttgcccaggctggagtgcagtggcacgatctcagctcactgaaagctctgcctcccgggttcacgccattctcctgcctcagccttccgagtggctgggactgcaggcgcccgccaccacgcctggctaattttgaaaatatttggctgggcgtggtggctcatgcccacctcggcctcccggagtgtaaggattacgggcgagagccaccacacccggccgacactgatttttctttccagcgaggtcagagcccgggcagggntcagagcagagacaattgcgacatgacttatgtttcacaggaccattctggctgctgtctggacaagaagtcgnagggggtgagggtgaaagctggg

SEQ ID NO: 135738 - DNA, 202 bp, Homo sapiens
gcgcctgctgctcaggccgaaatgctgtggtgtgatcatggctccctgcagccttgaaatcctggcctcaagtgaccctcctgacttagccttgtgagtagctgaggcaggagaatggcatgaacctgggaggtggagcttgcaatgagctgagattatgccactgcactctagcctgggcaacagagtgagactccgtctc

SEQ ID NO: 135739 - DNA, 709 bp, Homo sapiens
gatcccccgggctgcaggctcgtgccgaattcggcacgatgtctcatataataattagattgtaatcattgttttaatctctgtctgggaaccaagattgaaagctgacttacttctctcttctgtcttgtgaaccatacggagcctattattttaaaatatgatcagacaagtaaggcttctcttactttgctctgctctgatcagaagagctcatgtgaagtctttgagattctcttatttatcatctttctaaaactgtgtttttgagcttgacagtactgaaaatgtctggatgaagcagaaaagaaagtgatgaaatgtgtttctgagcatcagagaccatctatattgccattaccttttctagttgtatataagaattcaagattagaagaatttagatttgttgcacatttttttcctcagcattttttcctcttgttttttaaaatgtattgcctctttccccattcagtgacactggacataggaatttttaattgtgtaattttctgttgcaaaaagggtaaataaatcctttgtcttttgaatatcttctatgtgaaataattgtgagtgacatttgaaaaagtgaatctgaagtcaaagtgagtaaattccttatttccctattttttaaaaacctggtatatgacatggctacagggcaaatgaaataaaaattgccatagttggtatgaaaaag

SEQ ID NO: 135740 - DNA, 3896 bp, Homo sapiens
ataaggctacggatgggcgggacggagcagcccaccgcaaagtggcggtttacttgaggcggttaccttagtactccgagtagactgagtctgtggcgagctgcgggccgattcctggccagtgccatctcagccggagcaggcctcggggcctcagaagcaggcttttatctggcccgaggctcccagccgttcagcgcgtcttcccataacctataccgattattgggactctcggctgcagacacaggagtcacagatgctgggaagtatggcccgaaagaaacctcgaaatacctcaaggttgcccctggctttaaaccccctgaagagcaaggacgtgttggcagtgctggctgagaggaacgaggctatagtaccagttggggcatgggtggaacctgcctcaccaggtagttcggaaatcccagcatatacatcagcatatttaattgaagaagaactaaaggaacagctaagaaaaaaacaagaagctttgaaacattttcagaaacaagttaaataccgagtaaatcaacaaattaggttgagaaaaaagcaacagcttcagaagtcttatgaaagagcacaaaaagaaggctccatagccatgcagtcttcagcaacacacttaacttccaaaaggacaagtgtttttccaaacaatttgaatgttgctattggaagttctaggttacctccttccctgatgcctggggatggaatagaggatgaagagaatcagaacgaattattccaacaacaagcccaggctcttagtgaaactatgaaacaggcacgtcaccggctagcatcctttaaaaccgtgattaaaaaaaagggatcagtgtttccagatgatggaaggaaaagctttcttaccagagaggaagtgctttccaggaaaccagcatccactgggataaatacaggaataagaggagagttgcccattaaggtccatcaaggtcttttagctgctgtaccttaccagaattatatggaaaatcaggaacttgactatgaggaacctgactatgaggaatcttcatctcttgtaactgatgagaaagggaaagaagatttgtttgggagaggccagcaggaccagcaggctatccattctgaagataagaacaaacctttcagcagagttcagaaagtaaaattcaaaaatccattatttgttctgatggaagaggaagaacaaaagcagttacattttgagggccttcaggatattctgccagaagcccaggattattttctagaagcccaaggtgatttgctggaaacccagggtgatttgacaggaatccagagtgttaagccagatacccaggctgttgaaatgaaggttcaggttactgagccagaaggccaggccattgagccagaaggccagcctattaggacagaaactcagggtattatgctgaaagcccagagtattgagctagaagaagggagtattgtgttgaaaacccaggattttctacccacaaatcaggctcttctaacgaaaaaccaggatgttttactcaaagaccactgtgttctccctaaagaccagagtattctactcaaatatcaggaccaggacttcccacccagagaccagcatgttctccacaaagaccaagatattctgccataatatcaggaccagaattttctacctaaggaccagaattttttatctagagaccagcatgttctccccaaagaccaagatattctgccaaaatatcaggaccagaattttctacctaaggaccagaattttttgtctagagaccagcatgttctccccaaagaccagaatattctacctaaatatcaagaccaggattttctacctaaagaccaggactttttatctagagaccagcatgttctccccaaagactggaatattctacccaaatgtcaggaccaggattttctacccagagaccaaggtgttcttcccaaagaccaaaatattctacccatatgtcaggaccaggattttctacccagagaccaaggttatcttcctaaagaccaaaatattctacccatatgtcaggaccgggattttctacccagagacctgcatgttctctccaacgaccagaatattctacccaaatgtcaggaccaagattttctaccaaaatatcagaaagtacactttaaggagccatactctgatatgacagatgagaaagggagagaagacttttctctggcagactatcagtgtttgcctcccaaatcccaggaccaggatgacatcaaaaatcagcaacctgcatcttttatgagagaagaaagagtgagagaggaattgcctctggactatcatcaatatgttgtacctaaaatccaggaccaagactcccctagagaacagaacaagcatatcaaactaccctcatcttttgagaaatgggagattgcaagaggaaatactcctggagtgccattggcttatgataggtatcaatcaggattgagcactgaattccaagctccactggcatttcagtctgacgtggataaagaagaagataagaaagagcgtcaaaagcagtacctgagacatagacgacttttcatggatattgagagagaacaagttaaagaacaacaaaggcaaaaagaacaaaagaagaaaattgaaaaaattaagaaaaagagagagcaagaatgttatgctgcagagcagaggatcctaagaatgaactttcatgaagatccatattcaggagagaagttgagtgagatattagcccagttacaacttcaagaaataaaaggaaccagagaaaaacaacagagagaaaaagaatacctgagatatgtagaagctttacgagcccaaatccaggagaaaatgcagctgtataatattactttacctccactatgctgttgtggtcctgattttgggatgctcatcctgatacctgtgccaacaactgtattttctataaaaaccacagagcatatactcgggcactacattcattcatcaattcctgtgatgtccctgggggtaattcaactcttcgagtcgcaattcataattttgcttctgcacacaggcggactttgaaaaatctataataagaatctgaaattaactggtagtattttggcttttacttaaaatcatccctgagagagtatttaagaaaagctgttcaagttataaaatatataatctgggaagaaatactgtctcatataataattagattgtaatcattgttttaatctctgtctgggaaccaagattgaaagctgacttacttctctcttctgtcttgtgaaccatacggagcctattattttaaaatatgatcagacaagtaaggcttctcttactttgctctgctctgatcagaagagctcatgtgaagtctttgagattctcttatttatcatctttctaaaactgtgtttttgagcttgacagtactgaaaatgtctggatgaagcagaaaagaaagtgatgaaatgtgtttctgagcatcagagaccatctatattgccattaccttttctagttgtatataagaattcaagattagaagaatttagatttgttgcacatttttttcctcagcattttttcctcttgttttttaaaatgtattgcctctttccccattcagtgacactggacataggaatttttaattgtgtaattttctgttgcaaaaagggtaaataaatcctttgtcttttgaatatcttctatgtgaaataattgtgagtgacatttgaaaaagtgaatctgaagtcaaagtgagtaaattccttatttccctattttttaaaaacctggtatatgacatggctacagggcaaatgaaataaaaattgccatagttggtatgaaaaag

SEQ ID NO: 135741 - DNA, 521 bp, Homo sapiens
accttgctaccaaatgaattaagttctagcgcttgtttttaccaagtatggttgcaaaatttgttcctgccttgaagcatgcagtatagacatgaaagaaggcacggtcaccgatccatcaagaagcctgccatccagggaaagaggcaggaagtatccaagtgcaattgagcaaaaacatagaaggattatctgaaagcagcgcaggcaaattggaatctgttagttctgtgaaacgaaatgacactactccttacaggtaattattctagaacttgacttataacatcccaaaggtaagtttagttaacttttaagtgtctgtggtgttcctgtggctcttttagggaatggctttgcttccattatgtagccattccacaaacttaactgaacataaatttaacctgaagaagggaagctccaggtttccccacctgtttggtatccagcctatccaaaagacaggctcctctttttcttattttgagcaaatgactgctcagtttcagcctctcttc

SEQ ID NO: 135742 - DNA, 124 bp, Homo sapiens
tcttctatttttagttcatttacaaaacaataaatgacaggtacagactgtggtttcagatgctaagagactggtaagttctgctattttatctctgaaggctgtaagtatcctgttttggttg

SEQ ID NO: 135743 - DNA, 805 bp, Homo sapiens
ggtaatgatgtgattgaacagtcaggaaatatgttacatgtttgacaaacacactggagagttcaacaaaaaataccaattggtattagacaaaaccaaagacaagcgttatggccgggcacagtgactcacgcctgtaatcccagcactttgggaggccaaggcaggtggatcacttggggccaggagtttgagaccagcctggccaacatggcaaaaccccatctctactaaaaatacaaaaattagctgggcttagtaatcccagctactcaggaggctgaagcacaagaatcacttgaacctggggggcagaggttgcggtgagccaagattgtaccactgcactccagcctaggtgacagagcgagaccctgtctcaaaataataataataataataataaaggcaaggattgtcaactccaagagaaacaaagggctatacaaaaaggaaccatgatcatatttactgttagcttaacagtgaaaaacatttgtttaaatcatagtattataaaccttgactactaatttaacaaaatactgttaaataactgatgagggtatagatgaaaaggaattgtgtggagagagagagagtgatcatctttctcctaaagtcaataaatgaaaaaaaaacagtaaatgcatatttaagaataaaagaataagtaggccaggcatagtggctcatgcctgtaattccagcactttgagaggctgaagcaggaggatagcttgaggccaggagttcaagacaagtctgggcaacatagtgagacccagtctctataaaaaaataa

SEQ ID NO: 135744 - DNA, 442 bp, Homo sapiens
tgagaaaggggagacagactctggagcagcagagaagggagggctcaggatgagaaatgtgagaatggggtttaggcatttccagaaaactctgactgactgactgactgttgggggatcatggtagacatggtgggaagtttagactagagatgccaattaacaagatcgtatcctcttccttcagcaggaaagtgtcacttaaaatctaattcaatcagtatatactgacagctattaattcacaggtgtggtgctggggagacagagagaggacactaaatgtcatatctcagggagctcatgcaccattagtataagcagacctattaatagatctaataaagtgtacatgctatgataaagagagatgtaaagttgtatggaatgaaagaggaaggaaaatgctacttgagtggggacaggaatgggggactagaaa

SEQ ID NO: 135745 - DNA, 441 bp, Homo sapiens
cccagcaaaactctctgatctatcttcttctcagcctctctgtgtagcctccattcctcctgggtatggggcaggaccctttctgaaatgagagttttcaaaggagaaggagaagatagagagtgacctttctaggttttatggtttgctttagcaggagggtttctaggttctatgacccatcttgaggaagataaattctggtttctgtgactcactttggaggatgaaggcaagcagaagagagggtatgaggagaaggttggaaagaccttgcttctgagttccttccaatgtccttcagttcaaaatactcaggctgaggcaccatgctttggggtgtcatgttctaagccccgacagcataagggcagcgttgagacagccagttcggactctcgcttggggtcccaggcgagagtctccgtcgaactgggtacc

SEQ ID NO: 135746 - DNA, 209 bp, Homo sapiens
atttgtctcatttctaaaagtgaattgcctgtttgccaagttgagaaacccctccaaaaatttctaatagtgtttaagatacatagtgattaaaatataaaaggtgcttaaaaatgcaatagtctctaaaattgatatttcatattctattagcagatcacttttttggaaaaaaatgtaatattttgtgagaattcagaccttcccat

SEQ ID NO: 135747 - DNA, 165 bp, Homo sapiens
gaggccctagccatgtattcatctgagcacagactgctatacaatttataaatgtaaaatattttaaccataattgtgtgagaccactgtctctttccacgctgtattcccctcggccatacttcctttcatatcaggcaggattggagtggcaacataattttt

SEQ ID NO: 135748 - DNA, 640 bp, Homo sapiens
caggggcagcattttaaaggaaatgagctgaaagtctactcattaaagtcaaaggaaaccttgtgcttttttttcttttcaatatatttgtttcttcaaagtgtagctataccagcttgcatagcccatattgggaattcagaaaaaggtgacactgttaaaaattttactttactttttggagaagttccttggagatagatcttttggggtaaaaaaattatttgggtgtctggaatttaaacctacgttgctcgtttcatttcagacatataagaaatgagtttcagaggcatttgttagttgtctgtttcctcgcagtgtaagactgtcaagcatataaatgcaggagccccagtggcctgaaagcagtcaagagttcctaccctccttggctcaatggaaacgcaagtgaactatacagcgttcaatggaccaatcaacagggcaaaaatcagtaagtgcatgtccagttttctgaggacaatattttagctacaaatgattcttttgatgctgtatgtatctcctcaccccatcccccttagggagtccaaaattgtgtcatttggcttcttatgtataatagcaaaattttatttatagcaaaataaaagtcagtagacatttgagtagctac

SEQ ID NO: 135749 - DNA, 118 bp, Homo sapiens
gaatacacccataaatgttcaaagatatatatatgagaatgatcactgtgacaccattttaaaagatacaaatcagagcacactaaatatcaactaacaggggaagggctgaataatt

SEQ ID NO: 135750 - DNA, 131 bp, Homo sapiens
atcagctggggagcaaggtggtgaagccggggctgctgagactggtggcagcgctggtgcaggagacccaggaaagcagcaggctccggagaaacctggagaagctactttgagttgtggcctccttcaga

SEQ ID NO: 135751 - DNA, 687 bp, Homo sapiens
gcacatatgggtagaggcagcctatgtaaacaaaaactcttcggggcctccaataattttaaagagtatataggagttctgaccaaaaacttagaaacccactggcttaaaaattctgtccctgccacttacaagctgtatggccttgggcaagagatttcatcctttcctgcctcagtttatccagttgtaaaaggaggtaatatgaaataaggtatgtgaatcaggccaggcgtggtggctcacgcctgtaatcccagcactttgggaggccaaggtgggcagatcacctgaggtcaggagtttaagaccagcttggccaacatgatgaaaccccgtctctgttaaaaatacaaaaattagccaggcatggtggtgggcatctgtaatctcagctactcaggatgctgaggcaagagaatcacttgaacctaggaggcagaggttgcagtgagccgagatcgcgccattgcactccagcctgggcaaaaagagtgaaactccatctcaaaaaacaaaaaaggtatgtgaatcatttcatgcaacaaaccaaggattctcttcccccgagaaagggtatcggcctcacatggctgaagagagagacaaagactggggcaacagagcagtggtgaatgggtctggtgactgtcgatcctggtcgtattacatatggggggatatagc

SEQ ID NO: 135752 - DNA, 309 bp, Homo sapiens
agtccgttcgactgagctggtagtgttagtggggcccaagtgagtgggcatttggggagggggttactatttcaggtagagagaggaaggctgtaccactgggtgagacataagactaaaggccttacacaccagttgggttctgctagtgtctctttgcactaaatcactgggaggtttctgcagaaaagtaatatcagatcttaggcccacattttagaaattttggatttccaaaatccaaaaagtgatggaaaccaaaagatttttttaggctgggtgcggtggctcatgcctgtaatcccagca

SEQ ID NO: 135753 - DNA, 239 bp, Homo sapiens
tctgagaccccctggcttgctcaggtctggcggggcctcaggaatctcccggtagagtttctctaccacagacatttctctttccttgcccctcacactgagctctggctcctgagtattccttaaaaagttatcgttggctgggcgtggtggctcacgcctgaatcacagcacgttgggaggctgagacgggcagatcacttgagtccaggagtttgagaccagccgcacgacatggc

SEQ ID NO: 135754 - DNA, 246 bp, Homo sapiens
tgtctggcacttagtaagggctcagtaaatatttgtggaatgtttgaataagacaggccttgtgcctgttggtaggttaaactggggctttgtcagaactgactgtcaaacatgcagcagagggcctctaggagggagggctctaggagcttagattggctgatggctgttttttagattagattccataggattaatatgggatttagggggaagtctagtgaccacattgataaaatttttatg

SEQ ID NO: 135755 - DNA, 919 bp, Homo sapiens
tcagcaaaactggatcaaaacaagctccgtgtactagcagccagcgaggaccactgggaccctcagcccagcatgggcacagtcagggaaggcagcgtacttgtgtgctcaggctagacttctccctaacgtagccatggttcccaaacctctgtgcttgttagatccattttataccaaaggtattaacatgggcagcctttgacacatgtattccaaaaagcaactttatattttcttacatattttttacacatttctttcttacatatttttcttacgtttatattttcttgcatcctgaagcctaagccgcacctccaaccaattaagtctcagtatctgggtgggacacaagcgcattgatttccacgtggggggaagttatggatagttatggataactgtaataagcgtgaagcctttatccagtgaaaagttagactctgctatttgggaagtgtctcatgtcagcttctggttcactgacaaggatggttaagctttttttcttttctcattcagtgtttagatgtgtgtatctctatatcagtttcttcctgtcttacagatgtagaattaggaatagagggcagaaatgaactattaatagcttatgattccagtcaatctacaggactgaaattggtagaactttaacttatattctcatctaaaacggcttacttccctcccagagacggccactcaccactgttaattgtccatttttatttttatagacttgttcttccggtccagtgtcgaaaactattgtgccttcttttcccggactaataaaaaactgtaaacttaaaatacacaaagtgacacattactgacatactgtattttcttctctcaacctttggtctacagaagaaattcacttattaaattctactagtttcaagatcaa

SEQ ID NO: 135756 - DNA, 607 bp, Homo sapiens
atcttgcccaccctctaatgacacgttggactgcgcactgaacatagatcctgtcgagggtgtttagaattgcgccttcgggtgacctggggtctgcttccagaaggtgacattttaaataaggtgccatggggcagctgaggagctgggattaggctttggcctaacgcccctcagtttcttcagatgtgatctgttagtgctgcgggcctggtaccttgaagaggtagctaactggatccaatccccacttcccctgtagtttcctcagttggagcaaaaatggcgatggtagaggtcagacgtcatcctctatcaggacttcctccggactgacacctgggagagagtcacacttcggtttacagcccttccccgctccctttgcgcaaaaggaaacagttatcacctcaactgtcaccattagcaagacttgttcttccggtccagtgtcgaaaactattgtgccttcttttcccggactaataaaaaactgtaaacttaaaatacacaaagtgacacattactgacatactgtattttcttctctcaacctttggtctacagaagaaattcacttattaaattctactagtttcaagatcaa

SEQ ID NO: 135757 - DNA, 349 bp, Homo sapiens
tgcctgattcatagcaagaaggggcagaaaggcagataaagagaagcagagatatcaagagaaaacaacatctagtgtaggagtctttaaaattgtgctgtaaagtgccaaatcataaatattttagactttgtggactatacagtatctattgtgactactcaactctgccagtgtagcacaaaagcaggcatgaacaatatgtgaacaaatgagtggggctgtattccaataaaattttatttacaaaaacaggtggagggacgaatgcccacaagccaaagtttgccatctcggtcctagagtactgctgtccagtagaaatacaatgtgagccatatatgtaatt

SEQ ID NO: 135758 - DNA, 556 bp, Homo sapiens
acaacacttatccaggtgaaacaatcagaaagggaccaacaccagcagcatagatgctcttgttgtgataagctgtactcttaagcatatataaaagtctagtgaattaggtagcagaaatattatcaaagcttactttctccacaccacaaatgaaggtcaattccaaataaattaaagatgaaatgtgaaagctaaaattataaaggttataggagacaatatcatagaatatctatatgactcaggggaagcatttaaaaagcaccaacagtaaaagaaaaaactaatgtattttatctttttaaagttaagaatttgtatccatcaaaaagcaacaaaaagagagtaaaaagacaactaatgagtaggagaggatatctgcaatacacaccactaacaaattcccatgttatatgcagaatgcctacaaattaccaaaaaagataacaagataaataatccagtccaaaaagtgaccaaagccttgaagagacacctcacaaaagaggaaatccaaatagtcaatgcatgtatgaaaaaatgctcaccttca

SEQ ID NO: 135759 - DNA, 444 bp, Homo sapiens
cctgggggctttgctccttttcccagctggcaggcccttgagcgcccaaaaatcccacaggttcctcccaaccaagggattattgctgcctcagagcaatggttgtattgtggaacactgaaactgtatgtgctgtaatttaatttaggacacatttagatgcactaccattgctgttctactttttggtacaggtatattttgacgtcactgatattttttatacagtgatatacttactcatggccttgtctaacttttgtgaagaactattttattctaaacagactcattacaaatggttaccttgttatttaacccatttgtctctacttttccctgtacttttcccatttgtaatttgtaaaatgttctcttatgatcaccatgtattttgtaaataataaaatagtatctgttaaatttgtgcttctaaaaaaaaaa

SEQ ID NO: 135760 - DNA, 2008 bp, Homo sapiens
accgttaaatttgaaacttggcggctaggggtgtgggcttgaggtggccggtttgttagggagtcgtgtgcgtgccttggtcgcttctgtagctccgagggcaggttgcggaagaaagcccaggcggtctgtggcccagaggaaaggcctgcagcaggacgaggacctgagccaggaatgcaggatggcggcggtgaagaaggaagggggtgctctgagtgaagccatgtccctggagggagatgaatgggaactgagtaaagaaaatgtacaacctttaaggcaagggcggatcatgtccacgcttcagggagcactggcacaagaatctgcctgtaacaatactcttcagcagcagaaacgggcatttgaatatgaaattcgattttacactggaaatgaccctctggatgtttgggataggtatatcagctggacagagcagaactatcctcaaggtgggaaggagagtaatatgtcaacgttattagaaagagctgtagaagcactacaaggagaaaaacgatattatagtgatcctcgatttctcaatctctggcttaaattagggcgtttatgcaatgagcctttggatatgtacagttacttgcacaaccaagggattggtgtttcacttgctcagttctatatctcatgggcagaagaatatgaagctagagaaaactttaggaaagcagatgcgatatttcaggaagggattcaacagaaggctgaaccactagaaagactacagtcccagcaccgacaattccaagctcgagtgtctcggcaaactctgttggcacttgagaaagaagaagaggaggaagtttttgagtcttctgtaccacaacgaagcacactagctgaactaaagagcaaagggaaaaagacagcaagagctccaatcatccgtgtaggaggtgctctcaaggctccaagccagaacagaggactccaaaatccatttcctcaacagatgcaaaataatagtagaattactgtttttgatgaaaatgctgatgaggcttctacagcagagttgtctaagcctacagtccagccatggatagcaccccccatgcccagggccaaagagaatgagctgcaagcaggcccttggaacacaggcaggtccttggaacacaggcctcgtggcaatacagcttcactgatagctgtacccgctgtgcttcccagtttcactccatatgtggaagagactgcacaacagccagttatgacaccatgtaaaattgaacctagtataaaccacatcctaagcaccagaaagcctggaaaggaagaaggagatcctctacaaagggttcagagccatcagcaagcgtctgaggagaagaaagagaagatgatgtattgtaaggagaagatttatgcaggagtaggggaattctcctttgaagaaattcgggctgaagttttccggaagaaattaaaagagcaaagggaagccgagctattgaccagtgcagagaagagagcagaaatgcagaaacagattgaagagatggagaagaagctaaaagaaatccaaatcacctgaacaaagccttatggaaggtagggaagttaactagtcctggggctttgctctttcagtgagctaggcaatcaagtctcacagattgctgcctcagagcaatggttgtattgtggaacactgaaactgtatgtgctgtaatttaatttaggacacatttagatgcactaccattgctgttctactttttggtacaggtatattttgacgtcactgatattttttatacagtgatatacttactcatggccttgtctaacttttgtgaagaactattttattctaaacagactcattacaaatggttaccttgttatttaacccatttgtctctacttttccctgtacttttcccatttgtaatttgtaaaatgttctcttatgatcaccatgtattttgtaaataataaaatagtatctgttaaatttgtgcttctaaaaaaaaaa

SEQ ID NO: 135761 - DNA, 435 bp, Homo sapiens
gagaagtatttttaccatctcttttaattcctcttgaatatttagccatggtctatatatgctgtctgagaacataaaactatggtaattttagttttcttcttcatctccagcctcgtggcaatacagcttcactgatagctgtacccgctgtgcttcccagtttcactccatatgtggaagagactgcacaacagccagttatgtgagtgtggtttttggatattttgaagtgggaattattaagggtgggcagaggcacctattctacttcccaaaggcagtttcttctttatgaagatgaaagtaaccaggccaggcgcagtagctcacacctgtaatcccagcacaggctgaggcaggaggatcccttgagcctaggtgttcaagaccagcctgggcagcctagtgagaccctgtctctatttattaaaa

SEQ ID NO: 135762 - DNA, 3722 bp, Homo sapiens
accgttaaatttgaaacttggcggctaggggtgtgggcttgaggtggccggtttgttagggagtcgtgtgcgtgccttggtcgcttctgtagctccgagggcaggttgcggaagaaagcccaggcggtctgtggcccagaggaaaggcctgcagcaggacgaggacctgagccaggaatgcaggatggcggcggtgaagaaggaagggggtgctctgagtgaagccatgtccctggagggagatgaatgggaactgagtaaagaaaatgtacaacctttaaggcaagggcggatcatgtccacgcttcagggagcactggcacaagaatctgcctgtaacaatactcttcagcagcagaaacgggcatttgaatatgaaattcgattttacactggaaatgaccctctggatgtttgggataggtatatcagctggacagagcagaactatcctcaaggtgggaaggagagtaatatgtcaacgttattagaaagagctgtagaagcactacaaggagaaaaacgatattatagtgatcctcgatttctcaatctctggcttaaattagggcgtttatgcaatgagcctttggatatgtacagttacttgcacaaccaagggattggtgtttcacttgctcagttctatatctcatgggcagaagaatatgaagctagagaaaactttaggaaagcagatgcgatatttcaggaagggattcaacagaaggctgaaccactagaaagactacagtcccagcaccgacaattccaagctcgagtgtctcggcaaactctgttggcacttgagaaagaagaagaggaggaagtttttgagtcttctgtaccacaacgaagcacactagctgaactaaagagcaaagggaaaaagacagcaagagctccaatcatccgtgtaggaggtgctctcaaggctccaagccagaacagaggactccaaaatccatttcctcaacagatgcaaaataatagtagaattactgtttttgatgaaaatgctgatgaggcttctacagcagagttgtctaagcctacagtccagccatggatagcaccccccatgcccagggccaaagagaatgagctgcaagcaggcccttggaacacaggcaggtccttggaacacaggcctcgtggcaatacagcttcactgatagctgtacccgctgtgcttcccagtttcactccatatgtggaagagactgcacaacagccagttatgacaccatgtaaaattgaacctagtataaaccacatcctaagcaccagaaagcctggaaaggaagaaggagatcctctacaaagggttcagagccatcagcaagcgtctgaggagaagaaagagaagatgatgtattgtaaggagaagatttatgcaggagtaggggaattctcctttgaagaaattcgggctgaagttttccggaagaaattaaaagagcaaagggaagccgagctattgaccagtgcagagaagagagcagaaatgcagaaacagattgaagagatggagaagaagctaaaagaaatccaaactactcagcaagaaagaacaggtgatcagcaagaagagacgatgcctacaaaggagacaactaaactgcaaattgcttccgagtctcagaaaataccaggaatgactctatccagttctgtttgtcaagtaaactgttgtgccagagaaacttcacttgcggagaacatttggcaggaacaacctcattctaaaggtcccagtgtacctttctccatttttgatgagtttcttctttcagaaaagaagaataaaagtcctcctgcagatcccccacgagttttagctcaacgaagaccccttgcagttctcaaaacctcagaaagcatcacctcaaatgaagatgtgtctccagatgtttgtgatgaatttacaggaattgaacccttgagcgaggatgccattatcacaggcttcagaaatgtaacaatttgtcctaacccagaagacacttgtgactttgccagagcagctcgttttgtatccactccttttcatgagataatgtccttgaaggatctcccttctgatcctgagagactgttaccggaagaagatctagatgtaaagacctctgaggaccagcagacagcttgtggcactatctacagtcagactctcagcatcaagaagctgagcccaattattgaagacagtcgtgaagccacacactcctctggcttctctggttcttctgcctcggttgcaagcacctcctccatcaaatgtcttcaaattcctgagaaactagaacttactaatgagacttcagaaaaccctactcagtcaccatggtgttcacagtatcgcagacagctactgaagtccctaccagagttaagtgcctctgcagagttgtgtatagaagacagaccaatgcctaagttggaaattgagaaggaaattgaattaggtaatgaggattactgcattaaacgagaatacctaatatgtgaagattacaagttattctgggtggcgccaagaaactctgcagaattaacagtaataaaggtatcttctcaacctgtcccatgggacttttatatcaacctcaagttaaaggaacgtttaaatgaagattttgatcatttttgcagctgttatcaatatcaagatggctgtattgtttggcaccaatatataaactgcttcacccttcaggatcttctccaacacagtgaatatattacccatgaaataacagtgttgattatttataaccttttgacaatagtggagatgctacacaaagcagaaatagtccatggtgacttgagtccaaggtgtctgattctcagaaacagaatccacgatccctatgattgtaacaagaacaatcaagctttgaagatagtggacttttcctacagtgttgaccttagggtgcagctggatgtttttaccctcagcggctttcggactgtacagatcctggaaggacaaaagatcctggctaactgttcttctccctaccaggtagacctgtttggtatagcagatttagcacatttactattgttcaaggaacacctacaggtcttctgggatgggtccttctggaaacttagccaaaatatttctgagctaaaagatggtgaattgtggaataaattctttgtgcggattctgaatgccaatgatgaggccacagtgtctgttcttggggagcttgcagcagaaatgaatggggtttttgacactacattccaaagtcacctgaacaaagccttatggaaggtagggaagttaactagtcctggggctttgctctttcagtgagctaggcaatcaagtctcacagattgctgcctcagagcaatggttgtattgtggaacactgaaactgtatgtgctgtaatttaatttaggacacatttagatgcactaccattgctgttctactttttggtacaggtatattttgacgtcactgatattttttatacagtgatatacttactcatggccttgtctaacttttgtgaagaactattttattctaaacagactcattacaaatggttaccttgttatttaacccatttgtctctacttttccctgtacttttcccatttgtaatttgtaaaatgttctcttatgatcaccatgtattttgtaaataataaaatagtatctgttaaatttgtgcttctaaaaaaaaaa

SEQ ID NO: 135763 - DNA, 3435 bp, Homo sapiens
accgttaaatttgaaacttggcggctaggggtgtgggcttgaggtggccggtttgttagggagtcgtgtgcgtgccttggtcgcttctgtagctccgagggcaggttgcggaagaaagcccaggcggtctgtggcccagaggaaaggcctgcagcaggacgaggacctgagccaggaatgcaggatggcggcggtgaagaaggaagggggtgctctgagtgaagccatgtccctggagggagatgaatgggaactgagtaaagaaaatgtacaacctttaaggcaagggcggatcatgtccacgcttcagggagcactggcacaagaatctgcctgtaacaatactcttcagcagcagaaacgggcatttgaatatgaaattcgattttacactggaaatgaccctctggatgtttgggataggtatatcagctggacagagcagaactatcctcaaggtgggaaggagagtaatatgtcaacgttattagaaagagctgtagaagcactacaaggagaaaaacgatattatagtgatcctcgatttctcaatctctggcttaaattagggcgtttatgcaatgagcctttggatatgtacagttacttgcacaaccaagggattggtgtttcacttgctcagttctatatctcatgggcagaagaatatgaagctagagaaaactttaggaaagcagatgcgatatttcaggaagggattcaacagaaggctgaaccactagaaagactacagtcccagcaccgctacagtccagccatggatagcaccccccatgcccagggccaaagagaatgagctgcaagcaggcccttggaacacaggcaggtccttggaacacaggcctcgtggcaatacagcttcactgatagctgtacccgctgtgcttcccagtttcactccatatgtggaagagactgcacaacagccagttatgacaccatgtaaaattgaacctagtataaaccacatcctaagcaccagaaagcctggaaaggaagaaggagatcctctacaaagggttcagagccatcagcaagcgtctgaggagaagaaagagaagatgatgtattgtaaggagaagatttatgcaggagtaggggaattctcctttgaagaaattcgggctgaagttttccggaagaaattaaaagagcaaagggaagccgagctattgaccagtgcagagaagagagcagaaatgcagaaacagattgaagagatggagaagaagctaaaagaaatccaaactactcagcaagaaagaacaggtgatcagcaagaagagacgatgcctacaaaggagacaactaaactgcaaattgcttccgagtctcagaaaataccaggaatgactctatccagttctgtttgtcaagtaaactgttgtgccagagaaacttcacttgcggagaacatttggcaggaacaacctcattctaaaggtcccagtgtacctttctccatttttgatgagtttcttctttcagaaaagaagaataaaagtcctcctgcagatcccccacgagttttagctcaacgaagaccccttgcagttctcaaaacctcagaaagcatcacctcaaatgaagatgtgtctccagatgtttgtgatgaatttacaggaattgaacccttgagcgaggatgccattatcacaggcttcagaaatgtaacaatttgtcctaacccagaagacacttgtgactttgccagagcagctcgttttgtatccactccttttcatgagataatgtccttgaaggatctcccttctgatcctgagagactgttaccggaagaagatctagatgtaaagacctctgaggaccagcagacagcttgtggcactatctacagtcagactctcagcatcaagaagctgagcccaattattgaagacagtcgtgaagccacacactcctctggcttctctggttcttctgcctcggttgcaagcacctcctccatcaaatgtcttcaaattcctgagaaactagaacttactaatgagacttcagaaaaccctactcagtcaccatggtgttcacagtatcgcagacagctactgaagtccctaccagagttaagtgcctctgcagagttgtgtatagaagacagaccaatgcctaagttggaaattgagaaggaaattgaattaggtaatgaggattactgcattaaacgagaatacctaatatgtgaagattacaagttattctgggtggcgccaagaaactctgcagaattaacagtaataaaggtatcttctcaacctgtcccatgggacttttatatcaacctcaagttaaaggaacgtttaaatgaagattttgatcatttttgcagctgttatcaatatcaagatggctgtattgtttggcaccaatatataaactgcttcacccttcaggatcttctccaacacagtgaatatattacccatgaaataacagtgttgattatttataaccttttgacaatagtggagatgctacacaaagcagaaatagtccatggtgacttgagtccaaggtgtctgattctcagaaacagaatccacgatccctatgattgtaacaagaacaatcaagctttgaagatagtggacttttcctacagtgttgaccttagggtgcagctggatgtttttaccctcagcggctttcggactgtacagatcctggaaggacaaaagatcctggctaactgttcttctccctaccaggtagacctgtttggtatagcagatttagcacatttactattgttcaaggaacacctacaggtcttctgggatgggtccttctggaaacttagccaaaatatttctgagctaaaagatggtgaattgtggaataaattctttgtgcggattctgaatgccaatgatgaggccacagtgtctgttcttggggagcttgcagcagaaatgaatggggtttttgacactacattccaaagtcacctgaacaaagccttatggaaggtagggaagttaactagtcctggggctttgctctttcagtgagctaggcaatcaagtctcacagattgctgcctcagagcaatggttgtattgtggaacactgaaactgtatgtgctgtaatttaatttaggacacatttagatgcactaccattgctgttctactttttggtacaggtatattttgacgtcactgatattttttatacagtgatatacttactcatggccttgtctaacttttgtgaagaactattttattctaaacagactcattacaaatggttaccttgttatttaacccatttgtctctacttttccctgtacttttcccatttgtaatttgtaaaatgttctcttatgatcaccatgtattttgtaaataataaaatagtatctgttaaatttgtgcttctaaaaaaaaaa

SEQ ID NO: 135764 - DNA, 258 bp, Homo sapiens
ttcccctagaatagatactgggtctgcagcgacctccaagggcagaggcaaacagatgttcagctctcctaaatacagctgaggccctgctggccaaggtgagaacttcatctgtgtctgaggtgctaaggccccgcgccgtgaggacagctgttgttcagggctagcctgccagctggggcacacgcagcccaggcaacgtttcctttcacctggaaacctgccacagtctacctggtttccctgtgctggggggag

SEQ ID NO: 135765 - DNA, 544 bp, Homo sapiens
taaaaatgttccacatcagtaatcatcagagaaatgcaagtcaaaatcggaatgagatgccatctcacaccagtaagaatggttgttattaaaagttacaaaacaacagatgctggtgaggctgcagaggaaaaggggaacaattatgcacttttggtgggaatgtaagttagttaaactactgtagaaagcagtttggatatttctcaaagaccttaaaacagagctaccattcaatccagtaatcccattattgggcatctaccgtataccccaaggataacagatcattctaccaaaagatacatgcactcatatgttcatcaccacactattaaaaatagcttaggattgtgatgtcatatctgctgaacaaaacacacatctccttctttctccattctcaagtaactaccattcaattgccaacttctatacatttgacaattttatatgcttcatataagaagaataatgcaggatttgtccatctgtgactggattatttcatgtaacataacatctgctaagtccatctatgttg

SEQ ID NO: 135766 - DNA, 826 bp, Homo sapiens
ggagcagaaaggaaagggagaaaaacgaatcccaaactttgggcttacctcttcctcctggctggctggccaaaatacatgttaccggtggagggtgtccaggttcttggtgtcttgaacaaagaatttgacaaaacgcacaaacaaagcacggaagggatgaagggatgtattgaacatgaaaatgcacaccacggtgtgggaggggcctgagtgtaggagctcaggggccccgttaacagaatttttgggagtttaaataccccttagagcattccattggttaattccatatgccttatgtaaatggagaggatgaagtaaagttacaaagtcatttacagcatacgccctatggagaggatatttcctgtcacagctcaagtgtgaattggccttatgttccctgcctccagaccctaattatctttctgttttctgagtcacttccatctgaatcttgcaacatatccctgtagttggtgttattatttccccactttacagatggggaaactgaggcccagtgagaagaagggtcttgtcaatgtcacacaactcatgagagcaaagccagggcaggaactggaattgtctgacttccagctctgtgtgtcattatacttgaacttatagctaataaacaataaacagtgaaccatgaaaaaaaaaaaaaaacaacaaacgaacacatagacggagagaagaagaaggagcaaagaaggacgaaagaaaaaagagaagagcagagagaagagagagacagagaaaggagaagagaagaagcaaagagaggagaggacagagagaggaggagaagagaacg

SEQ ID NO: 135767 - DNA, 240 bp, Homo sapiens
gcctgggcaacagagcaaaactctgtctcaaaaacaaaacgaaaaaaagaaccttccatggcttcacatcaggataaaagccagcgtccttccgtggcctactgtgcctgtccagggtggctctgtcttgtctctctgagtcgcacttctcttttctcactggggttcattgaagccagccctgacttccctgtgacgtgctctgtatgcctttgcctctagtccaagctcttctcccag

SEQ ID NO: 135768 - DNA, 230 bp, Homo sapiens
tgacttcattggactataacaagtgaattttgtttcacacacaaagaatattcccagtgcagacatctataccctcttcaatgttattttattaaggataccataattttaatttttccaatacagtcagtatttaaataagccgcaatgacaaagaataaaattcagtgactatggaagatgtaatgaggtactaaggaagtaaaaggtagtgcagaggcagggagaaa

SEQ ID NO: 135769 - DNA, 237 bp, Homo sapiens
gaataccttagcaaatgctcaccaaattaataaaatcatcatcctagtatttttagaatttaaaataccataaaaacttctcaatagcttcctaaaaaaggctaacctctaggatttgaaatggataattccaattcactcatatcaccactcactcttcctctatttcaccgtgctttgtaagaaaaaataaactcttccagtttttccctattaccaacatctacattagcatgg

SEQ ID NO: 135770 - DNA, 449 bp, Homo sapiens
agcagaagaaaagcagggactgaagggaggggcctgaccacctgctgaggagcaggcacatctgggctcttggggtgacggcagccactgagtacccagaatgagggcccaggggccctggccgcagggttaatgcctttgctcaaaacccccaaagctcctgatgccgagctggacatgtggaagcattcagccaatacttgtcagcagtggtcaggtttgtacaaatttatctgggtcagattatatgaagaaagtgctaaagtttcagaataagctcggtagggctctgattcgtaacagacttaaggaggagacatgggtgtggtcgccaggatccacattgcagccaaagtccgggggtctttcagtctagaatggtaactatgaacttccttgactgagggatctattacagaatcacagatttaacagaagaggggaacgtg

SEQ ID NO: 135771 - DNA, 816 bp, Homo sapiens
gctttgatgtttcaaagctgacgaggtcagcatcttccaggctgcaggaaacatgcctgccaggtatacctttcaagcagctgattaatatgtcatgtggtctctggtcagaggagagtgtaagggctgttgaaatgactcaccagctcagctcccgtgtctttgggaaacgctaccctgtcagcaagaggcctccagctgaaaagtaaagacacagatctgaaagggtacagttctagcgtccaacaaactattatacatcctaaatgaagtgagaaatggtaggctcttcacctgccagggcctggcggggcctgtgtcccaggactgcttaggaatccaagcctcgcactgtttatccattatactgatgagaagcctgtgagacagggaggcttgctgggcctccaaagtccacttgctggcttgttacttggcaccatcagatctacgctagggatggtgtaactagagcctttgagtgcatgaaaagtctgtggcctgacaaagcacttactgaccaaggaaaatcaacttcaggtgcagcaggaaaggtctggtacccagaatgtctggggttttgagacactggaaaagattgctaataatgtcatgggctcccttccctggaaataatctgaaaataggataagttccctccaatcttggatgggtcaacctcgtcttgaggtaaggagacggttacatcaacccatggagagggcctgtcagcaactctgagtctattagagggtatattttcaacacaaaaaacttttatcctggtaaaatatacctaacgtaaaagctaccatt

SEQ ID NO: 135772 - DNA, 498 bp, Homo sapiens
acgtatcacctgcctctaatggtaacatcaggacctctcatttcccagtagtgactttaatttcctgtcaccatttcctagacggttatgttcagaggctgggttgtgccatggcacatgaaagagaatgacaggatgcatcctcatttcatgttacaatttgccagaagatcattagagaagtccgtttatgccttactgcagatgaacggatcacatgattgcattcccattatttggcactgggattgaggtattagggaggtggagagtattacactcaaaataagtacaagtcttagtagggcagcagtggtcctcatggacactggtaagccgagtagagattcccccaagatgataaagttttaaggaaagccttttgggctatgggcctgatttatgtctgagttacataactttctttcctagacacataaaaatattaagagtaatcagtgacctggtggggaagaggttattcttcatcagacatca

SEQ ID NO: 135773 - DNA, 588 bp, Homo sapiens
taccttataataaaatatatgtagttggaagcatcttttgcgaaataatttcttttgtctagcttgtatataatgcaaaattgcaacttaccgagggcagcttaacaggatgtgttaaaattttgagtatttatattctttgacccagaaagttcactgctatgaattaatcagaagttcctataaaagtacagaatgattttactaccttgtttataatacagaaaaatttaaaaaatgtaattctaatactcagtataaacctactaaaatgaattgcattatatataaaaaaggaaacattaaacaagtcttaaaaataaattggagctttatgggtaatgacatgaaaaactgaccaagacatattatgtgaatgaagcaaggtgcaaaacactatgcatagtatgatcccatttgtgtaaaaatggggtggttgtgcatacatcacatgtaatgcattataattttctggagtaatacataggaaataacaatacctacctgtgagcaaagggctgaatatgtgtgatttcacttcatgtatttctatcattttgaatttgtacagaaaacatgaattacatt

SEQ ID NO: 135774 - DNA, 498 bp, Homo sapiens
cagcctccagctgccgggctcaagtgatcttcctgcctcagcctccagctgccaggctcaagtgatcttcctgcctcagcctccagagtagctgggtctacaggtgtgtgccattatgccggctaattttttacatttttgtagaaacggggtctccctgtgttgcccaggctggtctcaaattcctgggctcgagcaatcctcctgctttagcctcctaaagtcctgggatcataggcctgagccactgtgcctggccctattccaatctttatagaaagaaaattcacatgacatgaacacattcttgctgtcaaaaattttaatgacacagataaatcaaaattcacccatgaccataatccctcgaaaccttcccctctccagaggtaaccatggttatcaactgggtatggttcttttcagatatatttgagcatataaggatgtagtggctcatgcctgtaatcccaacactgcgggaagccgagatgggag

SEQ ID NO: 135775 - DNA, 410 bp, Homo sapiens
aaaaacttcactccttgactccagctggagtgcatatgtaatgagaagaaagagttttacactgatgaaggaatacaatcaccacccctggatcaacagtcagacttaaatagcaaatgtggcatgggttccaaagctctgtgattttcctatactgaaagatttctcccaaccatggaggagcctaacaattcagtcttcagggtctctaacagcactgacacactggatgttaattacattgtgattggagcttccttcccagacactccagtgtactactttcctcctttacagcctctcttctaactgccaataaaagagtcctcatgagctcagctccagcacagataagactgacagaaggttccgaggttggcatttgcaaaatcgcatgagcatataattgc

SEQ ID NO: 135776 - DNA, 758 bp, Homo sapiens
cactccaaaaagttcttttggggccctttgccataggttccccccagcccctgccccagacaaccactgatctgacttctatcactattgattagttttgcctgttagaacttcatataaatggaatcatagagtatactttctctttccctggcttctttcacttagctcagtgtttctgatatttatttatttcattgcatgtattagtagtttgccctatcttattgctgagtagtattctgttgtatggatatgccacaatttatccattcatcagttgatgaatgcttatgttgttaccagctttgacttttaggaataaaactggtatgaatatttgtgttcaagttatttttcatatatacattttaattagcatgagcgttctaattgctccacatccttgataacacgagatattgtcagttttcaattttagccattcttgtggttaatagtatcttgtagttacattggtttgcatttatctgatgattaaacatgttgagcatccatatgcatattggctattcgtatatcttctattgtgactcgtctgtttaaatctttagcttgtatttttaaattgggttgtcttattaagttatgagtttttaaatatggccaggcaacaaggtggctcacacctgtaatcccagcactttggaaggccgaggcgggtggatcacctgaactcaggagttcgagaccagcctggccaacatggtgaaaccccatctctagtaaaaatacaa

SEQ ID NO: 135777 - DNA, 335 bp, Homo sapiens
tcagagaacccatcttcaatttctgagattctttcctcagcttggtctagtctgctgttaatacagtgattgcactgtgaaattcttgaagtgtatttttcagctttgtcagatctgttaggttcatttttacattggctattttgtctgtcagctcctgtactgttttattgtgattcttagtttccttggattggggcttgccattctcctgaatcttcatgcattatccttagcaaactaatgcaggacagaaaaccaaatgccacatgttctcacttataagtgggagctaaatgatgagaactcatggacacaaagaactaggaactagg

SEQ ID NO: 135778 - DNA, 341 bp, Homo sapiens
catgatggtgacagccttgatgccaggagaggagctagcaactgaaccacagagacattcccagcagtcaacaggagccacagattgatgagctaaagagttgtgcaaacagtgtttgtttgttttgtttggagagggaagtccgtgtgtttagagctcagcttgtctccctccctcatgttacaggggaagaatcggaggttccgagtggggagtgactctcgcaaggccacgtggccagccacggccaagagcgacaccagaaggtgatagttctacttgcttctgagtccttagagcgcatagcctagtctgcagttacaaacatgcttgttcaaaac

SEQ ID NO: 135779 - DNA, 118 bp, Homo sapiens
atgtttgctttgatgatttcttttctgaagccccttcatagcattttcttgcacgtttgctttgatttcttttctgaagccccgtcatagagttttcttgcacgtttgctttgatttc

SEQ ID NO: 135780 - DNA, 135 bp, Homo sapiens
tgctgggattacaggtgtgagccaccgtgcctggccaggaggatttatttttaagagttacctctgcccaatcacaaatcctccagaaagttttctccacaattttctggctttctaattaaaaaaaaaaaaaaa

SEQ ID NO: 135781 - DNA, 123 bp, Homo sapiens
aacactgaagaaataggttcataaaacaaaatgtaaccatggggaagtatgtatgttaaagaactatatgaagctagaaaaataaataggccaggcacagtagctcacacctataatccagca

SEQ ID NO: 135782 - DNA, 780 bp, Homo sapiens
cacgaggtcacgagatcgagaccatcctggataacacggtgaaataaaatggtagttttacgtgtgaatgttatttgtgtgaaagattagagcttcaagtaagagatcagggaatcctgagtggttatatgctgtattttgggcttaaagatttgaacttaaccaagccacttaatcactacaatacgtgcctaacagacccccccatgaggctaatgaaatgctaaaggtgacctgagaaaatctgaaggcaagccactctgtaatttggtgacaacatacagtgaatttccgtgggaaaaagttaaagcttgtatgtaatatgtagattgatagatggtatgacataaagaatatgctatgctgtgatacatagaactgatatcatccaatgcactggtagacttgggccaagaaccatgtcaatcgaatgctgatgttgcttgtttatcctctgtgggatgttctgaatactaatcagaggtctggactatctggaagtacacacagggtttctgcattatttttgaagtacttttaacacaggaaggaagataatagatctgagttatattaggaaaaattactcaaaaaatatcaagaacaaattgacttaaaatctttttcagtgattagaaaattaaagatattaataatttgaaagacatcaatcactggacattaaggagatgtagattgagagaccagggcaggagaatcacttgaactcaggaattcgagaccacccttggacaacctagcaaaacctcgtctctacta

SEQ ID NO: 135783 - DNA, 369 bp, Homo sapiens
aaattttgtaactttttaggtattcttaaattttaaattgtggttaaaaacatgcaatagtcatttcagacattattaggtgtacagtttagaagtattaagtgcagtcctgttgttttccaggaggttagagatgatttttgtcttacaaaagtaaaagcaaatactcactaaacaacaaattgtcctttccacctctctctagctcctgaagaaccccattttactttcttttttcatgactttgactaagtattctatgtaagtgtgattatacagtgtctctttttttgactattttattttacttgacatagtatcgtaaagatttatcattattgtagtatttgtcaagatgtccctatttta

SEQ ID NO: 135784 - DNA, 281 bp, Homo sapiens
agctgggactgtgagtgcacgctaccatgcctggctaatttttgtatttttagtagagatggggtttcaccatgttggccagactggtcaggaactcctgacttcaagtgatccgcccacctccatctcccaaagtgctgggattacaggagtgagccaccactttatcttaagataaattttccatatgcttcaagaggagtaagctctaactggaatgtagggtactgaccctagctccatatgacctcacaaaaatctgttactaaaatagtttattt

SEQ ID NO: 135785 - DNA, 265 bp, Homo sapiens
ctatcaaaatattgtactgtactcaccctctttgtgatgatgtgagatgataaaatgcctatgggatgagatgaaatggggtgaataatgtagtgtttaaaacttagtgatttatttatctctggaattttccatttaatattttcacatcttggttgtctgagggtaactgaaatcacagagagcaaaaacaaggataaggttggggggactacagtacttcaatcctcattcttctcttgactgttctggctacctctgctaa

SEQ ID NO: 135786 - DNA, 240 bp, Homo sapiens
ttttcggaaagagcagcttaagatggtgccttcgtgaaggcttttgttctttctccagctgcatttccaaagatgagtttgtatcagtaagtgtaatctcagccagcctttgggataagagaagataatttaatgggtgaggccttggtttcaggcagggctgaggtgtgggattacagttcccattttcttggacttgtccttagcatgcgtaagaaaggacagagcagggtgcatgca

SEQ ID NO: 135787 - DNA, 811 bp, Homo sapiens
caactttgcttgatagattgcatgttgaggagtagagtcccactagggcattgatcaatggttctgttttggtcctcattctctaagtttaaggcaatgatcaatggttcagtttgggtccacattctctaagtttggcactaaaaatcctatgtccctggaaatctctcagttccaggcaaagtaaggtcattggtcacaaggatccatctaatttgccaggaatccttttgtgtgccttctctgtcaccctaatcactctcagaatgctcatccctgtgtgctgtgttatttaaagctgtgcttcttaaactttcgtgtgtatgagaatcatctggaaggcttgctaaaagtctctggggtggccccagagattctgagtcggtaggtctaaggtggggcccaggttttaccatttctactaagctctaggaatgttgctactggtgattcaaggggctaaattttttagagtattcattgataactaaacaaaccaataaactaatagaaagagaaaaggagatttatcagcaaaattctatttcagcaactgtgacctccatcctctgattcatctctagtgaaactatttatcataattggaaactgaaaattcaatacattataactgaaattttgcccaaatcttttatatttattagaataattatatccattagggcatctaaaatcttggtttctcaactctgaaagaaaaacaagtttattattaaaaattgtgctctaaaacatgctaaaaacagtgagtacaactattttgttggtgataaacattcatttagcctct

SEQ ID NO: 135788 - DNA, 455 bp, Homo sapiens
ggagagagtcgcccctcccgccgccgacgtgacggacgactccggcgggccaatgggaggcagccgccgcaccccggacaccaatcgcgagctctgtaggaggtggccaatcggagtgcaatgaggggcagtgggcgggaggctcagagtgactgacagctctcagaggcaatagctgcgagctgcccgtgctgggcgggcaaatgaaggagatctgagaaggcaggaggcccaatgaaacgcgagtgccagattcgcggggcggcttcagaattagattgacggttctgaagagtcacgtggactgtaaggccgggcctagtggaagactcctatggaccggctgggtgggcgttaggtttgatagtcgtggacacaagccaatgaatgcacgtgagaggtggtgcttgtaaagatgggcagccaattaatccaattcctgacgagttctgggt

SEQ ID NO: 135789 - DNA, 324 bp, Homo sapiens
ctgttccttctcccatgttctctatcatctcagtatatggccttaccagctgattaagccagagacctgagaggcatctttgattcctttttctttcatcccatacacagaagccatcagcaggtccaattctccaacatcttccacttggattactgttattacagattactcctcatctgtctcccaccgcacacactcgccaccttccaaatgatcctcgcacagcagggagagtgctcttcacagaatgtaaatctgaccacgctgctcccttgctcaggacatttgccgctcttcccatcacatttaaaatagagtcca

SEQ ID NO: 135790 - DNA, 466 bp, Homo sapiens
agttcagttaagctctccttccaactgcacagcttgaaaaggcccatggctttcagatggttcctaacccttctccagctgctctctgcaggcctgaaggcctctttcagacccgatggccatgaagcagtcatgagcatccccacacatgctaggctggagggtgcacctggaaccttctatgtcttggtgtttgtccttcaagtgtgcaaagttttgcaactaagatctaaaccagcttctctgcttaacaaacgcctgactctaggttgtgtggaactggtactcaactgtcatctcagagcatctggagttactttttaaagcccagttcccattattttaaacatgcttcatcgggattctttgacacctttagggcattctcctgtaaacttgcatgttatctgctattcttcctaagtactcctgaacaagcagctctgatatggaaagccaagaaaaa

SEQ ID NO: 135791 - DNA, 824 bp, Homo sapiens
tgtggcaaaattggtcagtaggagaaactaactaaaagattaaacaaaaacaaggaaacccagttgctgtttttccctctccctcccccatcttttaagaaaaaaattctttcaaaggaatttgggtcaagaaaaaggttgttttcaattttttcccattgctgcaacagttaacctttagtaagtataactgctaaatatttaagaaaatcaaatcgatggtgaaaattatttaatcattaatatctcagtggggttttaaacttaacagtcttccctgtatggacaaggtctagaaataacacaaataaaagtattatgccacactacatttactttatgggtttagggtgcatgcataaagggatcatatttccccatatagttaaaacacaagaactgcagcagtagtcatttctgaacatttctcaatttaattatacttaaatccagaagcactttaggcaagttacaaatgagagcattgagtataataaaacctgtaataaagcaacttagtaccatccacccggaatcattgcgatcaggcacaattaacaggagcataaatccaagacagaatggaaaatgttcgaatcagtattattgttggacaaagactagagaaggaagcaatagttttttaaatggtaatgcctgtgtttggtaatgattgcaaaatcttctatctcagcagccctggtgctaatttgtaaacacagccagacattatattgcctgtcagtttctgcattagaaaacatgacttcattttactttctaatcacgttttgactctagtgcgcacacgtatacccatccat

SEQ ID NO: 135792 - DNA, 107 bp, Homo sapiens
tgggctcccctttctctggggaacagggagggcctgtgtctggccaggctgaggttccagatctgttgccatcatggccccttcagggtcctgggaaattcctggct

SEQ ID NO: 135793 - DNA, 299 bp, Homo sapiens
gtgtgtgagggtggatgaccctgaacaaacaggcgtcccaggtgtgtcagcagcttctgtcgggtactctgcccctggcagggccacttgggggtgcactggggtgtgtggctgctgtttgtggcagagtgtggatgtgaggggctttgtgtggtgatgcgtgtgcacctggtgtggtcagggatggagtctggtgtgtcagaggggccaacccttttctacttaggggcctgtgggcggctgtctgagcttccaagggcccgtgtttatggagagaaagggagaaagggagtgtgtgt

SEQ ID NO: 135794 - DNA, 666 bp, Homo sapiens
gtgcggggctccccgatgaattcactcctcacaatcctcgtgaaggggtgacctccaagccctaaggacatcaagctggtcttgcacgataaatccatcccagcgttctgccgtcctctccagtgtgccaggaaagttctggatttcactgaatttagggtcagctacctgtggggcgaaagtttcggtgactgatgaagaaaatgggggtggggggtgggtcactcccagccgttccctccaacgcatcaaatccagaatctcgtatctgagtccctgtccacttacgcaagcttatattcctcccacccagatcccgcactctcaacatcgatttccacacattttccgcaggttttcgtagggaaacatatttgtaggccacacctcacactttctcttttggggcctgctggaactccagtctggatctaggtctagaaggaacacagaggtggtggtgagtcccgggcaggacggcggcaccttacagggcagctccctagggaaggcacttgagggtctttgggcaaaggggtctcagctccccaggcagtggcagaagagccacatgtgccttcaaagacgacctgcggagttcaccggcagatcccaatggacttgcagggctcgtggtcctcagcttcactgggatcttcccacatg

SEQ ID NO: 135795 - DNA, 453 bp, Homo sapiens
ataaggctactgtatgattccatttatctggaatgttcagaataggtggatccagagaaacagaaagtagattagtattgccaggggctgggagaatgggagtggctgataatggttacaggagttaattttgtggtaatgaaaatattctgaaattagatagtggtgatagttgtacaatcctgtgagtatactaaacaccactaaatttagtcctctttaagataattttattatgtctgagttatttcttaaattgctaaaaagtttaaaggagttaaattttatcatcaaaagcatatcatctcctgcctatatttccatgtgtaatccattcatttatctaatttctttggttctaatagccactagatttgatagccaaaaaacctttacttttatttttatttttgagatggagtcttgctctatcacccaggctggagtgcaagt

SEQ ID NO: 135796 - DNA, 605 bp, Homo sapiens
gttgggccgggcacgtctgaccctctgtccccgtctcccttagaggaatcgtgggcccctctgttcttgtgttgtcaccggtggaggccgtccttgacttccccctgggagcacggtgtgtcccctcgccatgcagagcacactgtgaagtcttttaatgaggagagaaaagccccttaaaagttgatattctgcagacaggtgagcacgtggcctcgtggtcacaggaaagaagaggcgtttcctgtgttctggcaacctcgagcttctctgtgagcgcatgcccaggcctgcctgagtgctgatgaaccagccggcacagcagagcactccgggtctgagggagctgctctccctgcagcaggcggctgggcagggcaccgtggtcctttgccatttttccagggccggggggtgtcagggtgtctgcgttggggggtgcagggggtgagcagagccagcagctgcacctgagcctccccttgtgagcagctcgtggctgtggcccagggtaccctggatccttggtgggtgacccagagggtggggtcctcttggtcgtcttctagagggagcatgggggctgagtgttcctgcctgggtgc

SEQ ID NO: 135797 - DNA, 327 bp, Homo sapiens
tgcacaggtctgacaccacgaggtagcccttagaaatttgatggcatttctgatgtgtccccaactcttctccaaccactcctcccagagcttgtttcttaagccccttgtggagctgattgctttcctcaaggcagctcagtttttcccagtttgctcctggtggtcctgaaatatgattgactcctgaatactccaggtgtgaaggagagtgggggtggcctttctacttgtcatggcctgggttttaagttgctgtccagtggagcagaggtgactttcccagtgaactacattttttcccctctaaatccttagcaattttgt

SEQ ID NO: 135798 - DNA, 190 bp, Homo sapiens
agatcttagggtcatctattgcatataagagaatatacatttttgtaaatgcgcatgggatgctcatgaaagatgattattgaggtacaaagaaaactcttaaaaatttctcccacgcctggcaaattgattttttcataatttatttatacataggcctgaagtaaggatctagctctaaaaagcaaca

SEQ ID NO: 135799 - DNA, 458 bp, Homo sapiens
tgcttagacacccacaaaggcggctctgtagtcctccttcccttcagtcccctatcccctgcccgcagggcaacgagtattacataaccaacaaaagtgcaaaatattcccacaatgtgtctggtcctctctgggagaggccgctctggctttcgcaagcattcctctcagccctggccctctgcctgcccctcactcctggttggtgctggtcaggctgactagaggccaaggctagtcacagtgggccagcgctcagacataaatgagaggttacttaccctcctgaaacagccactaattccacaaattggctgcttgttgttcaagacagagaccctcacggataaagtaaataaggatttatcctatcaatgaattgaaagatgcattcatttaaaaattacttgatatcacaattggcatttcaattttatagttcttcttgctctcacttt

SEQ ID NO: 135800 - DNA, 547 bp, Homo sapiens
agtcgctgttcctctttacccctcagttgccaccctctttccgacctgaagactggtctgggtgccccaagtgacagcagcactgccctggctatggagcctctgggctagacagagctggcacgcttgggtgggcaggctttcagggcttgcagagtgggtggctcattcccttgacaatcatccagggctggttacgttcaaatgccaaggaggcagagaagggaaggacactagctcagttagctctcgggaatgaatctctgagtagaaaagcccagcctggccgggcgtgatggctcacacctgtaatcccagcactttggaaggccgagatggaggatcgcttgagtccaggagttcaagactagccctggcaacatagtaagacctcatctctacaaaagaatacaaaaattagccagttggtgtggtggtggcatctctagtcccagctactcaggaggctgagatggcaggatcgcctgagcctggaagtgggccatatttgcccactgcactccagtgtgggcgacagactgactct

SEQ ID NO: 135801 - DNA, 513 bp, Homo sapiens
tgaagttaacctaacaggccatttggtataatactggattatagtcttccattttcattttcttttttaacactttgtctaatttaatttacttctgattattatcactctgcctggttaatttatatgctttgctttgtgctcattgagtttaattaattcagtgagagcctagccttctttagaatctgaataattttcatctgtcagatgcttgcgatggaaagaaaaagccaaaggtcatgacacaatagaacttgattggctggagttcagacttctattggcctctgtaatatctgttaatatatacacaactcttcctgttgtggcgttcatcttcttattttttaaagatattctttgtcagtttaataaactgccctttcacaacttgtcagtaaaaaatatgtcaagaaactgcacctcaaagaaagaagtagcatttggagtggtattaaagtaatccgtccattgtgaaactaacaatacatgtaatccaatatgtatttt

SEQ ID NO: 135802 - DNA, 113 bp, Homo sapiens
cctagtagctaggactagtagcaggcacaaggaaccatgcctggctaatttttttattttattttttgcagagacaggttctcactattttgtccaggctggtctcaaacccc

SEQ ID NO: 135803 - DNA, 631 bp, Homo sapiens
agccttgaactgccctatagtgcccaaatttattgttcagtttttctccagctgtcaccattctccttcccggcagtcaagtgcagttctctgttttcaaagttctctttgtcttttacttgttttgtctttttcctctttgtgtgcattctaaaaaaagcttctgggaggcactgattttcagctctccccaccatctggctcttggtccagggcactaggtgaaacaaactgtgatggctgcctagtgaagggacaggtggtagctactcagaccctatgtgaggtacatatatatattggtatcaaccgtccggagtcacaaggtctctgtggacaacactgccctagcttagtgggagctttcaatcaagctggccttgtctggtccttccttcatcagggatgaatattgcccttttatactgtcactaaaggtgttcagggccccaccctcttatcctggaggaaccataagagtaccgggctgctgaacttcctgggattgacttcatggagagaagcagaaggagtagggagggctgaactgggtcctggagcacagacaagctgggatgctgttggtcaaggctgctgtctggtggcgggcctcactagctggccacgagaa

SEQ ID NO: 135804 - DNA, 849 bp, Homo sapiens
tttttttttttaaaggggttctcactctgttgcccaggctggagtgtagtggtgcaatcacagctcactgcagtcttgaccttctgggcccaggtgtttataccacttaaacactgcaagtacttgggatcacaggtgtatgccaccatggccagctaatttatttttattttttatagagacagagtctccctatgttgcccaagctagctcaatgcactttaagataacaaagagcagaattttatcagataaatttaacagagattaaaataatttttaaaagtcaagcagaaattcaggagttgaaaaacttaattgacaaactaaaaatgcatcagtttctcaatagcagaatggatcaagcagaagaaagaattaatgagcttgaaaacaggctctatgaaaattcagtcacagcagaaaaaacaaaaaaataaaaaggaatgatgcatacctacaagatctagaaaataacctcaaaaggacaaatctaagttattggccttaaagagaatggagagacagagagagagagagaaaaagagagagagagagagagagagagagagagagagagaggcagcggcagggaaggagggagggagatcagggtagatgatttactcaaagaaataataatagggaactttacaaacctagagtaagatatgaatatccaggtataagaaaaccaaaaaacaagcagattcaacccaaataagactaccttaaggtatatagtcatcaaactctcaaagatcaaggataaagaaagaatcctaaaggcagtgagagaaaagaagcaaagatactttcccagacaaacaaaagctgagagatttcatg

SEQ ID NO: 135805 - DNA, 226 bp, Homo sapiens
tctcatttctctctctttaataaactttaataaactcaactttaatcataagactgaacgagtttctgtaactggaaaccaaaaaatcctatctattacaacatacatttgttcctcactctttcaacaagtacgtaacagggccaggcacagtggctcatgcctgtaatcccagcactctgggaggctgacgtgggaggattactgggacccaggagttcaagac

SEQ ID NO: 135806 - DNA, 305 bp, Homo sapiens
agggcaccaggaggaaagtctgttactactacgataggggtgttggaaattactattatggacaagcccacccaaggaatcctcactgaatctgcgtgactcataatttgctgctcaactatggtttctactgaaaaatggaaacccatcaccctcacaaagccaatgctgaggagatgaccaagtaccacagtgatgactacattaaattcttgtgctccatctatccagattacgtgtctgagcacagcaagcggatgcagagattcaacgttagtgaggactgtccagcatttgatggcctg

SEQ ID NO: 135807 - DNA, 467 bp, Homo sapiens
ctgacaacaaggacttgtttactcctgtagatacttaaatgaaatgtttgtcagaatcattcactataggatgggaagcattactggttttgtttctttgcttcatgacaatagctgagagaatatgaaattttattaaagaaaacaatagcctcctcgggaaaagattagattttgtaaacacttcaaatagattatacactatttttagaaaagttttttgagggctttttaaaaacagaaataaagcaagaagagtaattttatgactatagcccagaagtagagccgtcagtttaccatttccaaagatgatgtggtcggtcttgtgaggaattaagtataaattgaacaggtcaagacaagtgtccaactgttccagaaaaagcatggactgccgtgggaacatggagccaaaagacacagattaccctttatttcctttgtgtctgtgtctgtgtgtgtgt

SEQ ID NO: 135808 - DNA, 288 bp, Homo sapiens
gataaaagtaatgtattgatgttaaatttactgcagttgataactgtatcatggttgtgtaaagtattaataatatcctcattattgagaaatgcatattgaagtatttagaggtaaagaagagtaatgtatgaaattgaaatgattcaagaaaaatttgtgtatagaaagagcaaatgataaaacaagcaggattaaacgttaactgtgtgtcagtctaagaggaacctggctatcctttgtaattctattgcagtctttgtgtaaatttcaggttacttccaaatt

SEQ ID NO: 135809 - DNA, 215 bp, Homo sapiens
cactgcactccagcctgagtggcagagtgagactctgtctcaaaaaaaaaaaaagttaaacattccaaaggcacaatcttactgaatacagtcacttctcctttaagcaagaataacatggcttgattttcaattcatggtgtctgctaatcagaaaacaggttacattaggacaattaggctctaggcccctcagctactagtatctagcacaa

SEQ ID NO: 135810 - DNA, 383 bp, Homo sapiens
aaccccgccaggcaagccgaaatcattggcagggcttgatcctgaggataaaaaaacccacaaaggagtacaattattaaaacagaagctgctggcaaaagaatggacataaagaaaaatgggatagaattgacagtctagaaataaaccctcacacttatggtcaattactctttgaagagggtgtcaagacaatttaatggatgaacaactctcctttcaaatgatagtgcagaaacaactagataaccacatgcaaaacagtgaatttagattactctagcttccaccatatcaaacaattctctaaaaaattaatcactgagttaaatatcagacttataaccataaaaacatcttaaaatagacatagaggtaaatat

SEQ ID NO: 135811 - DNA, 187 bp, Homo sapiens
cagagatgtgtccactcaaggaaggagactgccgtgcagtgagctcagggagccatggcacctcccgggtgggcctggctcagcataggccctgtgaagcccagtcatcggaggggcctagagccttgctgggagtcagagttgctggcaccacgtggacagtcacctgtctccttaataccgtgcc

SEQ ID NO: 135812 - DNA, 429 bp, Homo sapiens
tgccccgtcgacgactaggaggaccccccgttatatcaacgtggtaaataacctgcaatgggaacctacccagcccaagttcttcaatcagacttctgagttcaaatcctgcttcaactactgtgtgaccccaggcaagtgccttaacctctctgggactctgatccccatatgtaaagtgggaagcatagcaatgcctgtcttctaggagtgttgtgagatcggtgtcttgcatagtcttttcttcctatatattcattatatttgttctttatatctgacaataaaaatagaataataggtatttatagtatctattattatactatttattctctatataaatgggcgattcacaatagttagctttttatcttgaaaagaatgttgaggccaggccaggtggctcacatctgtaatcccagcact

SEQ ID NO: 135813 - DNA, 410 bp, Homo sapiens
  misc_feature (2)..(2): n is a, c, g, or t
cngactctagtggatcccccccgacggggtgctgtgaaacctcctcattggactttctgcttctctattgccttccttctgatctgttttctattttaggaaatataagtgaggtcaggccattgcactgtgtgaaacccattaatgggttttcattgtacctcaaatgaaatccaaatgcaagctctgcaagcactagtctctgcatatttttcctccttctcaaaatgccccagttccaagaatgcttcttctgatccttggagctgtcctttaccatcttgaagttgtaggcctgggtgcattcagactcctctgaatgtcccaaaaacccacaaccacgacccgccccctcctctgaatgtcctacccaaaaacccacaaccacgacccgccccctcctctgaatg

SEQ ID NO: 135814 - DNA, 334 bp, Homo sapiens
gcgtgtgtgtgcccgctttgtctgggccaagcctggattgtaaattgcatcctctgcctgggaactaactgttctcatccttaacactgttaattggatttcttattctcctttcagcgaaaaagaaaagaattgtaaaactaaggaactgctacttagagaaaatttaagaacgctttttgcgtttgccctttgatgatttttgggtattaattttattggagcctagggctattatttaaaaaaacccacttcctttgatagctgttgttgcgattcatttttgaaacttttatgttctgcattattgaaggactcaagagacacaaataga

SEQ ID NO: 135815 - DNA, 261 bp, Homo sapiens
ccaagtccctgttgttggaaactttggttgtttctactttttcacttaagaactttgttgaacatcatttatatacatagatctttgtatatttctcattatttccttaaaaaatgttttggtgatagaactgctagctcaaaggacatacccatttttaacacttttaacatatactgtgagacagttcaatggtaagcagtctgtttaaactatgcatgcctattatttgccctatttgcaactagttctagaatctta

SEQ ID NO: 135816 - DNA, 532 bp, Homo sapiens
atctcatgactgatgtgtgtcctgaaggagggatctttagaaaattgttcaagttacatcgtgacaacatactggaacttgggaaagccccacatgacaattcagctactttcaagtgactctgttccatgtccctaggcctgtgtgctcttaaaaagttgcaatcatgtggtaactgccattttgaattactaatattttatcatattcatttattttggcattgttaaatagcaacactatggcatgatagaaaaaacatgggctaggccgggtgcggtggctcacgcctgtaatcccagcactttgggaggctgaggtgggcgattcatgaggtcaggagttcaagaccagcctggccaacatagtgaaaccctgtccctactaaaaatacaaaaattagctgggtatggtggcatgtgcctatattcccagctactcaggaggctgaggaaggagaattgcttgaacctgggaggtggaggttgcaccactgtactccagcctgggcaacagagtaagactctgtctc

SEQ ID NO: 135817 - DNA, 600 bp, Homo sapiens
gcatgttctctcacaccaactggggctggcgatgaagccatatggtgagcactgtaacataatggtttaaatgtggccttgggcaagtaactaagcctaacctaaaatggaagcaatatttgttgaatatcaaatgacataattcgtgtaaagcatggaatgagtgctgagtaaatagcattaccattattattattattattaactgggctgggccaaaaatgagaaccccttcttgtctctgcgatagaagcacagatgggaagacattcctgaagcagaagtattatctgtggttttttagaataccaaaaacaggctgggcatggtggctcatgcctgtaatcccagcactttgggaggccaaggtgggcagatctcttgaggttagaagttcgagaccagcctggccaacatggtgaaaccccgtccctactaaaaatacaaaaattagctgggtgcagtggtgggcgcctgtaatcccagctactcaggaggctgaggcatgagaatcacttgaacctgggagatggaggttgcagtgttcagagatcaagccactgcactccagcctgggcaacagaacaagactaggtctca

SEQ ID NO: 135818 - DNA, 353 bp, Homo sapiens
ccatgatccaggagaaaatgaagtgagccagacatttgggaccattttttcctaagggcccttgttgattttggaagaaatggctgagaagctgatcagtactatcgatatcttatggggaagagggaaaattggaatttaagttttaccaaggtggattttttttttatataaagctctcataatttgagttgagaccataaaaggccacagcctgggagtgggtaaatcagaagtagactggctccctcgggaattacaatacagcttgaaatcatttcagtttcttgagttggattaaggtaattcttgatgctactgtctatccatctcatagaagtaaaagtatatcc

SEQ ID NO: 135819 - DNA, 575 bp, Homo sapiens
gggggtccaggtgtctcttggggaccctgtctttctgcagctctgtccttgtggccacgcaggaggcccagtggagggtccctcggagggaaagtcccctgagtgtggaccctggtggacacgaggcccccagcgtgtggaggctgccagtgggatacttggctcagggcagaagggaggtgggtgggtgcagggggagaggagtcttcacagctgcaggggaggctcctccacagccgccctccccccaacacgcctgcaggtgggcgtgggcactggttgccttttctagaaccatttgaaagttagctgaagacagcatggcacactcccttcaataggtcccacagtgaccccgcgcagggcacagcccgggcacccttgtggcctcggctgtcctcgttggaaccacgatcctcatggttggcaccctcccctctggcctttgacctttcactttagaagacctgtccctgtcgtggactctaagcggccaccagtgctgcactgggccgggtgggggtgaagcctgtggggcggagttcgtcgcccccgtgtgtggttggtttcccacg

SEQ ID NO: 135820 - DNA, 200 bp, Homo sapiens
tgggtgaccgtccctttgccgcctcaccagaatgaacctccgagtgccccaggagccactcgaggacgatgagaaggtaaactgactcacttcagcgaaacagatttgtggcaatcatgttgcggcagtaattacagtttatggcaggagatacacacttagcaaaaataaatacaaatagcacgactcatgtggtggca

SEQ ID NO: 135821 - DNA, 463 bp, Homo sapiens
tttcaatagccgaatcctagaaaacaggactaaagtccatgaccttctgggccagttccagaaacacacctttaataaataatagccctccgtatacagttgcacatctggccaaaagggaaaaaaaaatgtgtctgtgttctgtgatgtatgtgtatcttctttcattcttgtctactctacctagattgtgaattactggagggtataaactgcctagcgaggggctttgtaaggttttttttgatcagtggatctcaggtctcaggactcttttacacacttaaaaattactgaagactgcgtattttgtttatgtggattatatctattgatattcactgtattagaaatttaaaaatgatttgatccaggccagcctcccaaagtgttgggattacaggcatgagccactgcatctggccaaaaataaacatttctttttgtgctataatataataaa

SEQ ID NO: 135822 - DNA, 717 bp, Homo sapiens
aaaccaggggcggtgatctgggaactaacagtggtctctgagggcccctgtgcttccccaccaggtctggattgaggctgcattcctgaggcaggagggagtgtccctggagatttttgagctgggctctggcatgatctgctgcttctcagacaccccccgcccaacccctaaactcctgagctcaggcaggtggagcccaccacatcaactgcactcacccctgagaattttgtttttgaatgcagagtggaatttagctgacataaaagaatttgagaggggagtgcggaattaatggcacggtgtagcctgtggcttatgtggtttctaattcagaggtatgtggattacgtgagtctgtaacatatgctgatctaattaaccaagttaaaaggttaaaaatccacttcagcctacataccaagaatgggtctaattggaaacaatatttcaacaacagtccccacgaatgcctaatttactggtaaacactcactctaatattgatgatgatactcattctcttttcctctgttcataaagtgatcattgcctgagtgaaacagtcacgagagagagagcgagggaagaaaggagggagggaggaaaaagtgagggagtgaaacattaggagttggtgaacattagttgattgagtgactgagtccacaattccaaaaacgttcctagaagactcaaaatctatttaacatg

SEQ ID NO: 135823 - DNA, 363 bp, Homo sapiens
gttcacacttcataatacgttttaattgtcatctcaatgagatgactcaaatttatatattgatatatctgtatcacaaaaaaattgcaaattgcgtgcattgtcaatgtgaattatagatagtatgctatgaaaacaaaaatattttctaatctgtctgacttttagtagagaagtcaagatgagatcataattaatccaggcttgaattaacatagctggaatagttaacatgggcatagtccctcatctgtctttggctatttgggggaaaagaaatacatgttaaagtgaaaattagtggaggaacttttaattagtcatacatttttactcagtttcatacacaagaatattcatttt

SEQ ID NO: 135824 - DNA, 213 bp, Homo sapiens
ccacacgctattctctgttctgctctgtccccaaaaggctgatctgtatagatgacaggttcatttgccctctgcctggggagagaggggaaaagagagactagtaggacatcaaaggggatgcggaaatgaggctgaatatttctcggtcttttatcggtctccacctggattgctgttagttggctgtatcttccaactaaggtcacagct

SEQ ID NO: 135825 - DNA, 373 bp, Homo sapiens
gagaccagcctgggcaacatggcgaaaccctgtctctaccaaaaatacaaaaaaccagctgggcatggtagcacatgcctatagtcccagctactcgggaggctaaggtgggaggatcgcttgagcctgggaggtgcaggctgcagtgagccaaggccgtagcactgtaccactgctctccaacttgggtgacaagagtgagaccctgtctcaaaaaaaggagatgagatgctgagagaagcaagtggtggcccagtcatggaggagggggacgggtttggaagccaagccaaggagtgtggactttgtcccagaggtagtagggagccatggagggttccagacctgaactgcactttagaaagaattgtcc

SEQ ID NO: 135826 - DNA, 416 bp, Homo sapiens
gctccttccccaagagctgagaccctgcattcacccacagatagtgtgcatgagcctcaatagacagcacacagatatgaccagccactgcaactctgctagatttggagaaaatgctcaatcttgacacttcaagattgcactgccatagagaaaataattaggaggctttcagcagctggcatggcattgtgaaatcaagagaaggtacacaatcccaagacttcagaagattggagcagatatatccatacaaaatatctgagagatcccccaaaatcttgagtcagactcacttgtgaagatctttacctcgaggaggttactgtttcttcaaatgtgaagacagagacacaaggcttcaagggaaatgaagaatcaaggacacatgagacaccaaaggaacaaaataaagc

SEQ ID NO: 135827 - DNA, 131 bp, Homo sapiens
tatatactaggatatgaagttaacaatacattttacatgggtacctttctgtcaagttggaatgaatttccgcatgaataagaaaggcccattttctcttcatttttgtattttgaatagtagagaggcaa

SEQ ID NO: 135828 - DNA, 216 bp, Homo sapiens
gcaagccaattagacagggcctcacagaccatggcaagatgcatgaatgctatctgagggcattgatgagttccaagcatgggagcagaacaattggatttattctaagaagctgattatggctgttagtcagagagaggaacgtacagaaagcaagagcagaggcgaaaaggccaatgagaggctactacacgtggaatgatggtggtaaagagg

SEQ ID NO: 135829 - DNA, 197 bp, Homo sapiens
cctctgttgtcacaaagccctttaggtgattctgatgcacgttcaagtttgaaaaccactgacagtcgcaccaccaactaatcagttaatgaagtaatgattgagcgcctactatgtgaccagtgctgtacactctactttggcccactgttctttctagaggtagagatgcaagtatgtatatataaaaagaatga

SEQ ID NO: 135830 - DNA, 456 bp, Homo sapiens
tctatatatccaccccaatcaatcatgattactgaaggccttctgattaccgaagagagttccctcgcaggcaagaaaaatttctgtccttgctaagcttctccacccttggactcagcggcctctccccaaacttttcactctatataaaaactttcattcccaattaatacatactcaaaatccaactgtccccatgaatttagggtgttggcaaagaatcacagtgcttctccagtccaacttttattggatagaggaaacagccctagaaagaaaatgtcaaggctgggtgtggtggctcactcctgtaatcccagcattttgggaggccaaggcaggtacatcacctgagatcaggagttcgagaccaggctggccaacatggtgaaaccccgtctactaaaaatagaaaaaattagccaggcatggcggcacacgcctgtaatcccagct

SEQ ID NO: 135831 - DNA, 425 bp, Homo sapiens
tcttaaccacaggcctacagttattctgagaaaaggggaagagccaactcagccaagtccatccagggacctgtggatgcaggggacagtggaggactagggtggccaggatagagacctccccagtgtggccaggatagagacctcttgggtgaggccagcatagagacctctcagggtggccaggtagagacccatgggacatccttggctggctgagcatctcctagtctcctagcctgaagacaacaggatgaagaggagaatcaagttgtctattttcagtaaacctgtagtttagcaactttagtagcctttagtaaaatacatagcgtggtttccagccccactgaaaccaattatcctttatacctgcttggaattattctctagttcatgtttgtatatcctgcctgtggaattgt

SEQ ID NO: 135832 - DNA, 445 bp, Homo sapiens
tcttaaccacaggcctacagttattctgagaaaaggggaagagccaactcagccaagtccatccagggacctgtggatgcaggggacagtggaggactagggtggccaggatagagacctccccagtgtggccaggatagagacctcttgggtgaggccagcatagagacctctcagggtggccaggtagagacccatgggacatccttggctggctgagcatctcctagtctcctagcctgaagacaacaggatgaagaggagaatcaagttgtctattttcagtaaacctgtagtttagcaactttagtagcctttagtaaaatacatagcgtggtttccagccccactgaaaccaattatcctttatacctgcttggaattattctctagttcatgttgtcgacgcggccgcgaatttagtagtagtaggcggccgctctag

SEQ ID NO: 135833 - DNA, 155 bp, Homo sapiens
cttctttacgggtctgcatgttactgcaattacttcttcatgtacaatttaattaattaaatctctcatacatttttaagcatcttctttccctaccaaacctacaaacctatatgcccttgaaaccatcttctcttttgctcctgatgcaacga

SEQ ID NO: 135834 - DNA, 109 bp, Homo sapiens
aagcatattttataaagtctctccaaacctgcttgttattgatgttgttaatacaatatttagattccattttgaacattccagctggcaaagattactgaatgtcagt

SEQ ID NO: 135835 - DNA, 321 bp, Homo sapiens
cttcaagccataagccgttagtagtgttcttttgaaaaagtcagtattggctgatcacagtggctcacgcctgtaatcccagcactttgggaggctgaggtggttggatcatttgcactcaggagttcaagtccagtctgggcaacatggtgaaacccccgtctctacaataattataaaaatcatttgggcgtggtgcatacttgtagacccagctactcgggaggttgaggtaggaggattgcttgagcccaggagtttgaagctgcagtgattcagccactgtactttggctcaggcaacagagcaagactctgctac

SEQ ID NO: 135836 - DNA, 172 bp, Homo sapiens
tgtagcatcctcacctctcagtcttcgaagaaagaattgaagaattaattaggctttggcttaagggaatgttgtggcttgtttaatctatatagaccactcagactttctccatctcagcagtaaggctgtttcactttcttgtttgcatgttcactggagttaacacttt

SEQ ID NO: 135837 - DNA, 703 bp, Homo sapiens
caaaatgtctgtagtgcgggaggctgcgcatgtgtgagggcagggggtatatgggaaagctctgcaccttcctcacaattttgctgtgaacataaactactcccaaaaagagtctttaaaaaataactaaatcgcaagcactgtcctttgtgttgttgttgttgtttgcttcccaaagtgctgagattacaggcgtgagccaccacacccagcaacaagcactgttctaagtgtatcacataaatagtcaaatgtaatgccaacaacaaccataaaacatagctaataataatcactaacatccatggaccaccaatctctcagtgacttaggactttataagcactaggtcatttacctctcataacagcctatcaagttcagtctgttctgccataatgcttgttttggaaatgagaacctattccaacatgattggtatatcagggaacaatataagcataatgcagattttgcatttgctcttgtgtgattttgtcagtgggaaacactgtcaggggttggtaaactacagccctctggccagtggtctgtttttgtaaataaagatttattggaacacactcattcattgaacaacaacagcagagttgagtcattgcaacagatacgtctgcaaagttgaaggtatttattatctggacttttaagaaaaagttgtgaagccctgtgttatgggaag

SEQ ID NO: 135838 - DNA, 563 bp, Homo sapiens
agtacttcccacttcccaggataggggtagaggtgcggggacagaggctgtccagggacagtatcttctctccagttacactcccatctgccagtttgcaggtgtagtgtcccctcccttccccagctcctcagggtgatcactccctctgctaaccaaagccaatactaccctctgtactcagagccagattccattctcattatgtgtatttatttgatcatttgctgggggtctgctgtgtcctaagtgctggggactcagtattaaataagacaactccttgttctccagagtcttccagcagactctgccagagaaaaatatcttatctaaattcaacaattacaggactatgtgatccctgtagaggtatgcatgggatgcaatagctgatagccatcagtagggccaaatgagttcttaaatgattgaaaatactttcatactgatgggtaaaagccacaacccgagtccctggccacttccctgggataccactcactcacatgccaaaatagaatagaataattacagggttaagcccaaaacgggacctgctc

SEQ ID NO: 135839 - DNA, 1854 bp, Homo sapiens
  misc_feature (803)..(803): n is a, c, g, or t
tatgtagattcaaaccccattattagtagttttcttctaagtagacaacctcttctttacccagaacttctctttgtaaccgtttcatccatattaggctgtgtattttaaacaaacaaataaaaataagttgatatttatcttccttcttagtcaaaatgcttcttggaggttggggactctttctttgacgtgttctgtagagtatatttcagtttgtctttttagtaaagatggcaacatctcattggattaggaaaaattgaaaaccatatgttccatgtaaagaaatcatttattgtttcgatatttgtgccactcaaacactgaatgctttatttctgcaaaagcatattgattcgttttctgcagtgaatcttatatttttcaaccttcttaaacaatatattctgaacttgatttagtctttacatgatgatttcctgataatcattattgtattagtttcctagggctgccataatagaatatcataaattgggttgtttaaacaacagagatttattggatcacagttctggaagcaagaagtctgagatcaagctattagaagggatggttccttataagggttgtgggagggaatctgtttcatgcctcttgcttagtttctggagtttatggcaatcgttggaattccttgacctgtaaggcatctccctgatttctgccttcatctttaatatagcattctcccagtgtatgtgtgcccatgtccaaatttcccctttctctacaggcataagtcatacttgagtagagaaccaccttactccattacnactgcatcttaattagggaccctatttccaaatatggtcattttctgagatacttggggttagaaatttaacatatgaattttgggagggcacaattaaacccataataattatgaacactattttttgtgcagagctttaccacaatgatttctgcaggactcaataatagagatgtttgcaagctgtacatagttcttagctttgcatacttttatttctccctcacctcctctgtctcctcttcattctgagatagagccatcatttcttacagatatcattgtactttcttccgaaagtgttttcttcccatgtaatatgaatggagggtccagattactggtgttactgtgtattaaagaagaataaattggttccaaattaaagtctccttggtaagtaatgatgtatttgggcaacagcgtgtaccttatggcatttcttttcatttcccaagggctctattttccctcttctgggtttttgactatgttaacttgagataaccctataaatgaatataagattgctggatactaaggtaccaatatattattttctccttacagaaaactaaagaaatatatctcatagaaatactagaaattggtgatcttgtttactaattgctcaagattttgctcactgatataggaaaatcacagttcccttttgggtactataagatgtgaaattggatttttacagtgtctgttagacttccgtcattcaataaacataatactagagcagaattgagttgaaatcaaatgttgtgagtgggtaaggtaatgtgcacatccagttctcagcaggtggttctaagcaggatgcggggcctgcaccccaagctgctaacctatcaagggtagcccatgtggttctgagggcaccgtgctgatgagcacccactgtggttctgattttggcagccacggctgaatcaagtctttgatctttggagtgacttctgccacagtgagcatatctgtttgttttgcccctccctttggtcattattccaacctggcagtacaggacaaaaaaa

SEQ ID NO: 135840 - DNA, 441 bp, Homo sapiens
tcctgagtgagcatgggtaatttgtgtcaaggaatttgtccattttatctaagttattgggttattgacataaaattgttcataattttccttattatctttctaatgtttgtagaatctctagcaatatcctctttcttactccctggtgttggttatttatatcttctcttttattttccttgatcagtctggctagaaccaggttcttcctgttgttctatttcattcatttacactctgatcttttattctttcttttgctcgtttggggtcttacttgctcttctgtttctagttttataaagtgaaagctgcaatcattgattagagacagttctacgctaaagtcataatgacattttatgtaatttcttttttcttttttttgagacagagtctcgctccagctcgggcgacaatgcgagactccatctccaa

SEQ ID NO: 135841 - DNA, 575 bp, Homo sapiens
ggctgaggcagtagacttgcttgaacctgggaggtggaggttgcagtgagccaagatcgtgccactgcactccagcctgggttacagagcaagactctgtctcaaaataaattaactagttaattaattaataattgtaaaggaagggtactaaagacagcacttgggcagcagcatgaagcatagtgtttccaaaacctagggcacagattgagtgcctaaagggcctgctggctttgttatttttgaagattccatggatggtgtatcttctgtagaagttaagcaattctgaaaagcaccatacactcccagtttgcccagatgagagaataacaaggggaagggcccaagaaggccagttttggtcctttttcaagtcaaaccacatccatccctaccgcctccaccaccaggggctttaaatgtattttcttattggatccccaaaaaccctaaaatggaactgcctatccccgtttcaaaaaccaggaggcctagcctcactgaggttagctgacaatggagactgcactctgcacacaatccctcctgcactttccacccctgttctg

SEQ ID NO: 135842 - DNA, 316 bp, Homo sapiens
  misc_feature (23)..(23): n is a, c, g, or t
  misc_feature (28)..(28): n is a, c, g, or t
tgaaaatatgctcagcatcgggnccggncgcggtggctcacgcttgtaatcccagcagcttaactggctaagttgaaggcagctcaatttggagtgtaatcttgggatttgacattggttcaaaagcacagccaaccaaaaaaatagataaatgggacttcatcaaaatttaaaacttttgtacatcaagggacaccatcgaagaaagtgaaaagacaacctaaagaatgagagaaaaactttgggaggccgaggtgggtggatcacaaggtcaggagttcaagaccacctgggaaacatggcaaaaccccatctc

SEQ ID NO: 135843 - DNA, 262 bp, Homo sapiens
aaaaaggatccttatagaagagactgagaggtaggaagggaacagaagtgatattgcagaggcctgaggcagacactgttaaagagggaggcacctggacacttttgctgtagacaagtagcccatctaatcctaaagagcccctttgatatggccacttaatgacgtatgaaatacttcaaaaatgattttaaaagtgtttaaaataatgggcttctgtgtcatttccataatattattctgggtgcctgccatgcgcaag

SEQ ID NO: 135844 - DNA, 456 bp, Homo sapiens
aggatgctggcaaagaatataaattggaccaagagatttaaaagaaaaggagctgaggctgggcatggtggcctgtgcctgtagtctcagacactcaggaggccaagataggaggagtgcttgagtccaacagttggagaccagcctgagcaacaaagcgagatgccacgttttaaaatgctttagttagttagttagttagttagttagttaaagatagatagatagatagatagatagatagatagatagataaagatagatattcttataagaaaaggagctggaatactctaagtgccaaactgaactgcccaagacttagcaaaaaacaaagcacagctgcttctcttcaggtcatgcctatgacagatgataagatctttttttggttgctagtgacagctgatttaagacagatggattcaggaaaccaagaaatgaccactgataaca

SEQ ID NO: 135845 - DNA, 169 bp, Homo sapiens
ccctgatggcttacccaggcctcgcctgctctgcacaggaccgtagaccccatgctgaggggcggccacagaggtgtgcagtgcaaagccacagaccaaactgcaagtaatttgttcatgtaagaattcagctcatgagctcagccctggcacaggctccagtcaacca

SEQ ID NO: 135846 - DNA, 320 bp, Homo sapiens
gacagacataaataatgtacatactaaataagtaaaccacagccaatgttagaaggtaattaacgccatggaaaaaagcattaatccaggttaaggggatcaggagtacaaaaggggagtactttgtaattttaagtagggtggttagggtagatcttattttaaaggtaatatttgagcaaagacttgaaagaaatgagaggagacagctgtgtgggtatctaaggggagagcattcccggaaaaggtaactggcaatgcaaagaccctgagtcaggtacatgtttggtgagttcatggaacagcagagagtccaggct

SEQ ID NO: 135847 - DNA, 377 bp, Homo sapiens
tatgccttttcccccctctatcaaatgcaaaccctttcacatactttgagttttaaaactagttaaaatctgaaggagctatttttaaaatatacataatcatatagtaatagtaagaaccacgacttcagccatatggatcatacacacacagcccacataccattcaactctgctaggcacttctaagtccacgggcaatgaccttcatagatttcataggcggaattcaataccttgcgtaataattgaagttacaaatgcccagtccgttagacttacttagaaaaaaacaacacaactctgtgggcttcctatttcaaaagctgtgtgggcaaggagcagaaagcaaaggttaattttgcaaaagaaatcaa

SEQ ID NO: 135848 - DNA, 386 bp, Homo sapiens
cttctggctacctttgactcctggcccaccccgactgtgctaaatgctggtgtggcccctgcacagaagcactagctatcttctggtccttctccacatcatcattcagcaaaccacttcccttgtctcgcctgcaaaccctttatggcaaccactggtcaacagcagctgacattcaaacagagcttccaatgtacaggatgcgatttccggcgcattataagcattgccaatgccctgtgatgggcaccggggtcagcacccacgtcccacttcagagagagattgttgctcagctgcccagagtcccttggcagacaggtggttatggctctcagcccttttggggatcaatcctgctggagagagacctctctggggccatg

SEQ ID NO: 135849 - DNA, 485 bp, Homo sapiens
gccatgtgagaagccctttgcatttccctgccttgtcctccccctgattccatccagaaagctctgcgatgcttgaggtacaatagccaaccggggatcagacggacaagaactacacgcctagcagagcagcaagcaggaaggaagggccagctccgtgcagacgttcctgagggggtacccgcccggactgcctactgcggacttattatcacttgagaaaaatacccacagtgccctgtgcctgtcagctgcagtttgttggctggactagctacagaaaatgaccactggcagtttttcccaccgttggtaaaatcctgcggtggtgcaaaggggcattgagcctcagaaatttttcctttacttttcccaggctgtctactcacttcttcagtctaattttttccaaactagactgggcacagggatggagagaattcaagtacaaattctcaggattttgctgttcaccgtcctttcca

SEQ ID NO: 135850 - DNA, 428 bp, Homo sapiens
tccaggaaagggaggagagacacatatatggtggattactaccagtggggtttttatgtttttccaaaaatggagctaggtgaaataaagtttggggagcaatcttctgctattgctgttgtttctattatactgctagtgctaccagtagacatttgttgagggccaactgtgtgctaggcattgtgcttagtgctttgtgtacattatcttatttagtgatttcatcagtcatctgaggtaggtgctagaacttttcttattttacagatgaagcataaatgtagagagaataagcaacttatccaagttcacacagttggtaagcagcatagctaggtcttaaggcattggtctatttcatgccaaagtctaagatcttaactttatgatcactacctccttaaaagatcactgagctgtgattt

SEQ ID NO: 135851 - DNA, 401 bp, Homo sapiens
ctcctcctccttcccagcttctctacttcttcctggcagtgtcctcagagtctctggccctgtcctggagcttggtttcagtagcagcagagaagagcagaggagagtgccctgaaagtggggcagaatgaattgtagctacacaccaccagctcagctccagctctttgaaagtaaatctgggtcacattagctgtgggctggaacatgaccacgtgggcagaattctgtgcaggcagcagaaaagacagccaatctgtcctttctctgaggtgcagggcccctgtgggaccccagttggtgagggaaggtggtttctggattgcaaggtgtaatgccatcttaatgccatcatgcttttctaatgacatcctaggtgacatagagaaaggtatggaatg

SEQ ID NO: 135852 - DNA, 335 bp, Homo sapiens
ccctgcttgccctcaacactacatgtaggcctcagcttccacacctagcatgtttgttaagcaagactaagccacatgaagcaacagggcaaggggagggcccttgtgttctcagggtcccacggcagaagtgtggttccgggagaaatgggggagtgtgcccttccctgaacaagcatattccctcagtgtggaggagcccctccaaaatttacaagtgctgtgatgacacgatgctcattcagaccaccggctgcagacagattgcagaaatacgtaagggctctgtccttggaggtaggatctggttgctccttgttccctaagcttggccc

SEQ ID NO: 135853 - DNA, 256 bp, Homo sapiens
tcgctcacgctgggagctgtagaccggagctgttcctattcggcctcttggctcctccctaccttttgaatgtatcttttttactcctaatattgtttatttgggttctctctctgttttcttggtgattatcaccagagttatgtcaaatttattagatttctcaaagaaccaccttttggctttgctgatccttttcatttaatttaatttagtttccatttattcagttgtttttttctaatttgataagttt

SEQ ID NO: 135854 - DNA, 297 bp, Homo sapiens
taaatgagatttggcttcaaggctgttgagaattctctggaactgctggtgctcaagttttctctggagtagagctctaagaattctgattcactgtaaggatggcttgctttctcttaggtctgatcccaggacctaatatgacttctggtaggctgagtgttttctagtggtcctaaattatactcagatcgctagaaattctttagatgtcatttagggatgtcttgtgacctaacaggaaggaactgctgtgtgtatctccacacagggaagtagacagtgggaagtgatgag

SEQ ID NO: 135855 - DNA, 341 bp, Homo sapiens
gctaattttgtatttttggtagagatggggtttctccatgttggtcaggctaatctcgatctcctgacctcaagtgatctgccctcctcggcctcccaaagtgctgggattgcaggcatgagcgaccgcacccggccaataatggtaatttttatcatttctaatatttaaaccttaaaaaaagttctcattttaactgtacctcttaaataatattcaaaaatagtgatgttaaattattatctcacttgagctttattgaggatgcttctagtatttgttaatcttaatggttcagttgaaactattaaacgtgtggtctgaaatgcatgctttgttca

SEQ ID NO: 135856 - DNA, 109 bp, Homo sapiens
agaaacctctctcacccgccagcagtgaggccaggaaggagagaagggatcaaaatgaaagagcccacacctggaacacaatccacagaaacaaaagcctgatggaggg

SEQ ID NO: 135857 - DNA, 278 bp, Homo sapiens
cccgcctccgcctaccaaagtgtggggattacaggtgtgaaccaccacacctggctaaatatttactttttatttgtttaaccagtatagaatacatgttgttatgggagaatggttatttccctcataaaataagatttaatgaacatatttgtgaaaaatgtcctagggtaatttatagccaataaatgtgaaaatatgagatgatattggggatcagaatctgtggctggagttggaaaagggaggaggaagtttcacaactaccatgcacattt

SEQ ID NO: 135858 - DNA, 645 bp, Homo sapiens
gataattcatagagattttccctacaaagtctgacatagtcattctgagatgacctaatagctggggagtgcttttcttcccctataaaataacaagtcccattccttccctatcctcaaaggatcaccaacatttttaaaacatttctaaaacatttcaaatgttagaaacatttttctgtcttatgagtggaattgcaatagaaggaatgaaatgaaatagtgggtgaaagtacttaaatgctagttactaagaccgagatcattgcagaaggagactacagcaacagtccagtgttattcatgggatgggtacaggtactcctggtgcaggcaggaaagtatttaaataccacacacccaccaaccttgaaaccttgagccacgcttaggtggcagggattcctcactacttacctataaattgggaataacaacagcagctttccctgccagggagaataaatctggtaatagatgcaaagaccttactccactgcctggcacaaaggaaactctaaagtagaagctgctattattactaattattattattattcttttttagagacaaggtctagctctgtctcccaagctggtctcaaatttcctggccttaagcaatcctcctgcctcagcctccca

SEQ ID NO: 135859 - DNA, 466 bp, Homo sapiens
gtgtgtgtgtgtgtgtgtgtgtgtttgtgtatgcacatatgtatgtgtgtagttcctgaagtctcctattaatggtatcaggaaatagcaaatatgagaattgcatccaataaagaatttcacggttgtgctaatgtagtattgttgtgggttgaatttgtgtccctcaaaaagttatgtttattggcagtttccagacagggggaataaagtatgtttaatttttaacttctagtacctgtgactgtgaccttacttggaaataaggctgagaagatgtaatcaagttaaaatgagatcatattggaggccaggcacagtggctcacccctgtaatcctagcactttgtgaggctgaggtgggaggattgcttaagctcaggagtccaagactagtctggacaacatagtgagaacctgtctctaaaaaatatgaaaaaagcaaaaacaaaaacaaaaacaaaaa

SEQ ID NO: 135860 - DNA, 552 bp, Homo sapiens
ccagcatgggtgacagagagagatcctgtcttataaaaacaaacaacaaacaaatgaataaacagaaaatctgtaaaagtctaaagaagatcaggccatagatatgtttaaaaataatgaaattgatccacttttcaagaaacagactatcaactgccaggagcaaatcttggagtcaatgtcttagtttcccaagactaatccttgaagctattgaaataatgaagtaaaactgattttaatttttactctattaaataaaaaataaaaaagccaaaattgacaaatgggatctaattaaactaaagagcttctgcacagcaaaagaaactatcatcagagtgaacaggcaacctacagaatgggagaaagtttttgtaatttatccatctgacaaggggctaatatccagaatctacaaggaacttacacaaatttacaagaaaaaaataaccccatcaaaaagtgagcaaaggatatgaactgacacttctcaaaagaagacatttatgtggcaaacaaacatgaaaaaaagctcatcatcactggtca

SEQ ID NO: 135861 - DNA, 414 bp, Homo sapiens
ctcatctccagactctaggcacatgactggaatgccatctgcctcctcaccctccatcccagcttctcccaagttgtactctgtgccacatcagccaaaaaagcctgtgaaatgccataccccattcttcctcttactgatctgaaacatacacgaacaccataaagcctctgataaggcctgcaggaaagaaacctgtctaaaacatgttttaaggcagcatctcccaaaggtctaactccagcacatctgttcaagtgacaccttcgaacattcagcccatcagtattccatagacacttccacacccctgtgatgtggccggccgtgcttggagccacgccactctttctacatcctgttcacctttcagagctcagtttcagactagccttctccagaatgcctttgctg

SEQ ID NO: 135862 - DNA, 337 bp, Homo sapiens
ttagctaatgggaaagaaggtagtgccagaataggccggggccctccccagagcttggaaagtctctgaggatttgcaaaaacatcccaagagtcatacagagactggtgggggaagcagtggttccctgggcattctttcctgcttcccctgttatacacaagcctgcatctgatccaggtgaagcagatggctgtctgtactattctggggccctccaggcaacagtgtaaatgctgtccccttcctccagccaacatttctgagattaccaccccaccctcttccagatgttgttaaccagaaaacaaactcctttcctgttacccaccagaag

SEQ ID NO: 135863 - DNA, 591 bp, Homo sapiens
tttgataaaatgaagagatagaaagtatttatatactcctattttaaacatgacagggctcaataattaatgaagaattttaagttggcttttaattggctattttgtgggtgtaagctagaatcttcattaacttatagtaatgaaggtaaagtgttttagaaataagcctgattacatatgtgatagcttcttaaggagttgggctgctttcatgcaatataacacttagaagactattttatagaatagatactccacaaatttctgttgaatttaatgcagtaaaattaaaatttaaaaagcacttaccaagcacagtgagtttagcttctgaactcatccccatagcttctactctaatttgggaggtgtcatcaatagacaggtctttgaatgtgatcgaatgagttttcccttcgtcttgcattgagaccgacctggtggtgtgtaggcgctggtcattcttgaaccatttaactcggatgttatcatgagataactccacagtaaatacagcactttccttctctttggcagttacatctttgagaggggtgaggaatttgagccggattcctatcaagaaaa

SEQ ID NO: 135864 - DNA, 470 bp, Homo sapiens
cgcaagcaatcacatataaaaacttcattgtttatgtggatatgtattccattttccttgttaaaccaaacaaatttctattccatttctcacatttcttgttttgtccccatgcccttttagctatttcccctttccaaaatgctccccacagccacgttctggatgaagctctcctagacaaaccctgcctggctcttgctgcttagacacgccaggaaccccttgcacaaagctgggactggtttatttgatttgtctgcctagcatgcagtcaccaagtttatagtatctcctacaatgaactagaagttccctaagggtgaggaccgaagtctctgcttctgtgcccatcactgtgctcggtacccagggaggtccgtctcaagtgaggggttttccatgcgtgagaaacagtatgttttagagatcctgccttgagcaaaggatacatgggactaggacacagg

SEQ ID NO: 135865 - DNA, 143 bp, Homo sapiens
gccactgcactccagcctgggtgacagagtgagaccctgtctcataaaaaagagaaatctgttcaaggtcctatgttctgtgacagagaccagcaataaacattgaaatatggaaggcgatttcaggtagtactgagtgataa

SEQ ID NO: 135866 - DNA, 195 bp, Homo sapiens
gtgacagtgaatatctgtgttcagatcctgttacattgatttttgagttttatgctaaattttatgagatgaaactcggtactgtttagaagtgctcccatatgactcattgtttacaaaataattttaaatggaattaataaagtaatacgtttattgtctgaaagaaatagatacttttgctttttttttttt

SEQ ID NO: 135867 - DNA, 140 bp, Homo sapiens
cctccacccttccctgcctcctgcctctccctgtctgcccttctcgggacccaggctccttctgtctgtccacaagcatgctcaggtctccccatcttaaaaacaaggtctggaccccctgaataacctctttcttgcat

SEQ ID NO: 135868 - DNA, 342 bp, Homo sapiens
catttcattttattttatttcccttcattttaaaaagacaccttaaaaaaaggtccaccgggtagcgtcctggaagcacacaggacagcaaggagaggatggttttagagaaagagggctaggctgagagacttgaccttgaaacttccatcctcttgcccttgggtgtaaatgatttgaatattgagaatgtcttgcaatataaagccagagttcacgaggctgtttgttttgggttctattaggcctgagggagtcacagagcttgaagagcggaaaagtacaaaagagttattagaagaaactctaagacaccccttacctccatcaacaatgcttcag

SEQ ID NO: 135869 - DNA, 308 bp, Homo sapiens
gggcaccctaagaaattatctttgtgaggaacatgtaaaatgtcctgaggtccatattgatcttccttcctccacaacgagaaaataacaaaagtaaatatttggggccacgtttattttggtaagataagttccagtctggtttctaaaattagggattctgtggaatgcacgtggtttggggcatcctgcggagaactttgtctcagggatatgtagtttcttatgtgttgttgcttgcttggaaatgtgcatctaaaccttccctcacgtctgctcatctgtgcagacccagtgccgatggtagg

SEQ ID NO: 135870 - DNA, 495 bp, Homo sapiens
gttgtgaggacataattgatacttaaagactaccgatatagcaaaattactaaggtgatggctgtaggattacaagaggggcaattttttttcttttctttgttttttttgagacgtagtttcactgttgcccaggctagcgtgctatggcaggatctcagctcaccgcaacctctgcctccccagttcaagcgattctcctgcctcagcctcccaagtagctgggattacaggcatgtgccaccatgcccggctacttttgtatttttagtagagacggggtttctccatgttggtcaggctggtctcgaactcccgacctcaggtgatccgcccacctcggcctcccaaagtgctggaattacaggcgtgagcaaccgcgcccggccaaaggggggcagttattattattattattattatttgaaatggagtctcgctctgtcgcccaggctggagggcagtggtgctgtctcggctcactgcaacctctcc

SEQ ID NO: 135871 - DNA, 408 bp, Homo sapiens
tttaagagattaatttgaaagagttcttgatacaaacagaatacaaatctctcacagtaaattcatcatgaatatttattccagcctgtagttctcttaaagaagttgctaatactgatgtttgattaatccatcttttcttttatgatgtgtgtatgtttcccacctcaagagcagatagaaaaaatcttctatgtattttaacatttttgtctttacatttgggcctttttttttttcttttttttttggaaagggagtctcattctgtcacccaggctggagtgcagtggcatgatctcgctcactgcaacctccgccccccaggttcaagcaattctcctgcctcagcctcccgagtagctgggattatagatgtccgccaccacacccagctaattttttata

SEQ ID NO: 135872 - DNA, 171 bp, Homo sapiens
caggatatgccacagatgatgtctataaacccttatttcctttttcttccccccagtgggtaatagggaagtaggagagaagccattaggcagcagggagcaaaaggcaaaattaaatgcttttgtagacactttttgcactttttgcttcaaccagggagtcggaggttg

SEQ ID NO: 135873 - DNA, 754 bp, Homo sapiens
gttgtactacttttgtctcctcaaattagtttaaattaacttttgggaaaatagtggctatgaaaaaagaggagcataaagaaatcgatctgcttacaaatttgcatttagatataaaaatattaaatcctaaacattgtagaacttcagttctatactttttaaacattaaatcttttaagagaacttgcataataaagattttgccttaatctgaaacatattcatagatctactttgagttcagagcctcctttctctatgcctgtcattcagttttattatcaaacatttgcgttctatatatgattaatgtaatacacttttagatttcttaaagacgacaattgcatggacaattcatcacttggtagcaacttatgatattgctagtgatgcctaaaacagctatgaaaatttgatctcatgtacttttgtcggaacattttaaaatatcaagtataaactcttgatgccaaaaagcaggctttgctttttaatgatagacactattttcacatggagtcagttatgaattattttgcctctcttaccactttactaaagtcttctctcattaccctagctgaaagtattgctttgtcacctgaattactaatatctgattacttgcatggttgtaactgggtaaatatcatgcagtaatacactattttttagacttgtactcccagtggaagcctgtctccagatcttatgcaaaagtccaataaatgaagcagaattaatacaa

SEQ ID NO: 135874 - DNA, 531 bp, Homo sapiens
cattgcacagggctgtagctgcgctaggtattgcattccagaaagctccttggcttttaatgtgtggttcttcttttaagtttatcccatggtatggtctctgaagttcttggccaaattcttaaagctggactggccatctttccagtttccctccatcctcttgtgctcctctaagttctcaacatccattatttcatttactcaagaaatatgtattgggcacccatcaggatacagggatgaacttgtgaaacacactgaattgccaaaaggaaaaatactgcagttttagactgtggaataataacaatgaccagaactcttaggtgaaaacatcttagtttcacatggactcaggagagactgtcttttcttttgcactgcttataaggcattaggagagtaggtataatcacgtttaggtttgaatcagttagcagctgtgctggctcttctctgaagtgcttgccacaaactcagatttctgtatttatgctggaattacctcctttctcctcctctgtggtc

SEQ ID NO: 135875 - DNA, 184 bp, Homo sapiens
tacttttccaagggcctgggactggctggacagacactgcttataaggcattaggagagtaggtataatcacgtttaggtttgaatcagttagcagctgtgctggctcttctctgaagtgcttgccacaaactcagatttctgtatttatgctggaattacctcctttctcctcctctgtggtc

SEQ ID NO: 135876 - DNA, 317 bp, Homo sapiens
tttgattttgtggcttcaaatttgctcaagacttgttaagttgaccttgttactgcacacagaaggaaatcacagtcggtgtctcttctgtgagggaacctgcctgggagtttgtggccacgtgttcatttttaagacacgaggctatacacagttaaaaagccaattcttggccgggtgtggtggctcacgcctgtaatcccagcactttgggaggccgaggcaggcagatcacctgtgctcaggagtttgaaacaagcctggccaacatggggaaaccccatctctactaaaaaatacaaaaattagccaggctt

SEQ ID NO: 135877 - DNA, 170 bp, Homo sapiens
ctggagcccatggttttctcctggagctggttttctcctggagcctggttttctcctggagctggtttctcttattaaattttccatcagccttgtgactattagaaaagaacactgtcacattataacaatgactgagtaaagagcaaaacagaaaattgtcatctact

SEQ ID NO: 135878 - DNA, 809 bp, Homo sapiens
taaaattgtttattcaaaatgtgaaatggggatggacataaaagaataagggaaaattatagaaacttcatttttatattaattttatttacaaatgttcacacaaattaatagtaaaatattcttatttggaggattatgaaccaaggtgaataactttcttagagtaatttaagataatggaggactttataaaaataaaattcataatcttaagagccttgataaacttgattttaacttttggtaattgaacgagctgcactgatcaggggaaaaaaattctactaatataaacttggtattttggaaattagaaagtcaaagcaccacaaatcttctagactatgagtaactagagtaactagtgttatctagagtaacattgattcatattctatgtgtccggggatggttatactctgagcttatagctttcttttttgctagaaccctacacttgtttacttttcctgagtagctttttttggtgatatttttaataagtggaataatgaaaatgttcaccgtgtttatagttttaccttataacagtagttggtgtacagttcaagatttgtattttggtttttttattattcagccagttcttttgtaagcagttattttttgcagtgttcctaggttttcacttgaaagcttaagttaatatttttatccattgattttggagggatatgtttattaacattattgtgcttttggtaatttccaagagccagggcaatgaatcctatcttcttcattgtcatccacacaatgttgtaagataaactattatcacatat

SEQ ID NO: 135879 - DNA, 475 bp, Homo sapiens
cccgctctgaccctcattgaccactcctcctgagactctctgctctcaggtctcagcagcggctctgctgtggccagtctctcctttcagggtagaccactgagtgtccacctagaacagaacctttctgtgcacctgggtaacctgaccatcgcctcgtgttcataggatgagctgctaatagtggcgtttctttcccaagcagccatcttttggtaaagattatcatgcttgtatagaaaatgctaatggtcacagaattcctgacataaaaagtctgtcacagtttgtttcgcagaaacatttttaaacaaagatctaatgttgggcatataaacaaggcagtttactgtagattcccagtgcttctctttgcatttgtattaggcttgcaaaagagaaaagggtcttaacatttagcataggaagcaatgtcttgtgatggtgctgtaattggaagtcagtgacctgtatc

SEQ ID NO: 135880 - DNA, 864 bp, Homo sapiens
agaacccccaaaaacagttgccctaaactcagctcaagtgtgatttggtaaggccatggtctctcccattttacaaatgggagcaccgagatacccaccaagaaaaatgaaattcttccctcacacctcacaatacaggtgcatcatttagtgttctgtagttgtaagtcatagaaacaggctctggctaatacaagagctgaaagactaagggggagagctgggcggcttggaagatgcagatgggcaggaatccctggatggcttcctcaaggagaagctacaggaaggatcttgctcaagagaaagagtctgattggcctaagttacatcctctgttcacccttttgccaggtgagtgaggggccactcacttggcacatggactggaggaagggtggttcccaaatgaagagcaaggtgctgttacccaaaggcaggaaaatagatgtgggccaggccaaagcccacctttcgactattgtgagtactgtagggaaggatactgcccctgaggtctgcaggcttctatatgtaagccagccagaggtgtccatgaatgcagtatcagaaagtcagtcggatctataagcaccctgtgtgcagagcactctactaagggctttagagtgtaccaaggagtggagacatgctctcacttctgatttgtgagcttgacagggatgaatgtaaccacataagttaaatgtcatgttagacttgtagccccatatagacaaggattttaatgtccccaagctaagactctgggtgggtgcatgtccattggcccaggaatccagatggaaaccactttgtggaaatgaaatcttgtgcctaacatgctcactctcttttgccctc

SEQ ID NO: 135881 - DNA, 284 bp, Homo sapiens
ctcctcccccccgggagcctctggggatcacacttaccctgaagagggcccagtcccctttggaggggtagagggctcaaccttcctgctctcataggctgggaggggaggggctctctgatggtattcccccacttgcactgtttagggtggctgggtctgtctgtcagcagcagagccacccaggatctctaggaaggtggagtcccaggctaatggcagggcaatagctaggagggagagatagcaaggcagactctgcagtatgtgcactgggacagact

SEQ ID NO: 135882 - DNA, 292 bp, Homo sapiens
gattctgcatttcttaaaggcagaaactgttttagttatctttttggtccacatttgtagtagttgttgatatgcattgaattgatcagatttacttttttttttttaatcttgaatacttactagcacatatattgtgctagatagtaggaataaaaagataagtaagacacaattcctgctgaagaggaattacaatgtggtaaaacaggtagatagtcaaacaattatgatgcagcatgataaagtttagtaatagaagtttcaagaaagtatttagtgccaagaagaa

SEQ ID NO: 135883 - DNA, 1707 bp, Homo sapiens
attgaatgattataagaatttttaaaaatacatatccacattttttcatacacagatcaaaggagtgtttcaaagtcttttacatgtaacaattgtgacttcattacaattgaatgaggcatttaaccatagtatttctcatgaggatgttactcaaaacgatgccttacatataaaaaagcacttaaatctaatataaaaatattacaaattctaagccctcttaaaccctaatttatgtataaccttatattataaaatgcttaatactgacacaattttaaggcttttaccaaagtgaagcctgtgatcagagaataatttgaaactctaagttctgataagacaaaggttgaaaatgttgatcttgaaaatcttcatatgattttccagtctgaaatatgaaatagtactgataagggtactaatttttaaaagaagattttgaacttctttaatgagttgtttttaatattcttctaaaagtctcaagaggtatataacacaaggctaaaactaatattctaaaaatagtatgaaattaaagaaaactctaacttctatctatgcaaatagcggagcttccacaattcatctgttagctagaacttaagatttcactgtttacatctttcatgttttcattcacttatttattttgcaaatatttactggatgtttcctatatgccagggttctaagtgctgtggatttaatagtaaaaaagataaatgtctctgatctgagtttacattgtaataggtccagaagaaaagacagacacctaagtaagaaaaatataatattaaatgctatgttagagcattaactgcatgatgaggtagtgactgggtggctactttagagtgggtagtcagagaaggcttctctctgaagtaatgtgaaggacaagaagaagctgaccatgtaactgttattccagtaaaaagaaacagctatggccaaggttccatggtagaagaaaacttggtaagtgtaaagtataagaaaaatgtcaggaacaaggacaggaaccagaccacataaggctttgtattcaagataaggaacttggatttttttaactgtggtaaaattcatataatataaaatttaccattttaaccattttaaagtgcacagttcagaagcattaagtatattcataatgttatgtaaccatcaccactatctatgtccagtatttttccatcagtcccccacaaagaacttcctactcattagcacttattttccattttcccttcccctagtccctggcaaccactaatctttctttctctatgaatttgccaattctgaatatttcatataaatggaattatgcaacatgtgtctggctttcacttagcataatgttttcaaagttcatgcactttgtaccatgtatcagtagttcattcgtttttatgactgaataatattctttgtatggatacactatatgatatggtttggctgtgttcccacccaaatctgatcttgaattctacatgtttaggagaaacccagtgggaggtaattgaatcatgggggcaggtctctccttggctattcttgtgacagtgaataagtctcatgagatctgatggttttaaaaatgggaggttccctgcacaagttctcttgtctgctaccagtgagatgtgcctttcaccttccaccatgattgtgaggcctccccag

SEQ ID NO: 135884 - DNA, 454 bp, Homo sapiens
atgggaagaacaaataaaagtaagaagagagcacctttggctccaatcgtcttgatttctattttgactgtggtcaacattaccaagcatttaccacattccaggaaacatgttcagagctttatgtggattcttttgtttagtctttattagaaccccatgaggtaggtactgttgtagtgggcattttatagatgagtaaactaaggcacagagaaatttgagaacctgtctgcagtcccctggctgttaagatttggaccgatgcttgtctgacttcagaccctgcactctttattaatgtgacactttgcacagaactactcattttctttgcttttgcctagcaaggcttatttcatcaatctgaaacacttacccacttttttggtccataattaagaactgatctctgaatcaaaatgctaactactttcaaatgcagaatatttcc

SEQ ID NO: 135885 - DNA, 489 bp, Homo sapiens
tggagtatttataactgccagcagtccttggttgcagtctattcagaaaggtattaattctcttacgcttatgatttgcaaaggaaaagaaactcctcagaccaaaacaataacagcaacaacaaaaaactgttttcgtttgggaggaggaccaaaaggaaggaataagggtcaggcactgactctacaggtactcactgatctctttgttatgactatggagttttctttactttattcccacattttttcactgcactgggacctgcattttttttttctgtttttgtcatttgtcacgtttgactttctgcttttccttagttaggtcatgagaccaatcacagaaattatttatttatacattttcaaaatgtcttttcctctcctacccttcttcatgctatttcaaaaattacaccactggataaatttaaatgttcttcctgttttgcatctaaacccagcagtgaactatcactagagaaa

SEQ ID NO: 135886 - DNA, 706 bp, Homo sapiens
ttttatttttttccaaacagtagaacacaacttctctttagaggatggtgaattttactacttgaagttatgtagaacgttaggactattccagggctattatttttgaaggccattgagaatctgaattagtattgttatcccattttacagatgaggaaacagcagacagtataacaagttaaccagtgacaagattaaattagaccttttattctctttcttaactacatgagtctactagtttttctgtcatatacttaaagctgaataacaaatttgagattgtaagttaactctggttccaaaacaggataaatacctgttgaatgaaatcagtgccatgggattgtttgaacgagcttggaccttgatttccaggtctacctgaaatatagtcactcttacaaacacagattcttttccacaaacctctgaggtagggagtaaaatatggaggccaagaacacaagctctggaaccagactgtgtgcgtttgacccaggttccatggcctactgtgtgaacttaatctgttgcgtaactctctctggcttagtttcctcctctgtaacatgaggtcattagtagtacctgtctcataaagttattttatgcattaaaggagttaatatattgtgtaaagcacttagaatagtgcctgtcaaataataagcactcaataaaagttgttgctgctcttata

SEQ ID NO: 135887 - DNA, 426 bp, Homo sapiens
tctgtctcagaaaaaaaagagaaggggagatgcttacttattatcaaagtaattagaggccagacatcgtggcctgtaatcccagcacttcaggaggctcagacaggaggattgctttagcccaggagttcaagaccagcttgagcaacatcacaaaacccgtctctacaaaaagtttaaaaattagccagtcatggtggcgtccgctgatagtcccagctactcaggaggctgaggtggtgggaagatcacttgagccccagaggttgaggctgcaatgagctgtgattatgccaatgcattccagcttgggtgacacacccagaccccgtctcaaaaacaaaacaaaaaaaacaaaatctgaaaggatgccaaaacataaaaatcacattatcagtttaattgtgattttgctgggaaactgca

SEQ ID NO: 135888 - DNA, 313 bp, Homo sapiens
taatagatgactgtagaaatagttttgctcaactacttgctttcttgatgtcaatttatgttgatattacttaatgattgtttgcctctttttgagtgtaatgaagtgaggtagatttgacatttatcttttgaatactttgtcttgaatggcgcataatataagtgaaatccaggcagaagtatcagccttcttccaagcagctttcttttgtaccatagaaagttttcttttgtttaaaagtttttcaactacaaatttctttaacagatgcaggtttttaaattttttaatctatttcttcttgagggag

SEQ ID NO: 135889 - DNA, 143 bp, Homo sapiens
tatgatttctcacaggaaataatatatgggaatcagagtgtgattttgaaaagaaaagtatgaaagaaaatgagtaccttgtgagattaagcactacaccagcttgattctatcatactaatttatcaaaccctgtgttatta

SEQ ID NO: 135890 - DNA, 258 bp, Homo sapiens
gcccacccaccccccaaaaaagcagcacttaaaattcaagaccaatacgatctcaggcaacacggacactgttcacagaaggcactaaaagcatggtgcgcccttaccacctctctaaccccaggcactgagagcctgctctcactcaacatgccctccctagccgcagagtccgcgctcgctccactcaaagcaaacagtgagctgtcttgcccacagtgaactccgcacacaggccacttgcgcacagcacgctcc

SEQ ID NO: 135891 - DNA, 225 bp, Homo sapiens
tggaaacatataaaacattgatgaaagaaattgaagaggacataaataaatggaaagccatgccatgtttatggattggaaaaatcaatattgttaaaaagtccatacaggttaagtatctctaatccaaaaatcataatgcttcaagatctgaaattgttttagttctgacataccacaagtgaaaaatccacacctaatctcatgtgacagttcacaggcaaa

SEQ ID NO: 135892 - DNA, 301 bp, Homo sapiens
cttgccattatctagaggtttctaaaggctttcaattaaaagagcaggaggcctcactcctcaataataaagaacagagaaaaccacaggcttacaggccagtaaccccacccagccacgcgagtggtttcacagcccttcgaaggaaaggccacctgctgctcagaccacaggcccacagatgggcaggcagaggcatatctgagcctgcccacccacctcttgtccacagagacacagtaatctgtggtaccgtgagacctagaacacaaaccccatcatccagacctgaactgcttct

SEQ ID NO: 135893 - DNA, 298 bp, Homo sapiens
agactccgtctgaaaaaaattaaaaagatcataaaactcacatggctcctaagcaccctaggagaaagttctgctcccttccatgacctatggggccctgtgtgacctccaacctctacccagttctccaggcccgtctctaagattccatgctcctcatggaatttcacatcctctctcccgtaggagcgaattataattcctcaagccctctttcccctcccatcctttgcccatgctgttctttatgtctggaattcccttttctggtctccttttcatcctttcctcctcctca

SEQ ID NO: 135894 - DNA, 424 bp, Homo sapiens
caggaaaggtcagatgacagcaagatgggggactaggagggagacacactgttgaaaagtggccatctgttgtgtggaacccctattaacctcaatagggaaagtaccaagttcaagaggccaaagaagagcccaagagccagcaaaatagacatggggttttattagggattcacaggggagagagtccagtggcagtgggttggacaggagacccggcttccctgcagaaacggtccaatggcggcgggctggacagcacaacagcccagtggtggcaacctgggcaggaaaaccgcaactgcttgcaaacagcatgcagtttattcagcattttcacttaacaccctcctcttaacctccacctggcaaccttcatccaacccagaactcagggcctggatccccctgcatggtccatgtt

SEQ ID NO: 135895 - DNA, 498 bp, Homo sapiens
cactaatacaattcaacaaattctgaagattaatttaatccagactttgcctgtttggcatgacagtggagagcatttcatctgaatctcaaggaagccactaaataactactttgtgagtcctggcaagtctatgttgggacacttccaatccctccctctgtccctctcctgctgacacggtcccatccagtgcctggccctggtgcccaggaaggtggcttgaatggtgacagagatcacaagagaggtttctgactcctcttgacatacttctggtggaatgaaaatatgtccaattctagatttcttctgatttcagaacatttattgtattttttttatttttgagacagcagtctcgctctgtcaccaggctggagtgcagtggtatcatctcagttcactggaacctccgactcactggttcgagtgattctcctgcctcagcctcttgagtagctgcgattataggcacatgccaccactcccagccaa

SEQ ID NO: 135896 - DNA, 522 bp, Homo sapiens
attcagtcacatctcaagcaaccatttattctgttatttaatagaaggggagaaacccagttaccataacaactcacatccacatggtaattatggagtatctaaaatacagcaaaccatacttttcacagtattttctaggggaaatgtgtaataagcacagataccacttctccccattattattcacaatgttcacctaattgtttcatattgcacagatgctaacattattccttgtacttcatatcaaatatgttttttaaaataaagatgacactgaaagaaaaaggcaaatacacttcttatattttaaatgattggttacagcatatgtacttttctagggaaaaaatttaaaggaggcagaaaaaaattaatttattaggtaaaaagaatcaaatgattatcacttgaaaaaaagaagaaagaatgtagaactaaagattttatttagaacagagctgccaataggtctggataagttttctctgaaataaaaatgaaaagagagctcattac

SEQ ID NO: 135897 - DNA, 145 bp, Homo sapiens
tgtgaagcaaaggatggacaaccagttgatgagacagagacaatgcaagagaatgttccagcctagatcaggttagaagttttgtgattctaaccagaagaggcattggagaaagggaagcctgccagaatatatccagggcctg

SEQ ID NO: 135898 - DNA, 525 bp, Homo sapiens
taatgcatttccaccatatgccaccttgagacactaaccttagcggatggctccaggggcacgtaggaagggttgttgctcttaacgcggcccctttttcaagaattgctgtagttggaagcagctccacagtaatttcctatagccctggggagtatgcttttaccaatggcacctctagatgcccttcactctctcttgcagcagggccaagactgataacgaatggcccgtgggaagcgcacgaagtccaacgtgaatcaacgatagcactaatgaaattgcttcaagttctagagcagaaggtaaactgaatgcctttcagagacatttgaacttgtgcccttccaagttcccagagaagaaagaaaatgcacatggggtgcaagccaagagtaggaacaagccatcacatatttcttatttttacttaaaatctgtaacacaggccgggcgcggtggctcatgcctgtaatcccagcactttgggaggcagaggcaggaggatcatgaggtcaggagttt

SEQ ID NO: 135899 - DNA, 292 bp, Homo sapiens
cccacctgccttctgagttcacaattatatgccaaagagactacagtagctttctagtagaccagaagtctccctgcacagtgtatcacatgctgcaatttgctttgagtatagatacctatgcatataagtagctgtatggactgccataactctagggactgctgccgttgctatagccacaccatagcaatagggaccgtcactgtagcaatagtgaccactgccatagcaggtctcatagctataggaacctctctagctatagcaaccaccatagctacagaggccc

SEQ ID NO: 135900 - DNA, 788 bp, Homo sapiens
atggaagatttgctaccctgatcttttccctagcatacttctaaagttgattgaatccctgagtatcaatgaagaaatcagagtttaagtggctagggagagccaggtataaagactgattaatagagtacttcagctaattaaaaatttaaatagtaataatttatgaatgtgaataaattggaaggcagcaaaaagcatgattatagaatattaagttcaattatatatagacagtccagtttcctagtgaataggtcaagattatttgttttgttttgtggcactatcatagttcactataacttcaaactcctgggctcaggctatcctcccacctcagcctctgaagtagctgggactactcacatgcgccaccatgcccagctaatggtttttttctttagagatgggggtcactatactgcccaggctggtcttgaactcctaagctcaagtgcttctcccacatcagcctcccaaagtgctgggattacagccatgagccactgcatctggccaagatcaagattatggatattggtatgttaacttttaaaataaaagtacatgggctgggcgcagtggctaacgcctgtaatcccagcaatttgggaggccgaggcaggcagaccacctgaggtcaggggttcgtgaccagcctggccaacatggcgaaaccccgtctctactaaacatacaaaaattagctgggcatggtggcacatgcctgtaatcccagctactcgggaggctgaggcaggagaatcacttgaactcgggaggcg

SEQ ID NO: 135901 - DNA, 169 bp, Homo sapiens
tagagacagagatgctgttttaggtcaaaattttattgaactctaattcatatactaaagtttagtgttgaattttgctccagcaatgtagcaggcatgattaactcccactacaaaatatctacaaatgtaacaaacatagttttacatgcaaaccctaactcattac

SEQ ID NO: 135902 - DNA, 508 bp, Homo sapiens
ggcaaatgacctattagaaaggaggtacttgatagtagggtcagcaatgtggcagaataggaaactcctgactctccctccacccatgaatgcaccaaataaatatctattcatggatcagttctctctcagagaaagtcagagactagttgaaagattcctacccatggggcaactgaggaaacatcctcatcgaatgggtaggaaaaactgaagcacgctagggccagaccccaccctgggcattgtgccataaaattgggaagggaagccccagcatccaacttctccccatggagaggagggttttaaccccacatatagcatcctaacttaagattcttcatggtctggctcttaattcaccaactctgggagcagaggggattagacatacgcaagtctttctagaccacaggaaaaaagccgcagttagatatgggcatttaagcacttcagagctttcatcccccaggagcaatacatagaagggacttaagaaatgaag

SEQ ID NO: 135903 - DNA, 752 bp, Homo sapiens
cgccgcctcccaaagtgctgggattacaggcgtgagccaccctgcctggcctccccgagcattcttttctccatctattcttaaaataataagaacaaaacaccatgtattaagcacatacgcagcaggaactatgctaaatgcttcacaaatgttaaatcctcacaacaatctttgaagtgttatctctgttttaaaacgagaaaaatgaggctcagggaggttaggcaatttggcagaggtcacacaactaggattttcatcctgtgttatctgaccctggagcccttaactacttatgctaataatgaacatttatacactactttgggcgtgtccaagtttggtgggtcctgaagcttgtgcaatctggggtgctctttaagaataaaattattttgtactcataagaattatgagtacaaaattagattcagagcctgggaaagggtcctggcctagctttacagtttacaaatcatttcacaagcaggctcattttatcctcctggcctccctgtgaggtggggattatgatattcatttgacttaggagaaaacagagcctcaggaggttacctgcctgtccaagatctgaattttatgggaggcagagctaggactgaagccgctgaccacaaccgtgtctttaagaagacaaactccaggcagatggttgtcagacagctagacatgcctaaacaaaagcagctgtgataacagctttctctgtggtgtttggggagaagaca

SEQ ID NO: 135904 - DNA, 634 bp, Homo sapiens
tctttttttatgtagtggcgcgcacatacacacacacacaccccaaaccaaaatgtcaagtctatgaggaagagcaatggaaagagcctgaagggaaaagattgggaaccatggcattttgagaacctatctacagctactaaggctttttgggtgttgggaaaacaggctattgcttaacaagggtggggaagagcgacatgaatgtcatgaaacaagaatgggggcatcaaagacaaattcatcattactttgctggtgtcttacaggactttcttccctttgaaaccttagtaacattttttcccctttggaaaaaatgtcagaggtcctaagagcgggcctgaaaaaagaaaggagtagatgtctggaagaagcagaagccgcttccaaacattacttggataatggtgccctcttctggggtgactgatgtgacaatgtgactctgaaaccctgtctcctactacttggttcaaaacatccagaaagtaattgactaaagaaacaatgagactaaaggttaagcacttacaaaatcatttaaaagtttgaatttaggagctagatacatgcataaatatacatatgataaatgtattcaaagatgtctcttttcctttttttttttttt

SEQ ID NO: 135905 - DNA, 380 bp, Homo sapiens
attcagctggcctagctgctcacacagctgctggaagttcctgactctgctgagcaactaaaacttcaaggtgcttcaggttggacttcatttctataaactctccttgtctctggggagagaggcagtgagaaagacagtgatggacagtgcaagtcagaaagcacaataaaacatgagaacagaccaatggatgtgacagcagaaccaaggcttgctccttgtagggaacctctcagggtaagcacaattacactcgggagttgaacccctggggcccacatcatgtcaaggaaccttggggaaggaagctagtctatatgctggcccctttccaagtggcctgtgctggcctcttgtcctagctgaataatttgcaa

SEQ ID NO: 135906 - DNA, 718 bp, Homo sapiens
gagccggaggggctgcactgcaccgagcttgcacagggcgaggcgggggcaggacctgggacccagccaccccggaggaaaccggagaggaagccagcttggtcttgctctctgcctcgtcccaatccccggctcttaccaaatgcagatccgttggctgaatgccttttagtctgcatacatgcatctcataccgcacagcccaaatttctacaacttgtccaggtgcagtctcctcagaactacaaagcaagaaaagatcacctttgggctcaggaactcacagtcgttctccctctcccggaaggcacaatgaccaggacagtaccgagctttgcagccatattgaactcaccatcaactcagcacattcaactcaatcagtcaaaatcgtcttttcctgctggtaaataacactgaaatacaaggaagctgagccttcacaaggtcgaacaacacatttgatgccatgcaactgagaagtggttcaagctggatttgaacaaatgtagtcagactctgcagcctatgcatgtacccactgtgctatgctgtcgcattgaataaaatgcagtgccctcaatacgaagtcaatgtgagcacataccaagaatcatattgggaaggagaagtcctcagtaggcaaaacactttccagcaatgttaacctggatgtggatagaaaggagacttgggaatttctctgacttaattcatc

SEQ ID NO: 135907 - DNA, 1520 bp, Homo sapiens
gagccggaggggctgcactgcaccgagcttgcacagggcgaggcgggggcaggacctgggacccagccaccccggaggaaaccggagaggaagccagcttggtcttgctctctgcctcgtcccaatccccggctcttaccaaatgcagatccgttggctgaatgccttttagtctgcatacatgcatctcataccgcacagcccaaatttctacaacttgtccaggtgcagtctcctcagaactacaaagcaagaaaagatcacctttgggctcaggaactcacagtcgttctccctctcccggaaggcacaatgaccaggacagtaccgagctttgcagccatattgaactcaccatcaactcagcacattcaactcaatcagtcaaaatcgtcttttcctgctggtaaataacactgaaattgtgggaagatgggatggtaagaacaaagtctgtctctggaagcacgggcgctgtctctgaagacaaattgatcgtaacacaagcagacccggtggaacgacctccatgctgaaccctcagctccccctgcatttggaccatggcctgatggaaggtgcgagaaaccctgtgaccacgttacagcacaggggcagcttggccaggccaccccttgggcctaatttttctccctggccaaaggggtcagactattccagtgctgtctgctccctggcctccagagtaatcaaacacacatgtttggcgctccactaatcagggaatgaaataaagctagatgtttccatatgttgattcaatttacaagcaaaagtaagtgtcaggtagggggcacaacagtaaggggtgagcagtgaagaaatgattccacaatgacgtttcgtaaggagcaaaaagatgaggaagaaaaggggagacacatcattgaaggccaggctctgtgacaatttatatttgcctatatatctgtatctctctctgtcttatctaatgaaataccaacaacaacctgagaacagttctgtcttccgtcacagataaagagactgatctcagagtggtacagatctacaaccacgtgaagaattggatttatattcatctgactccagaaagttcctgagattcctctgcttcatcatctttcccatgccctttaaaacacgttatcaaatagcaacaggtggtgcaataactagacaaatgattctcagcctttttctttgccattagcactcccggaaggagacgtgttggacacttttccttgtcaccaccccatgaaccttccataccacaggtatactgtgtattcggttatgtatcatctgtacatctgtttctaaaacacagaaacagtaagagccccccatccaagaatccattttaatcctcttgggtgtgatgtcaccccccaaaaatgcatatgctctggagtcagtcacaaacacattacgaatgcatgatcacttaagaatgttaccaaagtttataaatttgagatgataattctatgttatttagttcattttagaga

SEQ ID NO: 135908 - DNA, 448 bp, Homo sapiens
ccaaatttctacaacttgtccaggtgcagtctcctcagaactacaaagcaagaaaagatcacctttgggctcaggaactcacagtcgttctccctctcccggaaggcacaatgaccaggacagtaccgagctttgcagccatattgaactcaccatcaactcagcacattcaactcaatcagtcaaaatcgtcttttcctgctggtaaataacactgaaatagtgccaactgttagtctttcttatctggagtcttcttcccaagtttttattttatgtgaaagcattgtgttctcagcagttattttggtctccatattttatagccaacccctttgatttaaaatattacagaaggctctgttccatccctttttcttcctaaactgatttttgcaaaacccttaatctgggcttgaaggaaatacaatcttttcctacacaattt

SEQ ID NO: 135909 - DNA, 465 bp, Homo sapiens
gagccggaggggctgcactgcaccgagcttgcacagggcgaggcgggggcaggacctgggacccagccaccccggaggaaaccggagaggaagccagcttggtcttgctctctgcctcgtcccaatccccggctcttaccaaatgcagatccgttggctgaatgccttttagtctgcatacatgcatctcataccgcacagcccaaatttctacaacttgtccaggtgcagtctcctcagaactacaaagcaagaaaagatcacctttgggctcaggaactcacagtcgttctccctctcccggaaggcacaatgaccaggacagtaccgagctttgcagccatattgaactcaccatcaactcagcacattcaactcaatcagtcaaaatcgtcttttcctgctggtaaataacactgaaatccactgcactccagccttggtgaaagagtcagactctgtctc

SEQ ID NO: 135910 - DNA, 1229 bp, Homo sapiens
gagccggaggggctgcactgcaccgagcttgcacagggcgaggcgggggcaggacctgggacccagccaccccggaggaaaccggagaggaagccagcttggtcttgctctctgcctcgtcccaatccccggctcttaccaaatgcagatccgttggctgaatgccttttagtctgcatacatgcatctcataccgcacagcccaaatttctacaacttgtccaggtgcagtctcctcagaactacaaagcaagaaaagatcacctttgggctcaggaactcacagtcgttctccctctcccggaaggcacaatgaccaggacagtaccgagctttgcagccatattgaactcaccatcaactcagcacattcaactcaatcagtcaaaatcgtcttttcctgctggtaaataacactgaaattgtgggaagatgggatggtaagaacaaagtctgtctctggaagcacgggcgctgtctctgaagacaaattgatcgtaacacaagcagacccggtggaacgacctccatgctgaaccctcagctccccctgcatttggaccatggcctgatggaaggtgcgagaaaccctgtgaccacgttacagcacaggggcagcttggccaggccaccccttgggcctaatttttctccctggccaaaggggtcagactattccagtgctgtctgctccctggcctccagagtaatcaaacacacatgtttggcgctccactaatcagggaatgaaataaagctagatgtttccatatgttgattcaatttacaagcaaaagtaagtgtcaggtagggggcacaacagtaaggggtgagcagtgaagaaatgattccacaatgacgtttcgtaaggagcaaaaagatgaggaagaaaaggggagacacatcattgaaggccaggctctgtgacaatttatatttgcctatatatctgtatctctctctgtcttatctaatgaaataccaacaacaacctgagaacagttctgtcttccgtcacagataaagagactgatctcagagtggtacagatctacaaccacgtgaagaattggatttatattcatctgactccagaaagttcctgagattcctctgcttcatcatctttcccatgccctttaaaacacgttatcaaatagcaacaggtctcccttttctgactctcaccctcttctttctttcccttataaggacaattgtagtacagg

SEQ ID NO: 135911 - DNA, 1078 bp, Homo sapiens
gagccggaggggctgcactgcaccgagcttgcacagggcgaggcgggggcaggacctgggacccagccaccccggaggaaaccggagaggaagccagcttggtcttgctctctgcctcgtcccaatccccggctcttaccaaatgcagatccgttggctgaatgccttttagtctgcatacatgcatctcataccgcacagcccaaatttctacaacttgtccaggtgcagtctcctcagaactacaaagcaagaaaagatcacctttgggctcaggaactcacagtcgttctccctctcccggaaggcacaatgaccaggacagtaccgagctttgcagccatattgaactcaccatcaactcagcacattcaactcaatcagtcaaaatcgtcttttcctgctggtaaataacactgaaattgtgggaagatgggatggtaagaacaaagtctgtctctggaagcacgggcgctgtctctgaagacaaattgatcgtaacacaagcagacccggtggaacgacctccatgctgaaccctcagctccccctgcatttggaccatggcctgatggaagataaagagactgatctcagagtggtacagatctacaaccacgtgaagaattggatttatattcatctgactccagaaagttcctgagattcctctgcttcatcatctttcccatgccctttaaaacacgttatcaaatagcaacaggtggtgcaataactagacaaatgattctcagcctttttctttgccattagcactcccggaaggagacgtgttggacacttttccttgtcaccaccccatgaaccttccataccacaggtatactgtgtattcggttatgtatcatctgtacatctgtttctaaaacacagaaacagtaagagccccccatccaagaatccattttaatcctcttgggtgtgatgtcaccccccaaaaatgcatatgctctggagtcagtcacaaacacattacgaatgcatgatcacttaagaatgttaccaaagtttataaatttgagatgataattctatgttatttagttcattttagaga

SEQ ID NO: 135912 - DNA, 241 bp, Homo sapiens
ttgttgtgtccagggttttctgtgctaccttttacattttatctgttttccccagatacctaatgtataggaacaaccagcaaaaactattcttgaactattgtgaactcctaaagtgttggttaaatccaaacagcgtgagtagcctacgactgccaattcactaccgagtgactatcgacctgtagatttataatacagctgagatggaaggctggctgagttccttcatttcttattg

SEQ ID NO: 135913 - DNA, 398 bp, Homo sapiens
ccaacattgcccactctggaatccagtatccattactttttcctagtccaactaagcagccttcatgcccagtctaattgggtggggggactgccacaccttcagcttcattgtatcttccctcttgggaagcttctgcttttcaacccaaaataagggttctcttgtacccaggtagccctcttttaagctgattttggctagcatgccaaggagcttatcattcaccctagtgtgcccagatttttttctagcctgaaataagtgagctgtcatccaggtctggcacttttgtgcttccgttagtactgcagggagtcatcctcaaagagcattatcaccactgacctgtcaccagaaaggcacagtgatgatgataaatttggactgattcatcc

SEQ ID NO: 135914 - DNA, 367 bp, Homo sapiens
ctaaagtgctgggattataggcatgagccaccgtgccccacctagtatatggaatttaatttagaaaaatagagttgctaacagtggtttttagtaaatccttgggattagtgacatgagagactagaatcttccttgactgtgtctctgtggaagcttccagcagtgctgcccctgaagcaggagagcgagcctctgtcctaagattgctacaggattccgattccctgttcttcccatggctaccccagaatcctttcaagaggcccccagacccagaagatgctccctccattgcttgcctcaagtagctcgccgtggtagaaccaatgtctgcagaaaggtcattgcaagcccggcttggctt

SEQ ID NO: 135915 - DNA, 769 bp, Homo sapiens
ggctcagcccttatatcaacttgctcagttctcacaaatctgcgaggtagggaagctgttataaccccctgctccagaggaggagagcggggcccacaggggctgtgtcatttgcctagagtcacgcaggagtgagtagcagaggcagccgcaaacccagctccgagtcttcctctgttccctgcactagactcactcctctcacgtcagaagtggagaaaggggccagaggaaagctgacgccattggcaaaatcacgtccagcctgaaggggcccgtcggctctaactaatgcctcccattcacattgcccatcttcccatctttcaagaaaatccagaaatccagattgctaggtaaaacctggttttaaatggatccaattttgttttaaccctgcgactgagcccaaacaaagcacatcagcagactgcacttagcctggggccggcacgtgccaccctgctgttgcagctgtctctaaggactgcgctgtcctctgcctgtctaaagaccctggggaactctgggtctggtggccaaaggggagtcacctcagtgaacaacagctccttcagcccattgatatgaataattaatttctgcgtgctcactgccagcccacaaaggttaccaacaagctcggcattcaggaagccactctgtgccctctgagacaatgaggacaggcgtggggggatcctaggggtgttcagggagccccataatgaagcccagcatggtgagctgtgctcagtcgaacggactg

SEQ ID NO: 135916 - DNA, 302 bp, Homo sapiens
aaaatattaggtaattggcacaagaatagtgaaaacgttagaattttataaactatcacaattagcttttattatagataaaatggacaagttagaatcacaaaattgggtagatatactagacatgcaatctcaattcatgcttttaccaaaataaattcagatttattaaggggttaagtatacttttaatcaataacaaataaaatcttaaataaaaataaaacagcatgtttgcctgtcaaattagcaaataaaaacaatagagtacactggtggtagttaggataaatgaaataggt

SEQ ID NO: 135917 - DNA, 444 bp, Homo sapiens
tccccaggatacaaccattatttgcccttcctctgtgcttccactgtatggtgtgtagtcccctacccttacagagtaactatttacacatctggccttacctctagaccaccctttcccctgataacttgttacatgtttatcttgactactttttaaaatagtagtaataaaaattgtagaaagtaaaaaatttcctcttcaaagttccccttcttgttaaagaataaatcataagtgttagaaataatagtttctttttattaaagactaactttcttcaagcctccttgctttgtgctagtaactctttgttaagccctatcctacgtaactgttggacatgctcacaggcacgttccagctcacagcctatgccccttccttatttggaaatgctattgcttccttaaacctttcgtaagcaacttctttgttcttcct

SEQ ID NO: 135918 - DNA, 847 bp, Homo sapiens
cttgggtgatagagtgagaccctgtatcaaaacaaacaaacaaacaaacagaaaactatccctctgaaatattaataagaaaaaacatataggaataaactcattgtagaaagaataacaaactgaaaatatcgcagaagaaatcactgaagtatatgtagcatgaggatagtttttcagttaaacttttaagaaacagtttgatgtcttgtgagatatttaaatgtttagccaacattggtgtatgtacccctctgaacatgtgcgtgtatgcacagttttcatagttgaattcaacaactgtgtattgggagagacattgtaccaatcaccacattggatggatcttagggataaagaaatgaaagtgatgtgctccttgttctcaaacagcttatcattgtgttacagaaggaaataaacacaacggacagtaatacagcacaagaagtactaagctcagggtggtgccatctgatattttgttccacttcacctttctactgataactgtatttttcctgtggcgaattcacacctgcctccccagctacattccctctctgttttggggtgtgcatggctgaactccaccctccctagaatccagtggtggagcaagtgagttaggctgagacagacagaaagattgagtgacggccgggcgtggtggcttatgcctgtaatcccagcactttgggaggccaaggcaggtggatcacgaggtcaggagatcgagaccatcttggccaacatggtgaaatcctgtctctagtaaaataaaataaaaaaaatagctggccatggtggtgcgtgtctatagtcccagctacttgggaggctgagg

SEQ ID NO: 135919 - DNA, 784 bp, Homo sapiens
catattgcccagttctttcttaccatacatgtgctaacaaaaaagggaaggtgggagcttccaaggtgtacatgcctggccctaagtagaccctttctattggcgcagcctccggtattcccccatgcaagcttccagcttccttatctatgtttgcagcttgatcttcaggctgctcttggttagaaaagaaatgatttcttgggctgctttttgttagaagggaagttctgctgaggactctcttgcccctaggatctgcctaagtaatttctatcttccgtctgtatcattactttatgggaaaatccaacattaacagatatgctctagtctataagatggggtgaaaacctgacctcatgatgagatcatttggcattgggaaagatgagaaaagaaaatgggaagggaaaatgggaggcttgcggggaggaaactgtggaaactgtagaaactggtggcacaaaagataaaaggggagttactgaaataatactgctttaagatttattcattatggccaggcatggtggctcatgcctataatcccagcactttgggaggccaaggcgggcggatcacgaggtcaggagttcgagaccagtctggccaacatggtgaaacaccatctctactgaaaatacaaaaattagctgggtgtggtggtggatgcctataatcctagctacttgggaggctgaggaaggagaatcgcttgaacccaggaagtggaggttgcagtgagccacgatcacactactgtactccagccggggcaaca

SEQ ID NO: 135920 - DNA, 758 bp, Homo sapiens
caaaaccccgtctctactaaaaatacaaaaattagctgggcatggtgatgggcgcctatagtcccagctacgcaggaggctgaggcaggagaatcgcttgaacccgggaggcagaggttgcagtgagccaagatcatgccactgcactgcagcctgggtgacagagcaagactccatctaaaacaaacaaacaaacaaacaaaccaaataaaaagacagagaatggggaattgaggacatctagtcagttggatagatctggattctattcttagcaattctgtgatcttgggcaatttacattgtcttttaagttatcagctgttcttaggttataaaaagatccattttgtaaattgtgtcaagcagatgtcgaccatttataataaacttatcaagatatgaagttaatttctttgctgtcattcgaaagacaaactgatagggtcagcaaactaccttaaacatgttctcattaaaacaaaaattaaaaacacagctcctatagccagacgtggtggcagatgcctgtggtcccagctaattgggagactgaggtaggaggatcctttgagcccaggagtttgcagccatcttgggcaacatagtgagacccttatctgaaaaacaaacaaacaaacaaaccaaaaccctagcaaagcacattttctatagaagctactcagtggacataattaaaacaaatggtagtatcttgaaaaaattaagacatttagtgtgaaccacatgtctagaaa

SEQ ID NO: 135921 - DNA, 818 bp, Homo sapiens
actgaaaatataaaacattgctgaaagaaataaaaaagatgaaaatgaataggaagacatcctgtgttcatagattgaaagataacattgttaaaatgtccatactacacaaagagatctacagagtaaatgaaatccctatcaaaatgccaaggcatttttttttgcagaaatataaaaaagcctacaatttacatggagtcagaagggactccaaatagccaaaagattcttgaaaaagaacaaatttggagatcacatgcttcctgatttccaagcttattacaaaactacagtaatcaaaacagtgtggtacaggcataaagacaggcatgtagaccagtgggatggaatactagaaacacacgagaaataaatcctcatgtatatattcaaatgatcttttacaaggatggcagcactactcaatgggaaaaggatagtctcttcaacaaatggtattggggaaactagatatccacatgcaaaagaataaagttgagcttttaccttatgccatgtacaaaagttaattcaaaataggttcaaaacctaaacaatatctacagctataaaagtcctagaggaaaacatagagcaaaagcttcataatattggtcttgacaatgatttcttagacatgataccaaagcccagtcaaaaaaaccacaaattgacaggtgagactacatcaaacttaaaaaacttctgcacactaaaggaaacaattaacagagtgaaaaggcaacctacaggatgggaaaaaaatttgaaaatcatgtatctgaaacagggttaatatctagactataaagaaa

SEQ ID NO: 135922 - DNA, 520 bp, Homo sapiens
gagacagggtttcattatgttggctaggctggtctcgaactcctgacctcaggtaatccattactttcaacgaatattttgtgtttctgaaagtccagagagtcacgtaatgtatttattgagcactttctatgttcagggacctactaggtactagggataggtagtggataaggcagacagcacctctgccccactagagcttatattcagctgtagcctcttagtacaatgttaagatgagttggtttgcttcaattcctacagaggccataaaccaggatcctaagaagaggtaaatttgggtaagtgaaagaggggaggctaaagcttagagcatacagctgctgaaagatttaagaactaagcgtgacactgagacaagtaggatggtgcacgaggagaaatacagtttgaggagttgaatacacatgaaaactgaattgaacctaaaataataatagccaacccctggaaagcactggttatgtggcaggtactgttctcatgaatttatatg

SEQ ID NO: 135923 - DNA, 489 bp, Homo sapiens
agaggagggagcatgcctaggtagccccctagacctggtgaggctggtgcgtggggcagcctccatggagaggagttgggcaaggagggaggaggtgctggccagtagagcacgtgtgtctctgtgcgtcagagcaaggacccgggctctccccgtaagtgagaagagtccatggaggttttggggctgaggaggagttttacagatgaccggtctgttcttggcacttgcaattagcggaccgtctgtatccgagtgttgatcgggtggattctaaccctgtgggagaactccccagcccgtagcctgcgctcactgtacctggcagttgtattaatgacgtcaaatgcacagtccagcttgagtcccctctagaacgtgggcagcggacactaagccgagaggaatcgctgtgggttggcagacactgtggagactgactcctggacaggctgtggaatgtgtggaagcaggtacagcccaggcccg

SEQ ID NO: 135924 - DNA, 258 bp, Homo sapiens
aaaaaatgaagctgacatttgctcctgctgtatttgtggtcactagctttgtcagtatcaaagctcacagcatataacatccattttactggcacaggataattctggagcagcagtggcttcctgatcatcactgattcctgatcttggtgcttcttgatcatggctctgtggtggtgggattctgggagctgacatctgcaaggcaacttcccagttaggcagcagctcctttggtggatcagtccaatagtgtaa

SEQ ID NO: 135925 - DNA, 158 bp, Homo sapiens
atttcacagcagcattattcataacagccaaaagtggaaacatccaaatgtttatcaattgatagggtaggtaaacaaaatgtgggctagccatacaatggaatagtacacagcagtacaaagacgggaagggctgacacatggcacaacatggatga

SEQ ID NO: 135926 - DNA, 247 bp, Homo sapiens
ttgtggggagctgacttccagaattatttctagtggggagttggttatggcttaaaagtttagttatcagttagatgtctcacacccaggatatatttgtcccactgaaacactgttctgtggaatcttggttataaatcaacatatagtagtgggatagagagaccttaactactgtgtgtaatggttggtctttctgtagcaaatattgttcagcagtctgccttggggcaggagtggcatactt

SEQ ID NO: 135927 - DNA, 430 bp, Homo sapiens
tttcaagaggaacatgataagatctgctggcaaggatctttattggcatcctgggaacttctggggtgaatgtgtgtgctgagctcaaatcagaatatctgcaggaaaaaaaaaaaaaaaaaagaagaagaaaaagaagaagaagccagaccaggaaagtgaaaggaaatggatatcgctgctggaggcaacgactaatttaagcagagtaggagaaaaactctttttttttttcctttgtgccagttccttttacacgacttcagaacattctatgacaacccagcgtgcaacttggcactgtcagaagagtcctgggaaagaaaggaaatgcggtaagaaatggaaacagagtattgttgttgagagcctggagaccatttgcagagtattttgctcaggggggagtaagaaaataggaaaaacctta

SEQ ID NO: 135928 - DNA, 122 bp, Homo sapiens
gaatgttaccagtaaccactgaatgatttaggtagtggatcatttaccattctagccgccagatgacactgctgacacctggctgacagcatgactataaccttgtgagcgaccatgaaata

SEQ ID NO: 135929 - DNA, 275 bp, Homo sapiens
gctggtggcatgtgcatctgcccccacagaagctcagggggtcttctcagttctgggctcctgagggttgcagaactaatgggaagtctcatgggtccccgggcagcacacagacaatgcctggcctgtagagccctccttgttgtgtgtcagctgggacatttccagaagcactgatggctttttcacagttgatgctgatggactaaaatggtccttgcaaggagttcttttggcttttcctggagaactgcatttaatctgggctaaaatat

SEQ ID NO: 135930 - DNA, 169 bp, Homo sapiens
gactacttttggaggaaaagccttgagctttcttcttcttggaagctttcagcatttgatgacgggtagatctagagccagaattctcctggctctgctgctaacaagctgacttggggcaagttacattaattctgagcattcatttctttttttttttttttttttt

SEQ ID NO: 135931 - DNA, 239 bp, Homo sapiens
ataacagtaacaaccacataaactgtcatgttagctatgaaaagagttggtggaaggaatgggctctcaccaagacagtgaaaaatagaggtaggtggtaaacaaatatgcaaaaggaccattcagaaacccaagcaaactatcattctccccattttactggtgctataaatacctgaaaaaaagtgccacagaaatggattagtgttatcatcaacaaatatatttgagccgggcac

SEQ ID NO: 135932 - DNA, 440 bp, Homo sapiens
ttattagcagcattatggtataacagttaagagcttaagctctggagtcagactgtctggattcaaatcctggttttatcttttactagatgcatgattttgggtagatatttggcctctctgtgtcgcagttccctcttctgtaaaatagtgacactacatattctcttagggttctttgaggattacaggagaagatacacatagagcattcgtacacagtacttggcacatagtagatgctcaataaaattagtttattttttgaggcagggtcttgctgtgttccccacactggagtgcagtggcatgatcacggctcactgcatcactgcagccttgacttcctgggctcaagcaatcctcccacctcagcctcttgagaagccgggactacaggtccacaacacccgctcagctaggtcgttgttacacattct

SEQ ID NO: 135933 - DNA, 354 bp, Homo sapiens
aaaatccgtggagctggaaagcaggtaaacaagtgataacattctagcatatcagagagggttgacccataaggcagcaataggaatgaaaagtcatgaagcaactagatacctctgggtgtgagagtaaaaaagggttaaaagcaggaagatatttgaaaatctgttaagaagcagatggactttccagaacctccctacaaccctgtacagctaggtgactgctcctttccaatcccagcaaaagatgagagctttctcctctgaagaggtggagagggtaaacaaagggtctttggttaggggtcaaccttgtttaattgaacgtgagggtatcatacgaaacactgaatt

SEQ ID NO: 135934 - DNA, 242 bp, Homo sapiens
gcaaagtgcagggctcattatgtgtagatcaaatgacatttatctatggttaaaaatattgtgttgaatatattattctacaacttgtttatttccctcgctcctatgtcatgtagatttttgcagtgctaccctctcattaactgcttagtgttttttggatagacatatcatggcttattcaaccatgtcgatgggcatttaggtgttagctcattttcacactgctataagcaattagt

SEQ ID NO: 135935 - DNA, 585 bp, Homo sapiens
ggttctttggtaataaagaacagaggtttacatgtctgtggctgaaataagatgataaagactcatatgaaatgattaaaggggtgggctgtcagaggaattcaaacatgaactgtaactgggttgcacttcacaggcaccagatacggaggacagtttggattccagatggctccatagactgcactggcagagtgtctgtgatttccatttagtacggtatccccagcatctagaataatgcttaacatataatagaccccagtaattacctgttgagaaaataaataaaaggaagtagtaaatcttcactctagagctttatcaaaatggagaagtgagtggcttcaagtacgtgattgataagagctgctgttagccggctatgctcttggtccttcacatatattattatttgagtatgttcagtcctgtgaaggggtgatggtaccctcattttactggtgatagaatttaaattcaccagattatgacttgcccaagttcgtgcagaatactaatttggagagttcaggtctacttgactctaaaccttgttctggtaactgatgccctatatattga

SEQ ID NO: 135936 - DNA, 434 bp, Homo sapiens
gaatttatatggctttcaatctactgagggagaaggttaatatttttaatccccattttaaaagcctgacaatagaagattaacaaagaccttattggcaatcttataatgctaaggttctaactcttgggcttcttcacagatcacgagcagaccacactaccttaggaaatctttaaaactgctttataagagagtagccttggaaggaaaaaaaaggaagataagaatggaaacttctaaccagacatagactgtaaattgtccagtgggtactgttacctgggaactaaaactaccaacacaaacatttgagtgtttcttctgatataaatctaaagcttagcttttatttctctgttgtagtctagatacggtccttttagtgtacattagagttgaaaattattttgtggtatataaaataaaatagt

SEQ ID NO: 135937 - DNA, 262 bp, Homo sapiens
gtgccccccatattaggtgaggttctgggaactgggaagccgaaggtgagtagcactggaccttgaccttgaagagactgtggtgaatggaaggaggatgagtatatgggggaagatctggcattgttgcaagcctggaatctggggtccccagcaggagactagcaacataccagatcggaggtgataggttagggtggagcctgtggaaatgaagaagaagagataatttggagtgctactctggcttgaggacaggacg

SEQ ID NO: 135938 - DNA, 283 bp, Homo sapiens
gtcatgctagcaagtggcagagctggacctgaaaccacgtagttcagcgacaaaacctgtgctacatttttgttgcatactcacttacctgcagaggccaggcaggtcatgtgaatggatgaagtgggccaaaaaaaaaaaaaaaagggagctagatttcatgttgttccaaagaaggtagccaagcagaccagtgttgctagctagctcttctgactgttcctgggaagccagaaatcctggctttcatgtgaaatctctcaatttattcagattagctcag

SEQ ID NO: 135939 - DNA, 372 bp, Homo sapiens
gcaggggaaaaaaggaagagtctgatactgtgctgctgagcaatgcgagacttttcatgatttgcctcaacaattacagagaacacccctttgacattcaagggtacagactgcacccccactttgtggcgttctgatgtcttggcatataaatattcccgtatgctgtattatttttcagtgttgaaatattggtatttttgttgacacgatgctgtcattgtggtctgttgaaaatctgggctgggcacagtggctcatgcttgtaatcctggcactttgggaggccaaggtgggaggatcacttaaagccaggagttccagaccagcctggacaatatagcaagacccccatctccacaaaaaaagaaa

SEQ ID NO: 135940 - DNA, 158 bp, Homo sapiens
aaacaaaatgaaagataccacctaaaagtgagaggacgtattgtagtagaggaagggctggctgggcacctatcatctatgccccccagcctggaggggtgtttaaggtttgaaacgtgccacactcatggaatactgcacttgcagccggttcaccg

SEQ ID NO: 135941 - DNA, 423 bp, Homo sapiens
tcagaagttcgaggttacaatgagctaattgtgccactgcaccccagcctcggtgacagagcaagacaatgtcctaaaaagaaaaaaaaaaaaagatgtgcaaaacatacacagaggagggaaagagtagagaagtagactgatttgtgggcagaaggcagaatatcctggatagaagaaaagcagatagttgaaaaattaactttgtgggggctagcatagtgtatgaaaatttggatttgggcctctgggcataaagagccaagaaccaataagaattttgacctgcgtggaacaataggatgaaaatttcatgaccaaagaattctggccataataaattcaggtgtgaagaaattagaagaattttcttcagatattcaagccaacatgtacatgccagaaatacaacagaatggatag

SEQ ID NO: 135942 - DNA, 390 bp, Homo sapiens
cagactttcatcctttctaaacattagctgactcctggccagtggctctggttctgtagtgcaggaaatgggctcactgataagacacatctttgggaggcagcaatgatcaggagcagatttatcagttgcagtatcctaggtcatggagatccctaacccgccagggctctcaacatcgcgtggctgcttatttggtatgcttaaaaccaaaaatcttggacttactgaattttgtggttcttctccctccaactcaaccaccccttattagaagctgaaagctgaacaccaacaacattctgtcaagaagaccaaagacagagtgtgtggaggcatcagggagccctgtccaactggcatgagaacagaccattcaatggagtaggt

SEQ ID NO: 135943 - DNA, 361 bp, Homo sapiens
atagccaagacacttagatctaaaagactcatagtcaattcaagcattctaggccaggcaggaatggaggtgggcaggcgttcatcaaacctttaaaatcttctaagtaatataagagtcaaaaagccgaaaggcaagtttacagaactgatttatctataaattttatgcattgagctactgcagtcttggttttagttacagacttgtagcaattagctatacagaacataagcattttgttaaaaccatttaaactagagagtttagagactttgttgtattgcaacactttttgcagtctttttagtaatttgttctaagatggctaataaaaaaataataagatctccccaggcac

SEQ ID NO: 135944 - DNA, 379 bp, Homo sapiens
atggactttccaatctccagaattgtgagagataaatgcatgtcttttatgagctacccagtctacgctattttgttaatagcatctcaaacagcccaaggcaggtaggcagggaatataatgggaagatgaattttatagagggaacaagaggagaaatgggcgtatttgtgaaggagagagggaaaaagtaggagggaatatatagcagatgtgtttgtgagatcataactcttccttgtcagttacgatgtcctgaccttgggcttgactttagcaccgggagcaggtcagcatccctagacttcagtcaacagggagatgagacaaaattgcaacttggctttctagggtacacgtgccgactcaatataccaat

SEQ ID NO: 135945 - DNA, 531 bp, Homo sapiens
tagagttgttaactttaacttgagtagctcctgtgggtcagttgatttattgagtacttgcaatgctaagtttaataacacatgttactgcattcagtaagttcacagcagcctgaaacagggctagatttctctgataagttttccccagaactgtccaataaatgaacatttatgaactgtctgttatattccagacattgctagatgcttgtttaaaagatgaataagatatgcctagcctttggaagcttccaaactggtggtaaggagagtggggagaggtaaattcataaaatatgcataatctgtagtgggaacccaggtctgccctgaggggccaggagtgtgtgtgggcagaaagtgagccagtagtctagctagggggagcacctgtctcttttgtgcttcactgccagcatctgacatcaatgacatgccagaatcacacagtaataatactggagtgattccttgttactctctgacacaaacatttttctcgatttttatttataattttatatataa

SEQ ID NO: 135946 - DNA, 745 bp, Homo sapiens
cccttgaccattttgtttgtttttcgtcttaacctgttttgaaaaaaactttagaccactatcacacacgatgggttctttatgattaaattaggttaaaatttttcacaaaaatacagcataaatgattttgtgaatttcttattgtatcttatcaggatagaagcaataatttcttaaaatattatttaatatccagtacatattcaaatattcctaatggtctcagatgtgtttttttacatcggcttgctcaaaccaaatattgtacaccatttaaaaaaaatcgacatagaaaaatcaattacagtctttttgagggggagggggaactcctaaaccagaataagttcagagaggccccctgaccacagtcttaatttctattccttgtaaatgcctcagagtaattcttaggcttctgctatatggaaactacatccctttgtcttttatacaaattacttgaaaaaaatggaggtaatttctcttgattactttaagaaatgaagtagaatttttgtagaacagtatacaaaccataaataaacggcttgatgaatttgcacaaattgaacacacccacgtaagcaggtctctgacccaagaaacaggatttttcccagctccaaaaagcgccccttccagattccccaagggtacctactctaacatccagcgtcatgggttcatttgccttatgcaaatttcttctctttccctgaaaaaggaagcacgaagtaga

SEQ ID NO: 135947 - DNA, 221 bp, Homo sapiens
ctttcagtaacttgttggcagtccatcccagaaatataccccatttatgtgacttggaagtgtcattaggaagaccgccatagcctctgctccttctgcctatacattgttgtaggtgaagacattttttgaagccttgcatgggcagctaggcttaagtcagcagggaaacgtctgcttcttaaccagtggttttaaccaaacatttttttcagtgaagt

SEQ ID NO: 135948 - DNA, 421 bp, Homo sapiens
tcttccactggctaaatttgaaataatttgagcagtctgtgtggattatgacacactgaaaaaatccacgcacccactatctatttagttttgaagaagaatgtccttattttttggagctgcatgttgaagtattgcaggatgatgtgtcaggatttctgcaacttactttaaaatggtttaccaaaaacactgttcacaaatgtagatgtaaagagtggggaaagcaaaggaggagacattaaccattcacgatctaggtaaagggcatgggggtgtgcactgtactattcttttgtctgcagcttaggaaaaaaaaaaagaggcaggaggggagacaaggtcagcaaataaatacaacatcaaaagttagggctgacagctgaggcagacagctccaaaggaaacattttcttttttc

SEQ ID NO: 135949 - DNA, 268 bp, Homo sapiens
ggtaacaggggtaggaagaactgctctacttaagggacaggtctgtcagacaagcatatatactacatgcatttgtttacatagtctcattttttctacacaaatgatggcatacaatacacactattctgtatcttttgttaattattatatgcattcaataaaatgcacaaatcttatgtgtagaaattgatcatcttgatttttcaaatttaacaatataccttgatatcattcttcaccaagacttaaagaactatttctcttt

SEQ ID NO: 135950 - DNA, 556 bp, Homo sapiens
gcagactcaaaaccaaagtaaagtgacatccagcccctccatatgtgagctttaacttagaattctgcaggaaggaacagattttgtcagtgccatgatttattcatttatttttgattgacaaaaattatatgtcatcccattaataatttatattaataccattaataatttaaaattaatatctttaaaatttcatagctattttaatggtgggcttagttagaagactcttccttgtgctgaagaaaagcagtaaggagcaacatcaccctgtttgtctttagcttttattacccgtgtctttttaatctctccttatgtaggacctcatcttttggttgaggtgattgttggtatttttttctcattcagaatttttacaagacttggccaggcatggttgcttatgtctgtaatcccagcactttgggaggccaaggcaggaggatcacttgagctcaggagttcaagaccacattgggcaacatagtgagatctcatctctactaaaaattttaaaaattaggcatggtgatgcacacctgtagtccca

SEQ ID NO: 135951 - DNA, 1596 bp, Homo sapiens
agcagaaaagtgaactcaagaactgaaaaggaaattcagaaactgaatttcctgaaaaggaattcaggaaccgaaagagaggccaatggaaaatatccaaatgacaaaaaaaaaacaacaaaaaaaacacaaaaacacatgtgtgcggcgcgcgcgacagcgcggcaccccagcaaacaaaattcacaagaaacaaacgcggagagggagcgccggaggcgcaccacgcggcggacgacggcaacaggcgcgccacacggcggcacagagagaagaagaacataggcgacacagtacaaataaggaagagggagacaataacaacaccaaaacaaactacaaagaccaccggcggaaacagaagagaaagctcaacgaaacaacaaacaaaaagaaatagacaatacagacgagagcaatacacaaacgacacccaccaacaacacaggaacagcacaaaaagagaaagcgaccacaaaaaaaaaaaaaaacagccccccacgaaagagtggaaacagaaactaacagaacagacaaacaaccaaacaaaaaaagcagcagacacaaaaaacaaaaacaaccaaaaaaaaaaaaaaagaaacagaaccaaaaaaagcagaaccacaacgcacagaaaagcaaaaaaaagaaaaaacaaaacaaaaacagcaccacacaaagaaacataaagaaaacaaacaccacgagaagcgaacagaaaagacgaaagaaaaaaggaaaggaaaagagacggagaagagagaagcgacaagacaagagcaggtgagatagagaaagagaggaaggaaggacgaagaagaagaaggacgaaagagaaagggaggaggaagagagggcggagaagcggcacagatagtatgaagagagaaaaggaaaagaagaaggagacgactaaataaagcaacggagagagaaacgagaaacacaaaagtaaagaaaagaagacgacaagagacggaaaacagcggaaggcgaagaacacgaggcgacactgggagcagtagaagcaaaagaggcaacgacgaagggaggtagaacgagaaagaaaacgagagagaagggggaggagagggggaagaggaaagcacggaggaggagagagacggaagaagaaggcgggaggaagagagagaaggggggaagaagaggaggcgataggggagggagaggaaaagaggagggggagaagaacgcgaggagcagagggccgccgcgcagaaaaggagaaggacgagaggagagggggaagagagggggagagagggggggtacaaagggggggggaggagaagggaggggaaagggagaggacgagcgaaaaggaaacgacggaggaggcagaaagcagaagaagagggaggggagagagagaaaaaacagaatggacaagacgaacaaggcggcgggcagagccgcacagaacgacaggaaacgacgaggggagaagggacaagatcgggagcaagagaaaaagaaagaaaggaaagcgacagagagaagagacaaaacgaagcgaggaaagggaacacggaggcacggagagaagacgcgagacgacggaaggcagaagaggac

SEQ ID NO: 135952 - DNA, 934 bp, Homo sapiens
gtcaggagatcgagaccatcccggctaacgcagtgaaaccccgtctttattaaaaatcaataattaccgggctttgtgagcgggcgcctgtagttccacctactcggaggctgaggcaggagaatggcgtgaacctgggaggacggagcttgcagtgagccgagatctcgccgctgcactccagcctgggcgacagagcgagactccatctcaaccacaccatttaggacgttgggctacagtaagacttggtaagagggaccaaggaagcatggaagaaggagctggatggttcccagagcaaccagagaaggcttcacagagatgaaattggagctggattctgatgggtaagtaggagtttgcctggtagaaaaaaaaatagagaagggcaggaaaagaaacagcccttttcaaaaaagaggagaccaaacattgcatgcacatatcctttgactcggcaattgcactggcaggaattctgctgttatcctcacacacatacggctccaggcatatgtctaaggatcctcatagcagcaatgtctgcaagacttagtcactgggagtggcctgtggtccctcactaggacactgctgaaataaactatggtacagccataccgtgaattcccacacaaccattaaaaagaatgaaggagggccaggtgcggtggctcatgcctgtaatcccagcactctgggaggccgagcgggtgaatcacctgaggtcaggcgtttgagacgagcctggccaacatgatgaaaccccgtttttactaaaaatacaaaaaattagccgggtatggtggcaggcgcctgtagtcccagctactggggaggctgaggcaggagaatcacttgaaccctggagacggaggttgccgtgagcagagagagcgccattgacctccagcctgggtgacaagagtga

SEQ ID NO: 135953 - DNA, 893 bp, Homo sapiens
ggctactgtcccatgttaggcacccaatgactctggaggctggtgtcaaaacattcatatatatatgtgtgtgtgtgtattttaaattaaaattgtattattgtttgaaagtgctttcaatatgaacgtatcctagtatgatttgtaaaataaaaaacagggtgtgcttctccccagcagtttctagagatctagactagagatctgagactgtcttacagttggccattgccttaccacattgcctcacactggagagaaagagaatgatacgtgtatatttataatggcattcgcttcctgccttgttatggtattaaaatacttaggatttgttaccagtacacaaataactgactaatgatactcttgtgaatacagcagaagtatgtctcatttacatacatgcaaggatatatacttcttaatccccaagagcatgaaatttgaaaatgtaaatttggaatgagtgtgttaattttcaaaaatcagagttagttatactattctttcaattttttataaatttgagctttcaggataaaaagtttttaaaataaatatgttatacttaaagctgaattgttaacgccgtctgggcaagataaaagcagcaaagagctggtaaattattttgaagatttaaaaactcaccaaattaaaactgctgtgtaacccattgttttagaagaaagacctgtattccttcatcttatggcctttgttacatttgttaactccggccgcgtggacggtccgcgggtcatttccagaaaagggttttcctgacacaccaaggggaacgggggggagcacctggggttgccctggggggcctaccttgtgggggggccgggagcatacccccgaaggggggggagaaaacctactag

SEQ ID NO: 135954 - DNA, 306 bp, Homo sapiens
cctgacgcccaccagagctgggctataacaaggcatatggctgggcaagagggtgagaggccaaggccagaggacagtttgagcccaggactttgagacctgcctgggcaacatagggagaccccgtctctacagaaaatttctaaaattaaaaactttagcctgacgtggtggtgcacgcccagggtcccagctactcgggaggctgaggcgggaggatggcttgagcccgggaggccaaggctgcagtgagccgagattgcaccactgcactccagcctgggccacagagcgagactctgtctc

SEQ ID NO: 135955 - DNA, 104 bp, Homo sapiens
agcttcctaaagtaccaggattataggcgtgagccaccgtgcctggctgtcaaagtgatttaggaagaaaatgtggttagtgtacattaggaaacttctgcttg

SEQ ID NO: 135956 - DNA, 573 bp, Homo sapiens
agaaattctgactactcctcctgatgctcatactcttttccagcctggacaaccccacctttctaggatcacgtcctattacctcccatatgagaaatttatgccctgcccagactggtctactgtttctagaacattccatgtgccatttacaatatctgtgcctttgcttacagcatctctgttgctttgatttaaccaccaccaccaccctgcccccatcacgtacacaaaatctaagtcctaacaactctccaacgtccatctcaaaccacatcctgggctctttctctagagtcttggagactccaacctattgagaatcctctctcctttgaacattccgaaccatttagagcttctcatctggtgctttgttgctgctgatgttgctcttgccataaatagctaacgttcctggagagttcactgggcaccgtaactgagctctttgcacacattatcttattggcaccccacggcagctccacagtgtggggaccattatatcgtggtgtagtcgattaagatgctgaggctgagggaggcaaatcccttgcccaagatctcacc

SEQ ID NO: 135957 - DNA, 590 bp, Homo sapiens
caggccggccaggcctgtgatccacctgcccagccacagtccatctgggctccaggacaagcatggtccattgagcaactgagctggtactgggggccagagcctggtgtgggaatgaacaaaactctgatgattccgcagaatgaggaggggacaccatggctcatgcctgtaatcccagagctttggaggcccagtggggaagaatcacttgagccttggactttgagaccaacctgggcaatacagcaagaccccatctctagaaaaaaaatatttaaaactgagctgggcagccaggtgtggtggctcacacctgtaatcgcagcattttgggaggccaaggtggggcggatcacctgaggtcgggagttcaagaccagcctgaccaacatggagaaaccccttctctatgaaaaatacaaaattagcagggtgtgatagcgcatgcctctaatcccagctccttgggagactaaggcaggagagtcgcttgaacccaggaggcggaggttgcagtgagctgtatcatgccattgcactccagcctgggcaacacgagcaaaactccgtctcaaaaaaataaaaaa

SEQ ID NO: 135958 - DNA, 799 bp, Homo sapiens
cgcaatttatttaaatatatatgtatgtatgtatgtatgtatgtatatagctacatatatttgtttatatatgtgtgtgtgtatacgtttatggaatgttgctctcctcagaatttaatctccatgaagacaaagtccatgtctgattttctttcactgaagtattattcctagtgcctaacacagtacccagcatatagtcagcatcaataaaacttgttggaagaatgaaagaatgaatgaacgaatgctttgtggaatccctgcatgacagaagtccttctgttcacaatagacaactgcagtccagagcccattctcttaaaagtctttcttttaacctcaaagccacatgagtcaattcctcaaagagaatgcacttactcctccaggctgattatacagtgaccttccagcagagccatttaggaagaaaagagtcagatctctgatggagccagactagatggagagaagccaaatgagaattccctttctaatgcgttggaaagatctgaagaagaaaatgaaacaaaaatcttagacttagagcctttgaggaattcttgccatctggtggcaataatattaatctgcaggcaaccaagcacttttcctcggctttctatagtatctcaacatttctgaaattgtacaatgattttaaccttggtgtgggtctcctttgatttcatcatgccctgtattctagaaatttatggccttcagttctgggaaattttctcaaattatttcttttagtatttttcttcccaatattttttctttctcttgttga

SEQ ID NO: 135959 - DNA, 234 bp, Homo sapiens
ttccttccgcttgtgggtacatatccaaaggatttgaaagcagcatgtcaaagagatatctgcactcccataatcattgcagcattattcataatagccaagatctagaaacaagtgtccattaatggatgaagaaaatgtgacatatatacacaatgagatactatttagccttaagaaagaaggaacaacatgggtgaacctaatggacattacactaagtaaaataagcta

SEQ ID NO: 135960 - DNA, 533 bp, Homo sapiens
acagaaagcatagaactcaaggaaagctcttaataagaatgggttccggtgagggagctaatttcataaaatagtgccgagaaaaagaaacagacttttgttaaatgggggcagaagctgccagtggattttcacgtttgagatttctttcttttttaatttaaaatccaggacactcaagttacgattcccacagcaacagtaattttgtctgatgcatcaatgacatttctgttgaggaaaaatctctgtttttccggtggtgttgctgcacttgtactgtcgagaagattggtgacagtggaaatcgttgaatttttcagtcctgggagtaaaaatgtatgtggtatagttggtcttagcttttgtctcctgtgcatggactgtagcatattacccatagggttggccttgtctacctaacaacttctccagctggtttgttctagacttcatccctttatggtgccttgtcatttgctctcccacagcctgtgtcctcaaccaggaggaagacctaggcaaaacttagg

SEQ ID NO: 135961 - DNA, 741 bp, Homo sapiens
caactttatgatggaaacaccataaatgctgtgaaaccaaaaactacatttgtagaagtgtaacaagtagaatgaagctatttgaagtccttctattctcagcgctgatgagactctctgtgggtactaatatttgcttcaaggaatcaatttgtaaaagggataaaaacagatgtaaatgtgaccaaattagagaatagctaaatagctcgagcctgtggtaatgttatatgtttttaattatgcctcctttttattccttttggaaagaaatctcggtggacaattttattttatgaccttctgggaaataccataataagatggatactcatacttgctttgaaatcaaccacaagctttgaaatctctactctaccatttaatgtgaaattcaattgaggcctttaaggcacagctcccacaaatccaagactcaagctttcccaatgcagaattattgttaaataatacatgtctcaacaaatcatgatgaaatttgtaaaatccaatggtaaatagaaaatattccaaatctttaaaaagtggtgaggaaaaatgtagaatgttacttaaaagaaataagactaagtaaatgttttaatttcaacactgggagcttcagataaatagggaaaaaaatctatcaattataagatatatggattgtaggccaagaaactatactgaaagaagtatcattcactagtctttattagagaaatacatttaagatataca

SEQ ID NO: 135962 - DNA, 428 bp, Homo sapiens
ttgataagtgataagaaaaagaatttgagtggaccagtaactaaacacattttcacgatatttcagaatagcaaggaaaaggagaggatgttaaaagagtccagaaatgggagtggggtggaaagttgaccacaaagataatttctaggccgggcatggtgactcatgcctataatcccagcacttcgtgaggccgaggtgggtggatcatgaagtcaggagttcaagaccatcctggccaacatggtgaaaccccgtctctactaaaaataccaaaattagccgggtgtggtggcgtgtgcctgtagtctcagctactcaggatgctgaggcaggagaatcgcttgaactcgggaggcggaggttgcagtgagccaagatcccgccaatgcactccagcctgggtgacagagctagacttcctctca

SEQ ID NO: 135963 - DNA, 360 bp, Homo sapiens
gtgggagtgaaagcgtcagtgcattgagccagtgtgtgtgtgagggtgagcatgagggaggcatgagtgagtgtgaggggattactgggtgtgcgaatgagacacccagtgtaagtgtaagtcagtgtaagtcagtgagggttggtgagtgtgaggaagtatgagtgggtggcagcacaagtgtgtaagtgtgcgattgagtgcgagcatttgtgtaaatgtgtatgagtgccttgtgtcagtgtgagcacgagtgatgttattgtgaatgcgtgtgagtgaatgtgagcattttgcttgtgtcagtgaatgggaggttataacagtataggtgtgagtgcaaagtgagaaagtgtgtgg

SEQ ID NO: 135964 - DNA, 275 bp, Homo sapiens
gcgttatgatgcatattgctctctgctgctctggaccaggtattcatgctccgtggacttctccatctgagcacttcaagctcaacacatctaaagctgtaacttccattttataagagctgagattttttgagagagagaaaaaagttgttgctggttccaaagatctgaagcttgtaaactcaaaagatcagaggaaagagggtctgtcctgagagaagttctgccactacacagggaggagaaagaagcctgggacataacctagaggaacg

SEQ ID NO: 135965 - DNA, 777 bp, Homo sapiens
gttgatgactgctaactgattacagtgatggttgccaaaggtcaaggtggctgtgacaatttcttaaaacacaagaatgaaatttgccccattgattgactcttcttttcacaaaagatttctctgtagtattcgatgctgttcgatagcattttacccacagtagaacgtcttccaaaattggagtcagttctgtcaaaccctgctgctgctgctttatcaactaagtttatgtaatattctaacaatttgaacaatttttcatatctgtgctttatctactatctgatttattgttatttttttgtagtctctttttcctgagctccaggttttcatagtagcccaaataagactgtctttttcttttaaggttgttttttttcctcactgtctttaacactgcaaaaatgtttgcatgtagaattcataattgcagcatatctaaagtatccattctgtgccaggcactgtcctgagcactttaaatatattaattcattttatcatcataacaactcctatggcatattcagttattatctgcctttttcaaattaggaaactgggatacagggaagttgagtaatttgcccagtatagaacctttcctgacttccttccttctttgaattaacgccccttcctctatttgcttaactctgtcgtattacttgccacgatgtgctgctattagtttatcttctttcatttgatttgagctgttggaaggaatataatatatatgtttcataaatcttttataaggaagatgtg

SEQ ID NO: 135966 - DNA, 279 bp, Homo sapiens
atttccttccggactaagaagccataaacccagatgtaatttggggcttatccattcatccaccctcacatccacccacccacctatccatccatccatccatccatccgtccatccgtccatccatccacatctatccatccacctacctacccatctgtccatccgtccatccatccatccacccacctacctatccatccatccatccatccatccatccatccatccatccaccgaggcttccatcatttaccgaatgcctactatgtgccaggc

SEQ ID NO: 135967 - DNA, 282 bp, Homo sapiens
tccctgtgtgtctatcttcatgagcgtacagaaaaaacagtaagttgaaaagtttagataatattatttaaaacctgacagaaaattggagaaacttgactaattaacattgctcatagttaaagctcttagtcttgatgaaggtgaattagtaaactaagaaagtttgtgaagaaatacattggcactccaagatggccaaacaggaagagctccggtctgcagctcccagcgagactgaagaagaagacaggcgattcctgcatttccaacagaggtacc

SEQ ID NO: 135968 - DNA, 337 bp, Homo sapiens
ggagactggctacgagaaacaccttcgtattataattattgcaatttcttgtttgtactgcagatgtcatgccctcattagacagggattttgtgtatatgcatttgttttcatgttttcataagaaaaaccttcaccattcgttggagatcagacccgtggtttagaaggtgtgatgttctctccatgctatttcagtataatcaattagtgttatgttcatctctggtttcttgacattgattaggatggatttttatgatctttaagggttttcatctctctaaaaacatatatactttatttattagaattaattgcctctctgaattgcctg

SEQ ID NO: 135969 - DNA, 457 bp, Homo sapiens
cccagctgtctaactctacaggcctgctttccaggcacgtgattttgtaagttactgcccactacccaaggattcaaacttcaagaattactaaatggatacagccaacaactttccatttaggtcaagtgaatgaatctaatgtcttctttctatcagacttcccctctctccttctcttttcaaaggtccatgtctatcctgacggagcactttcagcagcagcttgccctcacggttcaacaggtactgacaccacacacaagaaacatttcagaatgtacctactggtctcaaactaagtcctgaccccctgacctattccttatctgctttcttcctttaatgctcacagccatggtcctgatgctcattctataatcaggcccttcacctgttctttggaaaggtccaaggggctctgggtctcccttaccatgaatcatactggctgtct

SEQ ID NO: 135970 - DNA, 411 bp, Homo sapiens
attcccccttccacccgctcgtcagccacagctaaccactattagttttccagagttttcctgcctcagggcctttgtacatgctggctccctttgcatagaatactctttctcctcatccagctttctcagtggctggtttcctggaaatcacttcctccaggaagccttccctgtctttccctatgttccttacaagatccacctcttgtaagggaagagacagccactgtcttgtgaaaagtgtcccaagcccttggcacagtattacttggtagctctgcaggaaatacaaaagcagtggcagagggagaggaagagagggagttgatgtgaaagaggctaaggcagtcaaattgtcagagcttgatagtaagttggatctggggagggaagtcggacctaagataa

SEQ ID NO: 135971 - DNA, 749 bp, Homo sapiens
ggtgtcggggcttccattccagggtcaagtgagaaaccttcagccatcggggcgggtgtcggggcttccattccagggtcaagtgagaaaccttcagccacttggcagagactccaccaatcctgtgttgaagccaggccccagctgtgacagcaaggggccaaagtcttttaccaaaaggtaaaacaggctacccagatgggacgggtgtggccaagcagtgctaccaccttgggcaagacccttctcctagctgggattaggttttctcctttaaaattccacccctccagcaatcctcagtgatggcctgttgttttcctaatgccagtcccaggaagcaaagctcaacaaaatcacctgttgtcagggatagtggaagacggaaagataaagcactggcttccacaaagtcacagatggtgggtggaggttcccacagagagttcacgggaatccccaggccgtcctcagggctttagtttactccctccctataactcaagaaaatacaggggtttccaatagaaatttaaacctagtagcctagaagtattcctaagggactgcagattgagtaaaatgtaaaatataatatacccaacttttattaatgtaaaaatgtatcagttgacccagttatcccctctctttcctaaggagtgcctccccagttaggcggacacaaagggttccatattagaaacttgattcacattcccctttcctttctcagccactcacacaga

SEQ ID NO: 135972 - DNA, 334 bp, Homo sapiens
gatctagaggatcccgtcggagcaagcggggaaattaaaattagtactgacattatacaattaaggaaagatagttcaagggaaatattatgtcattaccacacaaataattaataaaatgagataccaaaacccatgatctacttattagtattttaagagaggttaatcaatttatagtcaattaagaagcattagtgacttaaatgatcaaaatcggtgttacaaaaatgtaaagtaacacctcattagacattctaggtccagttttttgtagaaatgcattttgcagaaatgttgggcattaaatatagtattaaaaaataaaaatagc

SEQ ID NO: 135973 - DNA, 655 bp, Homo sapiens
atcactcaccatagtatataccttctgtaacattcattattgagttttcataatgacttagtttttatagtgatgatccagtaacactacaccacttcatctagttgtggtctaatttattaaacaatttcttatcatttagtttattcctaaagaatagagtcattcattcagcaagcatttagaagtctacagtgttcaagctttgtgtgccagcctcataaaaatgaagaaaatatggaccttgccctcaaggaactctccaactatagtagaggtagatatatcaacaattattataatggtatctgataagggtacatgttagaaggcattttaaaggtacaaagagcgtacaccagagtgtacaccagacggagtgcccaactgtgagagctggaggttaggtcctgatttagcaatggtatagaaatgggaggaggaagaacaactgagtaagagaatgcagtaatcaaaatgtatgtcaagggatgatttgggacagatattaaaatagattggaagggggctaaagattttcaacgatggaaaagatgaagtaaaaatttaattattagctataatgttttctagtaattcataatctaatacaacattattattagaggaagattcttgcttttaaggatttgaa

SEQ ID NO: 135974 - DNA, 183 bp, Homo sapiens
agcagtatcaaatataaaaggaacatcagctcacacagatgagaagaatcactgcaataactctggcaactcaaaaaggcagagtgtcttcatacctccaaataactgcactatttccccagcaatggttcttaatcaggttgaaatggcagaaatttcagaaatagaatcagaatatggatg

SEQ ID NO: 135975 - DNA, 259 bp, Homo sapiens
tgttaaatatataaataaggccctgcccctgagattttggtttggaaatgggggctggggatatgtttgttttaatgttccagatcattctgatagccatgtttgggtggtagtagtaaataatgataatagctaacatttcctaagtgctttctctgcatcaggaaactgtgcatattacataatttctcatttaatctacataataaccttctgagatattattaacaattaattgacgtacgtataaactgaaacc

SEQ ID NO: 135976 - DNA, 168 bp, Homo sapiens
tcagttttgcatgggaatgtccagagtcattgaggctgtttttgtgactaggcctcctttattgagagtgagcttcagggggaatgtagatgacttcattcagtcctcaccctaaaagttaaatggaagcacaatcacacacctaagaagcagaggctaaataaacca

SEQ ID NO: 135977 - DNA, 143 bp, Homo sapiens
ctctattgcacaaaccatcttctaacatgctatagaatttatttattatgattatattttctttcccatattcctccattagaatgttaaatccctaagaacagaaccttcatctgctttattcagttcctagaacaatgcct

SEQ ID NO: 135978 - DNA, 507 bp, Homo sapiens
ttgttaaagcaataataacagtaggataagcaatctgagagcaagccccgcaagcttgagatcgtaatcaaagagtggcgcttcctagttgaaatcacttccttgatgtgagaacccagccatatttttggtctggatacttactaccaaaactagagagagtgcaaacgtattttcttttttctcctgcccattcagagttgcagaaatcaaatcctatattccagatcagtccttaagttttagccatgctttctgttcttagttacatcatttctatggtaagagaagttgaaggagtgtagggaatgagggctccctgctctatgctgtgatttgggaaatgaccctcaacttcatagtggtcagctcaggaaagtattcaggacaaggacagtctcatggcagtaaatggtccatgttcccatgaagtttggggggaaaaaatgaagtacatgaggaatcatctggggatgggtagagagttctgaggctctggctggcagg

SEQ ID NO: 135979 - DNA, 675 bp, Homo sapiens
aataacgttgctaaaagaaaatagatcctaatattgctctagtttaaactacatatgcaaattgcagtcactgagacattaagacaatattgagaagcagacttaaatcgcaaattttatttatattatgcctgttaaataaaaaattatgatttttacattttattgtaatattttttctttatttcattttatagaaatcagctttttctcatgtaaaatgcacacattaaagtgatgtaacttgatgtcatttttacatagtctaaaatattacaggatttttcaactcctctatgagtttacttggttagataaactaaatttcctataatagaaaaatatttgctcattaaggagttattattttcataaactacaagcaaacaagggacattcatttacaattagaaaaaaattccaacatcctgaaaatgtatatgaaatatcattgatacaagtattatacaaatctattagtatggtgttgtgaattaactagcaattatctgctagtttccagagttgtaaattaactcaagtgtctaatctgagtatagatcatggagctggatataaactaagagatttataagagccagtttctacctttaggaagaagtttcctcagggaaagcagtgacccgcttggctttttactatggagatagagac

SEQ ID NO: 135980 - DNA, 407 bp, Homo sapiens
aatgagtaactctataaaataaaaccatcaaaaggcactaaggtttatgaccagctgagataaattttgggtacttgccaacactgcaaatctttgggaatcaccataacaagaaatgaccacacacctctggagattctaatagccagagaatatatgatttggatccactcttacccaaagaaggaaactcctttttacctctattctccaagcagtttcaaattctctagtttacaaaaactaattttattcattcatgcctgcatcaagagtttatgccattccataagtcaagactcggttatccagtgagactagcaaattaaaaaaaataaaatattccagccaggcacagtggctcatgcctgtaatcccaacactttgggaggctaaggtgggtggat

SEQ ID NO: 135981 - DNA, 604 bp, Homo sapiens
gcaggtgtgctcagagagggaagctgattgtggccaggagcctcggaggttcgtggggtttcgtcctggttccctgggctgggccagcgagagcagggctggctcagggtgcggtgtcctgacacactggtaccagcaggttctgaagcaacaggtagtgaccccacatcctggcccccacccagctttactggcatggccagtgctgagataggaaatagggtttccattcctgaccccagcctgggctctcacgaagaagctggtgaccaaatcttagtcctcgagtgccctttcctttatttcagcccctctgcccccagctttgtctttttccagtgtctccttctatatgtgtctccacttctcagccctccattgttttgccttttgtcttcttccctttggtcccactgtctggcccaggatttttcccctaagaatttacgcctggactcctcagagcctcagtttccccaattctctgtctcttcagggtcctttcttttagacctatttgttcctgccccttctccattccctcttctttttaaaaaaaattttaattaaaaaacaaaatacagatggggtctatgttgcccag

SEQ ID NO: 135982 - DNA, 370 bp, Homo sapiens
cttgtgtgtctggactggtggcaggtttgtatgttaccagagtgatctccatggtaacggatcaacatggcgccaatgacaactctacactaagagcttcaggttcccatgagaaagtggatcctcacagcaaataggaagaaatcaagaaatatggatccacactccccttccctgtagaattctggccgtgaagtttcagttcatataaccaacaccatgtcctatttaaccacttgggtccctctgagtaaaccaagactcttctgagaatgcagtgttctctcagatttcaactaaattcatacaaagtttaatcagacttgcatagcaaagaactatattgcagtggagcaagaatgtaacttgg

SEQ ID NO: 135983 - DNA, 665 bp, Homo sapiens
ggcttgagaacaaatgggatgggggtgttcgagagagggaggaagctcaggggatggcagttttaaactgtgggattgggaacaagacagtaatagaatttagcagattagaacacattgagtttgagatgccagataatgcctgggtgaagatgatcagcaattggaaacatggatcaaaacttgagcaaaagttcaagctggatatgtagatttgaggtagatctgctcaggcaggatagttgaaatcgtgagaatttgaaatttccaaagtagaggatacagtcaagaatcagcctgcaattgaggataaaactagaagagttcctacatttatagaactaggaacaacgacaacaaacaaacaaaaaaaaaaaaaaggaaggagagggccgggcgctgtggctcacgcctgtaatcccagcactttgggaggccgaggcgggtggatcacgaggtcaggagactgagaacatcctggccaacatggtgaaaccccgtctccactaaaaatacaaaaattagctgggcgtcgtggtgcgtgcctgtagtcccagctacttgggaggctgaggcaggagaatcaatggaacccaggaggcggaggttgcagtgagccgagattgcaccactgcactcctggggacagagcaagactttgtctc

SEQ ID NO: 135984 - DNA, 329 bp, Homo sapiens
aatgacaggcatttgttgcttgttggctgggcctcttgcatacagttctcccaacatccctgtgaggtggtgatgcttatccccattctccaggggaggaggctgaggcccagagaggtgaagtcgtgtgccacaaaataccccagccatatggtggtagaaccaagttttcagccagactcaccagctcacagcagagctgccctggactctacagccattcagtgtatagctgggccactccatcattcaaggcagttcaacgtcaagattcctgatttgcctcaacctggggcctctagaagataccatcacccccaacaagctga

SEQ ID NO: 135985 - DNA, 521 bp, Homo sapiens
gaaacccttagacggtaccaacacaccaaagacgttgctaaagaatacagcagtaacaattggttgtcttggttatgtttgtcctcaagaggtggtccccatgctacagcagtttacgagactctggtgcacctctctgagaaacataagagacaatgagaaaaggattcagcattccgtggaatctgcatcatgatcagtgtgaatccccatggcataatccaagattttatatttttttgtgatgctgttgcatcatggattaacccaaaagattatctcagagacatgttctgtaagatccttcatggatttaaaaatcaaattggcaatgaaaatgggaggcatttctctgaccagtttcctcttcccttaaaagagcatcttgtagctttttatggtgtttaatgtaatacacttaagctgcagtcccaaaattaggggtccttcagtcttggagactatgagggagcctctgcacccagggaaaatgctacccttcatggggggaagggtaaacc

SEQ ID NO: 135986 - DNA, 1049 bp, Homo sapiens
acagcgcccagtctggagtgcaatggcgcgatcttggctcactgcggcctccgcctcctgggttcaagcgattctcctgcctcagccttccgagtagctgggactacaagcatgcaccaccacacccaactaatttgtgtatttttggtagatacggagtttcaccatgttggccaggctggtctcaaactcctgacctcaagtgatcctcccgctttggcctcccaaagtgctgggattacaggcatgagccactgcacccggccgagagagcttgtattttaaataccctattcttggctaaaaaaaagcaaaaacgacttgcaaaacccagggagacgctaagaaagaacagtttttaagtgtcgcttatgctgtcacctagagcctagaaatgacttagcatttcacttgagtgtttttcaggacacacacattttgaaaacactgagatcacactcacccgtgttttgcaaatgtttctgacgcatgggaagtaattcccattcattcagttctcaacatcattttaacagttgcgtggtatttctgggtcctagacaggttactgtttacgtaactggtcagctgttgctgagtgcttggtggcctgatttcctgtgctactggaaatgactgcaggccgaaccagtagggcaggagaccaccacgcgtgccaggtacctgtagttcccatgtggttcagggtgaactggagaggggagagctgggtggtggcgaaaggggtgtcaggccatggagagtggcctgaggctggtggctttgtgggtggcccaccttggctggttggagttggcactaggcagagtgagctgggggaaagggccaggatgtgtttcatgatttggccttggtgggatagaaaatagccccagaatagcttgagctctcccaggcagaacggcagggtcttgtgtctggggtgtctgggtggatttcttatgggtagcggaacccaagtgccagggccaggtgctgacctctccctctggcaagtcactgcacttcatgcctcggtttcctcctcc

SEQ ID NO: 135987 - DNA, 688 bp, Homo sapiens
gtgtccttggagaattcaggaaagaaagctgagctcatttgaattctgtgtcaggaaggactcttattgctagctgtcttgttattatacagggaacaatgttttcacatgattccattatatttctagtgctttattcgataagaagactacaaaaagggataaacttgactctatttccctgaacctgtttgtctccctactttagacttctcatttacttaatatttttttcttgtattctatacatatgagtaagattaaataaccttacatttctgcaacactgtagaattgttaaatcaaatctcgggggaagtttccccattagtgtaaattatttccataattcccattgtatctgtcagcaagaggttatataagactattcaaatatatattcggaaaattttgaggctaggcgtggtggcttatgcatgtaatcccagcactttgggaggccgaggccggcggatcacgaggtcaggagttcgagaccagcctggccaacacggtgaaaacctgtctctactaaaaatacaaaaattacccgggcgtggtggtgcatacctgtaatcccagctactcggaaggctgaggcaggagaatcgcttgaacccgggaggtggaggttacagtgagccgagatggcaccactgcactccagcctgagacagagtgagactcc

SEQ ID NO: 135988 - DNA, 1396 bp, Homo sapiens
ggctggaccagtagtcaacacccacatgccaaaggatagagtcactggccagcaccaaggctatggctttgtggaattcttgagtgaggaagatgctgactatgccattaagatcatgaacatgatcaaactctatgggaagccaatacgggtgaacaaagcatcagctcacaacaaaaacctggatgtaggggccaacattttcattgggaacctggaccctgagattgatgagaagttgctttatgatactttcagcgcctttggggtcatcttacaaacccccaaaattatgcgggaccctgacacaggcaactccaaaggttatgcctttattaattttgcttcatttgatgcttcggatgcagcaattgaagccatgaatgggcagtacctctgtaaccgtcctatcaccgtatcttatgccttcaagaaggactccaagggtgagcgccatggctcagcagccgaacgacttctggcagctcagaacccgctctcccaggctgatcgccctcatcagctgtttgcagatgcacctcctccaccctctgctcccaatcctgtggtatcatcattggggtctgggcttcctccaccaggcatgcctcctcctggctccttcccacccccagtgccacctcctggagccctcccacctgggatacccccagccatgcccccaccacctatgcctcctggggctgcaggacatggccccccatcggcaggaaccccaggggcaggacatcctggtcatggacactcacatcctcacccattcccaccgggtgggatgccccatccagggatgtctcagatgcagcttgcacaccatggccctcatggcttaggacatccccacgctggacccccaggctctgggggccagccaccgccccgaccaccacctggaatgcctcatcctggacctcctccaatgggcatgcccccccgagggcctccattcggatctcccatgggtcacccaggtcctatgcctccgcatggtatgcgtggacctcctccactgatgcccccccatggatacactggccctccacgacccccaccctatggctaccagcgggggcctctccctccacccagacccactccccggccaccagttccccctcgaggcccacttcgaggccctctccctcagtaaattcacattttccttcctcctgttacattttcccaatatcttttctattccttggaccaatcagagatgctgtagctccttggggcaaaggtactaatccctttcagcacccccactccattcccctttttaatgtaactttttccacaggaggtatttcttttttatgttggtcctgagtattttgcaaatgcacagagaaaataaaactaaactccttgttta

SEQ ID NO: 135989 - DNA, 455 bp, Homo sapiens
ggctggaccagtagtcaacacccacatgccaaaggatagagtcactggccagcaccaaggctatggctttgtggaattcttgagtgaggaagatgctgactatgccattaagatcatgaacatgatcaaactcctatggctaccagcgggggcctctccctccacccagacccactccccggccaccagttccccctcgaggcccacttcgaggccctctccctcagtaaattcacattttccttcctcctgttacattttcccaatatcttttctattccttggaccaatcagagatgctgtagctccttggggcaaaggtactaatccctttcagcacccccactccattcccctttttaatgtaactttttccacaggaggtatttcttttttatgttggtcctgagtattttgcaaatgcacagagaaaataaaactaaactccttgttta

SEQ ID NO: 135990 - DNA, 487 bp, Homo sapiens
agccctcattttgcatggtggtactgtgggactagaaaaatggcctttggggcaaactggtgcaaagtgacctttttcttttggagtaaaacatgcacgcacacatgcacgcttacttgcgaagcaatcttaatcgtcaatggagaaatggattgcttgtgatctttaattttttttttgttaaggcacaaaaatctcttactgtaaattgtaaacgtataggggagtgacaagcagtaaaacattgattaaatacactgtaatttataacattaaaaacattgatagttaaagtacgtaaccctttgacgcagcaggttcatttctaagtggatagcttagagcaatctggtgtctccttttaatagtattttaaattataatttttatcataaaatgacattcataaaaaaaccctacctaaacacataattttagaaaaatcaatacaatgcctcaattgtgatgtaaaataaataaggggaaa

SEQ ID NO: 135991 - DNA, 401 bp, Homo sapiens
tcacccaggctggagtgccgtggcgtgatctcagctcactgaaaccccgcctcccaggctcaggtgatcctcctacctcagcacccttgagtagctgggacgataggcgtgccaccacacctggctaattttttgtaatttttgtagaaacggggttttgccatgttgcctaggctggtctcgaacacctgggcccaagtaatctgcttgtctcagccctcagcctcccagagtgctgggattgcaggtgcaagtcactgcgcccagcccctcgtgtgttttctaaccatttctttgccatgtgttttctaagaactgtggtgtatgtggtggggatgaatagcgagctattcatcggcaccccacaataaaaatctgacccaggccccccatttctttcc

SEQ ID NO: 135992 - DNA, 369 bp, Homo sapiens
agctgggactgcaggtgtgcgccactatgcccagctaatttttgtatttttagtagagacggggttttaccatgttggttggccagtatggtctcgatctcttgacctcgtgatctgcctgcctcggcctcccaaagtgctggggttacaggcgtgagccacggcacctggcccattctgggtatattcttagttaagcagggttgtcttggctgtgttggcagcagccctgttggcatatattccctggcaatttgtggtcaactgaaacccctaagcctgtttcatgtgagctactattaagccattccttccccattctatactttggtagttaggtttcattttgtggttttgattcttcatttc

SEQ ID NO: 135993 - DNA, 358 bp, Homo sapiens
tatgtggaatgaatgaatgaatgaatgaaagaaattttgatatgttacatggtaaaggtaagataattataagaaaggcaaaatatgaaactatacttgtgattttagaactaagttctggatagttttaataaccacatatcttgtattatttatatacattcatgtgacattaatatatcatctttaaataaaaaatactaaaataaaaaacaatacatgaaaaaggcatgtgtaatgtatattatatatatttgcattaatattttacatttaaatgaaagaagcttagagtaaattagtctacaaacccacctcaaatttattttgaatgtaggaagaatatcatttatactta

SEQ ID NO: 135994 - DNA, 670 bp, Homo sapiens
gattttatatttgatgcaaaacttaacagaattttaaaatatcctgatagtagattattttcattttctgggtttgttatttttaagttttattacattatgagcacagatgtatacattgtttttcctttttgaaaactgtcaaagtttttttttgtttgcaaatgggcagttttgtgaatgttccatggaaacttggaaagaaggtgtagtctctatttttagagtaatgtatatcacttaattttatttaggttttccatattctgaaaaaaatttttttttgcttattctgtcatgtcctgagagaaaagaaagtttcctattgctgagattttattttctaatttaagacttctgttttctgtaggtttttctttattgatattgcttctgtattactgggtaattagatagtcataacatttaatctacattttgtattgtgccctttagcattacaaggtgtttatcttttttcattgaacatatactatgctgcattaaaacccatctgatattaataccatgaacgttattttctttttacttgctcttgcctgttgtaatctttgcctttccttttattttcaacccttcttggttacttattgatttgtcgtattcttgtgtgcagcagatatttggattttgctttgaggcccacctc

SEQ ID NO: 135995 - DNA, 512 bp, Homo sapiens
gatctagaggtccctgtctcagtctcggggaggctgcattcagtccttgatggggtcaacggctcaggggacaatagtgaatctggctaaataaatataacccggttgcctaaaaccttaaggtcggggaaaagacataaacctttctaatgaagaaaagcatgcccggccaatttttaatctgacctcaagtgatctgcccacctcggcctcccaaagtgctgagattacaggtgtgagtcaccacacccagccttggagctgtgtattttctgaaattctctcagaggtagattggtacaccaaatgcgtcaatgaaccacgtcagtaacctgtttaattcaagtcaccgcttcctgcctctgataaagcattatgtcttatgctgtcttcttgcttccaaagtcaagctgtgtcagcaaggaagaaggttgtgatgtggctaatgaaagacgtgggtctccatcaaccctgtagctgtaggtttattttccctcatatctccctcctcc

SEQ ID NO: 135996 - DNA, 171 bp, Homo sapiens
tagggattacacgcgtgagccatggttcctggcccctgaaccattttttaaaggaaatcgatatatttattctcaagtaatgaactaagttgttttataatgtgaaccttggcactttgttgttttaatctgtagtagtcattctataatgctatgagagagtatatatat

SEQ ID NO: 135997 - DNA, 316 bp, Homo sapiens
atcttgaactctctggctctgattctcactcttttttgcctgtgccatcgtgtttctgtcccgtaactctgtggatgccattccacttcccaggagtgccttttccttgtctgtctcctgtctctttccaagtattttccaacatttgagaccaacttgagttcaattctcaccttctccatgatggaaggcttccctctcttttaaccacttcatctcacctggaaatctcgttcccttatgtccttctgacactaaatatgcagccacatataaatatactggctgagtggtccagtcgttaagcagccagtat

SEQ ID NO: 135998 - DNA, 558 bp, Homo sapiens
cccagcctcgctgccgccttgcagtttgatctcagactgctgtgctagcaatcagcgagactccgtgggcgtgggaccctccgagccacgtgagggatttaatctcctggtgtgccgttttttaagcccttcggcaaagcgcagtatttgggtgggagtgacccgattttccaggtgccgtccatcacccctttctttgactaggaaaaggaactccctgaccccttgtgctttccgagtgaggcaatgcctcgccctgcttcagctcgcgcacggtgcgcgcacccactgacctgcgcccactgtctggcactccctagtgagatgaacccggtacctcagatggaaatgcagaaatcacctgtcttctgtgtcgctcacgctgggagctgcagaccggagctgttcctattaggccatcttggctcctcccctctcacctctcattttcaaagggatatcaatctctttaagttcttaagtacttccacttgagttagaatatgagcttccatttgatgtttttagactccttcttcgtctttgactgcatgaata

SEQ ID NO: 135999 - DNA, 522 bp, Homo sapiens
aaaagctaaggggagttaacgcgccgctgcagctcattgtcaaagccagcttcaggcagagaacgaaggagggagcgacttcggggctgggttaatgttttcccgcaggcaagtggtagcagatgtcaagggttaaggacaatttaggaggtaagaatttccaggctgcacttgtgtcgggtgcctcgggcgatgagcccaggagcccgctctccacgcagtgacgcttcccaagctggtgctttagacccctcacttgcctggctgctctgaggccccgtccctgatggcttctgacaatttggtgtcctttgtaaagacgacctcagatcctatcagcttcagtttcacaaaacctggatcccctgcctctgtggtatgtctggactgccctgggcaggcagggcctggctctgagatgaagatttctcagcactgaaggaccgcctgcctttgagctgtgaaactagtctatcctcacatagacaccagtaaactgaggcttgagaggctcaaggacac

SEQ ID NO: 136000 - DNA, 230 bp, Homo sapiens
aaaagctaaggggagttaacgcgccgctgcagctcattgtcaaagccagcttcaggcagagaacgaaggagggagcgacttcggggctgggtgagctggattctgttcctgctctgccaccaccataagcggtcccagctgttacaacgcggctctgcacctccacttcctcctctgtaaaatgagtgtcctcgcctctgtcctcgctccctctcaagacttctggggga

SEQ ID NO: 136001 - DNA, 967 bp, Homo sapiens
atcctcctgcctcagcctctcaaagtgctgggattatgggcaagagccaccgtacctggccaactggcttaaagacatgcaaaagggccgtctcttccacagtgttttgtgaaacaatacagagacatgtggagaggacaaagggtgaagccttcttgaataagcttgctccccaaccatgaaggatgccaacccactgacctcccaacgtgtggtcccagcccatcgtaatcaaacctgactccccactactaccaagtccagcccaatgaaggtagaaaagcatcgtgcagtttcctccttaaaggacctgccctgtgtgcacaccatgtccaccaatattctgctggccagagcttagtcatgtggcctcaactcaagggggctggaggtctctgcacagagctgtctcagcagcttacccagagcaccagagtgacagcgggctcctgccaggtggaagtgttcacaaaaatgagtaagagaaaatatggatgtgcctttatgaattacaaactccatgggcttccatagagcatggcttttacataatctaaattccttctctttgcgactccctcctgaactcatccccagaccctccctgagtggagctggtcacaccaagtcagcctgtgcctctagttgctaccatttcttttataggtgttgtcccagttaagatttcactggcagtagggctggattctggtttccagggcaatcaagagcagagcatgaacggtgcgtctttggtagacaatttaactctgtgtttctggcacccctcacttttgtgatcaaaagaaagaccagaggagcctttctgcaattctgccctctttccctgttttgcttttctcccaaggcctagctgattgattgcagttctttctggatttagtaacttggttttattcctacccactaatcttgatgtctttttccctactagatcatacctttc

SEQ ID NO: 136002 - DNA, 731 bp, Homo sapiens
atttttctttgggctgctaaagggtgcacagactgtgtactaattggtaaatgttttaaaaacaaagcatagaattcagaattgccctgaatctgccttcaaggactgatacaaaaccttgtttttgtcctttgaagctttcttaactgctacctaaagttatttgctggaatgggtgcccttggaactgttctgaggctcctaatagagatttattttggaatcaaacccatggatgcctcctctgggatccacctaagagaaattaatgagcactttttgttttgtgaattaagtttagtttcttaatccttttatatgtttggggttgactgtaaaattacagcgtattttgaaaataaccagagaaaaggaggctttatatagtcctattgtttagctaagagttcctctaacttttaaacagagtgcttttctgtacagaaattagctttattgaatttttttagagcagtaatggaaaaactagtcacaaaataactctaagatagcaatacttaatgtaaaacagggtttaatcaaattgttccaaagcaaaaagcaactccataccatatcttattttgtataataagaccatcacccagggttttaggatatacccatttgaaaacataagtaaacggtgttccactgccatgctcatgccctccttgtctgccagtattcttctttttccagcttgcctttaaagtagaattactctatag

SEQ ID NO: 136003 - DNA, 353 bp, Homo sapiens
cacctcccttctgtgcctggccccagggtcttgggtacccaacacttgtcactcagctcagttagtcctcactaggtttagagaggagaggaccaagccacagggagtggtgcagctgctaaaacctaggtcctcctctctcaggtctgcacccacaaggccagcatttccctatacacattcaacatcatagcatagcgcttcatatgtcccagacatgtgccaaacatggtaggttagttaggtaatttagtccccatgcccgccctgtgagttagggctctgttttacagatggggaaacagaggcacagattagtcaagccatttaccccaggtcacacagcaatacta

SEQ ID NO: 136004 - DNA, 238 bp, Homo sapiens
tttaaaacttagtttgactattttgcagtaatgaaaaatggtcctgacatacagaatgccatctagcttacaactgcatggggcatgcagaagaaagagatgaacaatctttacctgaaaagagaccaccctctcctttaatgggagtggaaattaaagaataatgctcatagtttgctgcaaacactattgctcaatttaatactctaatggaattcacacatttctttttctacag

SEQ ID NO: 136005 - DNA, 473 bp, Homo sapiens
atttcctgggtttgatttattcatcttgtgaaataaagggagagatggaaagaatctctgcagctcctgattttatgatcttctaactctaaaattatcacaaaaatttctattgaaaactgtcacttatcatgtaagggaggggagttgtagtataagttcttttggttacattagaaacaaacttggccgggcgcggcggctcacctctgtaatctcagcacttcgaaagaccaaggcaggtggatcaacctaaggtcaggaattccagaccagcttggccaacgtggtgaaaccctgtctctaccaaaaatacaaaaattagccgggcatgggggcgcgtgcctgtaatcccagctactcaggaaactgaggcaggagaattgtttgcacccgagaggcagaggttgcagtgagccgagatcgcgccattgcactgcagcctgggtgacaagagtgaaactccgtctcaa

SEQ ID NO: 136006 - DNA, 815 bp, Homo sapiens
ggcctaagacatggcctcactgcatagataagacaggccacacagctgacttgcccagacatgtctgcaatggaaaattccatcccctgacacatgtgcagtaaggggaacaaagcaatatggagtaactcaaggcagacattgaaagtgaaattcgaacgagattgaaaatgtcctacatcctaaatctcagattaaattgatccagaaagctcctgcaagaaaaaggaccaaagttggctgatcctgaagcttgagacaagatagggcctcaaaagatgagtgtaatgtaaacatatcttgcattccacaactcacaactgtagttggagttttcatgttaacttacacatgtgtgtatacaaataatctgtacagaaagatattattgacaagcttgaaaatagatgtgcattgttaggttgaaatgcttttgagtctcactcatgaatatagctagtctgcttcaagtttacttatggagttcttccattctgcccacccgctaccgtttttaaagcagtcaaccgtgtttagaggaacatttattcccaaaggatatatttgaaaaataacaatctttggattcaggataactaacaaattcaatatagaataaataaataatgaacccacacttagacgagtgctagtaaatttacagaatgtcaaggaaataagattatcaaaaataccagacaaaaaaagaaaaatcaccttccccaaatcagttgcaatgaagaatgatttaccaataacaacactggaagctagaagacagaggaataatatcttcaagaagatgagagaaaata

SEQ ID NO: 136007 - DNA, 260 bp, Homo sapiens
ggcgggcccagctgctctgcaacacctctggcttctatccaaccctgtgtgctcccctctctcttttgcatcagagacaccacccaaactttctgctccaaattcttctttccctcttcaacctatccgtcagacctctgggaagagttccaggcacttatgaagtccaaccaccagaactgctccctcatcacacttctttctcccttctggttacatatttggtttgatcccactgcccctgctagatggccagccct

SEQ ID NO: 136008 - DNA, 408 bp, Homo sapiens
tgcctggccaccacaatatcaacatttttaaatgaaaaatcttatcttagttaccatagcattagcacctctttaaataactccattaatttaacctaaatctaaacgttctctaaagttcatcattaggatcttgaattatggaacctcttgacttttctagttccttaaataatgacaagtattcaagtacatttttgtcttccatttttaatatccctgtaacatgaggggaattggcaagattctcttcataaacccccctcgctatcccattcaccgaattcatcagtatagccaggaatcctaataggtttcagcaggaacatttctgacagctcaatatttttctgtccaatgatttggaaaatcctgtttctctttattagagctgaagtaactaaaaag

SEQ ID NO: 136009 - DNA, 234 bp, Homo sapiens
taagattccattgtgtaattataccaacttgtctattctgtgttgatggacatgttcccgtttttggctatttgaataatgttaactgtgcacattcttgtacatatgtctcttatggtacatgtacatgcatttcggttgaatatatgtcaagagtataattgcatatcttggcctttagtattaaaagcacgtttctggctgggcgcagtggttcatgcctataatcccagc

SEQ ID NO: 136010 - DNA, 196 bp, Homo sapiens
gatagagtctcactctgtcacccagggtggaatacactgtcacaatcttggccactgcactacagactgggagacagagtgagaaaaaaaaaaaaagatgctagagtaattggcatccataggcaaaatatgaacctcataccttatgcaaaaaatgaactcaaaatggactacagaattaaatgtagaatgtgaa

SEQ ID NO: 136011 - DNA, 239 bp, Homo sapiens
caatacattaatgaagtctgaatggggaacatggacttctacccccacctggctgtgatgagatggaagcccctttcccctgccatagtggtatcagaaaacaaaacaaaacacaacaaaaacaaaagtcacaaacagctaagtcaatagacttaaataatatagagagactcataccatattcaaaagatccaattttctataaaaaaaattagtcatgccaacaagccaggaagata

SEQ ID NO: 136012 - DNA, 466 bp, Homo sapiens
ttcctctgggccaaattattcaagtgcttggagcgcacatgcacatagacacacacataatcaaaacccatcccctccccaataacttatttttatgctatttatgcttcaaagaaccactttattgcagcttagttttttcttctctttcctagctaggcaggagggagagttagggaccttgacaagaattgaatgacagctgcctccaggaaagggaggacaagcaagctggtcctagaacaaagtttgtaactgaacacctttagtatcttttctcttcatataatctatctcttgatacacttatgtttctacctccttggaaatcagtacccttatattgcccctctggctgttcttaggctccttctgaggagtacttgctctcataatacgtaatcaaaatgcaaaactttcatgtccttgctgttaggttttcagccatgttactatgttacattga

SEQ ID NO: 136013 - DNA, 360 bp, Homo sapiens
ggtggaaagaaaagacaggaagtctctctgaacttattctgatttgggggtgctacccgacttaaaattttaaaaacttaaggccaggcgcgatggcgcatgcctgtaatcccagcactttgggaagccgaggtgggtggatcacctgaggtcaggagttcaagaccagcctaacacggtgaaaccctgtctctactaaatacaaaaaaaatagccgggcctggtggcacatgcctgtaatccgagctacttgggaggctgagacaggagaatcgcttgtacctgggaagtagaggtttcagtgagccgagatcatgccattgcactccagcctgggcaacaagagtgaaactctgtctc

SEQ ID NO: 136014 - DNA, 498 bp, Homo sapiens
gcagttcctccctgtcataatgtagcttcttttatgtgtatcctcatccatcagaaataggaaaatgtgttattatcttgttcccaatatcacagagtccaccaaaattctctaatggttggaaattaatgctaaaaggaagggaaatgtgaagttgacagttttattcgttcattcaaaaaatacttattaactatacactgaatactagaatacactgatcaaatatgtttacctctcatgagccttaaagacttcttggagtggtagataatcaataacaaattaaagtaagtactgtggttgaagatgaagcctgttaagaagaaaagagcatagttagaggagccactttagataaggttgttaaagatggcctctctgaggaagtgacatgggagctgaaagataagaatgaatgcacagctatgctagagcagtgtggaaaatcattccagggagaaggaataagaagggcaaatgctggaaggcaggaag

SEQ ID NO: 136015 - DNA, 938 bp, Homo sapiens
agcgggggaagcgactgcggattggaaaactgaaacccagagaaaagggacttgcccaaggccacacaccaaattagtgacagagctagaactagactccagttctccgacttccagctaagtctctttagcttcagcctactgcctctatagcggaaggacttgttccaaggaacaagttaaactgccccagggaaaaggaacctgtgtggcctactttgtattatttacacttcagctggaatgaatttcagatcctcccctgaaacttttaatggggaaaaggaactagagagactaagacaatgagacttgaacatttttaactaaacaggaaacagaagggctaacacagcacccatgtctgaagtgaccatgattagctggtttctagctggtgactagctggccctgactggtccacttactaccttaaagttctcccaggtttggtcctacgccctcttgccactgcactctatattctcttcttgggtacccctccacacccacaacttcattttccacctgtatgcaaatgtacacaagtgtgtatctcaagcccagccctcatctctaagctccagatctatatagccaattgcctcaacatctcctttaggatacctcaaaggcaacccaaactctacatttctgaaattgaaacaatctctgtgtatcccaaccttttcctccaagcctggatctcttccagtgctcctacctttatccacaatatacccaagcccaaaacccaagttagtacctcttccatttacttaatacctcttccatttcccatctatcactaagtcttatcagctttacttcctgaatatcttttatataggtcctagctaccatcacatccttcctgccttccctcccagccatatttgcgcactgcaaccagagtgatccttcaaaatgcaaagctg

SEQ ID NO: 136016 - DNA, 281 bp, Homo sapiens
cctcggcctcctgagtagctgggattataggcgtgcactaccacgcccagctaatttttgtatttttagtagagatggggtttcaccatgttggtcaggctggtctcgaactcctgacctcgtgatccacctgccttggcctcctaaagtgatgggagtacaggcatgagccaccgcgcccagccaagtatcagaattttagagaattcttaggatctaaagtccatccctcacttttctggagctctgctgtgcagtaggtatatgctacatgtggctgt

SEQ ID NO: 136017 - DNA, 789 bp, Homo sapiens
ggattagaggcatgagctaccgtgcctggcctgaaagtgtcttttaaaaccttgaagtgaccctctgacaaactgaggaactttaactttgcctccatagattgatagaaaagtatgagtagtagcccttttgaaaatgatagaccaaccttatttctctgacagccaacagggttatgatacttattttataaatggtaacctccctctgacccttacttggagtgagttttcaatagtatgcattcaataaacattcaccatttttattccagccattactgtccttgtgcctcttactggaacctgtactttcatgctcagcaggtgtccagcattaaaagaaaaagtaaagattacctagaaagaactcctcaacagtagtgccacccaccatcctagaggtcgtcatagtgtttgtagctggcctttcttccccttgagaattctccgttggtttccgtgatttggttatcaacagtcctgcctgctcgcttgctgtcctgtgtagcttttgctgcttaggtgctgagtggttctatatttctttcccagtcctcttttgagtgcctggctgacattttcaatctctattgggctccaaaccaaaccagtttcgtggtattgtcctccaaaccttgccctcttatagcatgaacaatgtgttgagcatggggtattataagagttctcatttagcattccacagttgaggaatgtgtgttacttcaattacctttgagctgtagaaaaatctttagctgtggtaacagccacttctaggagagg

SEQ ID NO: 136018 - DNA, 748 bp, Homo sapiens
ttaagaacacgtgtcttctgacacggatgaacaccttatgatgaagccatgtgaaacaagttccttcattttaagcagctgaacatctatcctttaaatattttcttttgtaaaactttaaggctctctacaccaatgcttccccaaatttgtgttccttaaagggctgttaagtaggctattaattagcgttactcaaaaattattctatgttcaaattttagaaataatatttctcagataccttcaatatgctaatatgtcctggaaataacccaggaattctaagagagaagggagtgtgtagtgttattccctcgctggcctaggtatacttctggtgatgaaatattattaactgccatctagaaaaacatttcaaagaatgccagctgggaaatgctactactctaattttaagacttaataaaagatcctcagcaaggcaactttcggcccctcacagagacagtactttgaaattcatattgagattttaccctctcttccaacgattttgggaaaattatgaactgagactcttcagaaaatatctttcttctggaaaaaaatgtcgctcccttaccctcatccttactttgtatcctggcttataacaggccatgcatttttgtagcaaacttttcaaaaacaattatataacctggtcccttctttctggggcctggatctgcttacacagcaggaagaataacaccaccaacctttacatagcccagctagccag

SEQ ID NO: 136019 - DNA, 610 bp, Homo sapiens
  misc_feature (610)..(610): n is a, c, g, or t
gctcacatgactttcatgacagtataatctatatttttctcccacctctcaaatcatttcttagatttttctatctctgtctttcctttaaacatcagtgtttccaacctggtgcagcagctcatgcttgtaatcccagcactttgagtggccgaggcaggtagattgcttgagcctaggagttcaagaccagcctgggtaacatggcaaaaaccccatcttaaacaaaagaaaaaaaaaaaaaaaaaaaaaacactttttgggcgcgcgccttgggcccttggaaaaaggtttttaaacccttcggttggggcgcgcgcggggcgcccaataggggataagggagaccatggggccaaaacgcgtgttccctaagaggagacacccggggccaatagagaaacagaggcgcggggagttcttctcccccaatatagaaagagagcccgcggggggggacaacacccgagagggttttgtgtgaaaccagaattttcgcgagaggtgggaagttctcacggggaggctccattaccgagggggactctcttctacaccagggggggttcccaaggggagagctgcggattatccaatttttaggcccctn

SEQ ID NO: 136020 - DNA, 530 bp, Homo sapiens
cagtcatgtatgtaatcttactgatattcagatcttaagggtgaagaaggccgggctggtctcaaactcctgacctcagggtgatctgcccaacttggcctcccaaagtgctgggattacaggcatgagccactgcgcctggcctgtaataagtcttaaaatcaggaagcgtgtgtattctttctaaacaaatgaagaaactaaagccacagagcctaaagttaagtaagaaaactagtagagtcagaagtagacctaagttagcctcattcacagtacctttcttttttaatatcttgtagtacaggtagaccatccctaatacaaaatctgaaatgctccaaaatccaaaacttttttaaatagagacagagtcttgctatgttgcccaggctggtctgaagctcttgggctcaagcaatcctcctgtctcagcttcccaaagtgctgggattacaggcatgagctgccactcatggccagtgagcatcttttcttacacttattgatcctatagtttttcttcttga

SEQ ID NO: 136021 - DNA, 717 bp, Homo sapiens
  misc_feature (717)..(717): n is a, c, g, or t
gcgtcttgctcctggggggttggcagccccagtggctgaggccggcgccaaggacagcaccttttccgccagcccatttcatggattggccgctgggcccagggacccggctggctctttctctgcacgtcctgattggtgcatcgttccttatctggtgcgtgttaatcccgtgatccgagaagcatagtgcttggcacacggtagctctgtgaaggcgtctgtgtgttcagacctgcattcaaattccgaatcccgtacttacagtgacatgcctcagtttccccatctttacacctcattgtgttctggtgaagattaaatgagatactttatgtaccaaaaaaaaaaaaaacacaaaaaaaaaaaaaacatgtgtgtgtgggccgcgacctgggaccacggagaaaagagtttctaaaaaccattgcgcgtgtgggggcgcgcgggggccccacgtgggtacacgtggaacagtggcccaaagaggggatcccagaggagagactcgcggcgcagaggacagaagggggcggggggttttccccccgcgacataaaaaaaaagccgccgcggggggggaacaccgcgggagggtgttctggggcaacaaaagccccagaagggggggcccggaggggccacagcggggagcatatcacccaggggaccccagagagaggccggaaataaaaccgaggcggggtggcggggggn

SEQ ID NO: 136022 - DNA, 348 bp, Homo sapiens
aaatctaacaactgggaattgtcacaattcacgcatcaccagagatttgctacaatgacccttcctgccatcatctggtaaaatctgcataagtccatccgtaccttgtaggctgtccttttgtggcctggtgaattacaccatcattatgtgatgctccctatgaaaaccattctacaatttttataatggccattgattttaaaatgtatgatcataaaagatttgtttcaagtgattttgttccttgaatattaaagtttttacactccaggtagatagttacaataatataatggatgatgtaatggttgagaagttttctttggcagtgatcttctaggcgag

SEQ ID NO: 136023 - DNA, 184 bp, Homo sapiens
agctgaaatcactttttaaatgcaaatcttatttttgtttgaatgctcacctcctttgtaattttttttaccattttggtaaaaccaggaatagctatattgttgtccacagtgaggctggcagagccttcagagaccacctcctaggtctgatccccttgtattaacagaacacatgaaaaga

SEQ ID NO: 136024 - DNA, 460 bp, Homo sapiens
tattttacagtttgactctttctttgacatttcctatatgtgtgtggttcttggaattatttttaaaccagttgtaacatctgaacgagttacatgaaatcttttaacacatgctcattttatatctgtatgaatcacgactatattctttttaaaagttatcttttgctggggtcgagggtggtggctcctgcctgtaatcccagcacttttggaggctgaggcaggaggattacttgctgccaggatttccagaccagcctgggcaatataacgagaccccatctctacaaaaaaaatttaaaaattagctgagtatggtgacgcgtgcctgtagtcccagctactcaggaggctgaggtgggagaatctcctgagcccaggaggctgaggttgtagtgggccgtgagtgcactactgcactccagcctggagacaaggcgagaccctgtctcaactt

SEQ ID NO: 136025 - DNA, 335 bp, Homo sapiens
cacaaccctctgccgctctctcattatttgccactcccacgtataaagctttaaaatcaacctgtatgctgacaattcctgttcggacctgattacgacctttcatgaattccaaaatcaggctacctgctgctttctgcacatatttatttacctataaaccacacaggtacaaacatattccaaactgaactcaccttcattctcacccactcccaagagacatgaatgacattcaaagaacacccatgcccattaagtttgggcattgtccccaaatatgccatgctcatttctacttcttcactaactcccctcctctctacttgcctgag

SEQ ID NO: 136026 - DNA, 288 bp, Homo sapiens
aaagatgagttgaggagagactattggctagagtttttaatttgtttggtttttggattttaatgtgttatttaatttttaaaaatagagaaagaaattcaaagtctaggttatgttaccagataaactgttaacttgccttgtatagtgatgtgttgatattcattttaccaaattgcttgggctttcagttttccaacctggaaaatgtatgatagccgaatatagaaaatttcttctaaaggttagatattatttctgtcttcgtgagctgctctgaatttgctt

SEQ ID NO: 136027 - DNA, 410 bp, Homo sapiens
aaattcaacgatacataattagcttacatacctccctgattacatcagtgtgaaatctttgggctacaaggaaatatctaaactgtagacaactctatagctattagtacaataaaatagatttcgagacaaggattttcatacttgataatgttacaggtacagaagagctctaaattcatagaatttacaaaagaaactgtgaaaatggaaagtattacagtctcaacttgcactttttttcttaattattgtactgacacgacaggcctagaaataccataatcaagcatcattttcttgtttaaccccacagtaatattccagctcccaagagtttatataataaccaagtcataaaatgtagaataatttcaactttcttttactcgatacccctgtatgcatta

SEQ ID NO: 136028 - DNA, 474 bp, Homo sapiens
tgcacgtgtcatctcatagctgttcctagagtgtccaccctaacaggcttggagccaaaggaagagtatggttctctatactgaaagaatagagaaaagaataaaggcataaccctgcagagcaccaatatccaaaggttggctgaagttgaggagaggcaattaagagaagtaagaggaaaaccaggagagatgtatcatggagtccaaggggtatagagttttaagaaggcaaataatgtttaatgtagtagaagaaatcaaataatataagagtctaagaagttgggcatggtggtgtatgccaatagtcctggctactcaggaggctgaggcaggaggattgcttgaggccaagagttagaggctgtagtgcactatgattatgcctgtgactagctactgcactccagcctgggcagcatagtgagatcccatctctaaaaaaaaaaaaacacacacagttaagagtct

SEQ ID NO: 136029 - DNA, 420 bp, Homo sapiens
agggataatcccggcgggatgtctaataaccgactacgagtaatttgatgatcaatcacccattcagtagaatgttgtctttctctccctcctggtttaatgaggagtacaaaatggccagtttccagcctcagcttccatttaatacaaacattaactgtgctcccctaatggaaccgtgtctcccttaagcacaggaccaccaagttcaccaagttccatatttcaggggccagaagcatacatttcttaagtgaattatttggggtaataataagaaggggtcatctcatctccaccttttaggttctatatgggttaaacatttagacttcatcttaaagaagtataaacctaagaagcctcacaggatggtttgttggatgtataactaatgaacccttaagcaaccattctacc

SEQ ID NO: 136030 - DNA, 501 bp, Homo sapiens
agttcgagaccagcctggtcaacgtggtgaaaccccatctctactaaaaatacaaaaaattagctgggcatggtagcgggtgcctgtaatcccagctactcaggaggctgaagcaggagaatcacttgaacccaggaggcggaggttgcagtgagccaaaatcgcaccactgcactccagcctgggcaataagagcgaaactccgtatcaaaaaaaataaaaaaaataaaatcctagcaaacttacaagatttgaaaagacataaattttctgacctcgagggcaggccctattagcatatggtagacaccagagaaacattctcaaaaatgataggagtaatctctaaatgaaggtatgagagtttacatcaggtacaattttaaagcaaaaaaagagaaagcattgaaattaatgcaagaagtttacggtcactcagtgagtaaattaaaaacaagtgaggacctgtaatcccagcactctgggaggccaaggtgggcg

SEQ ID NO: 136031 - DNA, 760 bp, Homo sapiens
attgtgaacactctggatattaggctatgtagaatatgaattctgttagttttgtctaataagtgtttgtccctttgctttaacaagtaattttgttgtctgggcttgaactgtaagcccttcctttggtcaagtgatccagtcttggttctgactttttaattttattttaacttggttgctttcagtccgttcaacatgagtggtttaaggatcaaccagagatgtaaaatgacagagtttaggaatttcctctttggaattttccttcacagaatttatctactccagcatttctggtttcctagtttctgttttctggttctctgggatagaaaaattggcattttccatttggactctattgctgttgtgtgcacagtcaggatgacctttctcctgaggctaaaatcaggtagtaaggaatttacttgtagaggctcctattcccttgttcttcaagtaaacatgcacaactcatgtcttgtattgccttatgtccaggtttttagttgttttctaaatggattaatctctttgggtttactaacgtattcattatcccccagagtgttaatctattttatttgctgtagcataggcttttaccagcacggtagcttttatcccatagccaaggaacaatatgaattctgacaactctcaagtatgtccaacaaattatatattttggaaaaggaaaaaaagcaccagattgacttatggacccagtggatgcactgtaagcaaaacttgaacc

SEQ ID NO: 136032 - DNA, 442 bp, Homo sapiens
ttttcacttcaccttaatgctctggttttaatatggacatctgtctctctcttgataatccatttctgaaaatcagatattctatgtaggaatacattctatgcagaagcttattttccactattttaagtgggaaaaattttaatgtattacatgtcaatgtaaaactcaacgaattcactaagtattaataaaatacagcaaaatacctatatataacaaatatcatgttaggatgttagatgctaaaaacacttgctgctctccaaatagttaatatagtaagtaacaattgctctgtgtgcaggaatacatagcacatcccctgtgatgctctgcatattcttcaaaatgtccaccaaggattctgatattctgtcaaaaatgttactcaagacatttcctgcatatcataatgttgtattgcattttggggatgtat

SEQ ID NO: 136033 - DNA, 335 bp, Homo sapiens
tcacgtaatatgtacatgtagtcctagagcacaatttgaggaatacaaaaatggtaatcctagaattaaatttgcctgaagaaaacaaagctcaagaatctttattaaggactttgagtgaagcctaataattttgatgcatcttaaaagaaaccttggatatgtataagcatagaaatagtatattctgtatacctgtgtttaaatgtctaaaattatttaattggttatattgctgaaatttatttatttatttatggaatgagccatgttgcaaaatcatggaatctattttctttatgccaccctaggtcaaaactcaatagcatctgaag

SEQ ID NO: 136034 - DNA, 517 bp, Homo sapiens
attatcacctatatatttttcacttccctcttcagtttgaattattcatatctgtatactatatatgttgtttttaactttattgataagacttgacctcaagtagattccgccacttctcaaaaatgtatttatcctccagaatgtttttaaaaatatatatgtcactgacatttaaatcaaggtaatttagccactgaaataaatttgaaggagatatctcccaaatgtttgtataatagcagtaacatcatatttagtgaaagtctccagagtgaattactttgaggagtttgtctcagtaatcactagtacatttgtttaaaaatcagttttctttcctcaactggcatagtttatatagtctcttggaataaactatttttctttactgtgtgaaattctactttacccctaacttggttttccccatcacagaatgccaatggctctcttctttccatttgaatcacataagttaattttgcagtggtttcccccatcgctgtttagggaa

SEQ ID NO: 136035 - DNA, 216 bp, Homo sapiens
ctgcctcagcctcccacagtgctgggattacaggtgtgagccactgcacccagcctcaaatgtgtatactttcataccagcttgtaagcttctgagatcaggtatggtatctatttctttatatgcataatagtttgaatatgctagttcttaagttttaaaattcaaattgagccatcataaacgtgggcacagattatggagggggatcctcta

SEQ ID NO: 136036 - DNA, 535 bp, Homo sapiens
attcgacggagactctccaattctcttgagatgtacacaagtaccatcttctgagacaagctttctgtcttatctatggatcaacggattatagatgggttgaaaccagctttgattatcccatctggccaccctaatttataattcagtaatgactttaataggcaaaataaggaggaaaggaggctcgcagttacaaactgtgagctacaaactcacagttcatctcttttcacaaggaattcatcatctggaaaaacttacttctaacagattctaatggaggtattagggtggggctcaggcaaaaagatcaataacaaatgtaaattttatgatgttgttctccatggcggaacctctgccaagcaaacaataaaagcacacactttgtgctctcttcacaacccatttctggactctctgtcactcaaatgtttatcatgaaagaaaatgtgtttcaggcacaactattaaacttctgagtgacagagagtctccgtcgaactgggatcctctagatcactccaacatg

SEQ ID NO: 136037 - DNA, 290 bp, Homo sapiens
tatgattatttggcacgttttgtttggcagattgggtcagagtagcaaattcagctattgtgtgcgtggcctcaaaagtcaggaaatgtttttctcctaaaacattatcaaccatttgttgttggctaggagcttgttggaacatggcttgggtaatgcaggccagcaaggtgagttgacaaactagaatctcgtggtagtacatttggggaaaaggttcattagtaactactacatacttgaaagcaggtttaggaatatgctgttaattcttgtctgaatgaagagga

SEQ ID NO: 136038 - DNA, 808 bp, Homo sapiens
tgaatgagttaatgaaaagtgccaagggaaagcagactgaggatggaaagtagaactgaagatcaaggactctggagtcctgcagacatgggttcaacttatgagcatgtgaccttggtttcttgaccttggaagttcattgacttttgcaagcctttgttttctcttctaaaagatccacagcattttataaaactttcaccatccataaaaaagcaataataatagtaccttccttgaggggttgttgttaaggattgagtgagaattttttaagtgtgagcacagtgtctgaaacataacaagttctcaacaaaaagttggttattactacactgcatttaaagttaatgcttttatttacgaattatttgtagttgttaacagcataatgatccaaatatagtcatttcattgatttttttttggattagtttctatagagttagcttctttaagaataatatttgtcttaattttatagtattttatacttttcatagatagcttatttcaatgacacatggcttcgatagaaagtctatatatttccttgaatccttttaaattatatttttctgaaatgctaacaacaatggtggttagtaaggctgaaaaggagttccattttggttagtcctgtagtaaggaattggatatgaaaagttggtcacaggaattaggctggatactgaaagcaaaattctctttacaaagtaaaggcactagattaatctttgccagatgtcaaataattattacatatgctttaatacggaaagatctcgagggtatgtttggtaaaaac

SEQ ID NO: 136039 - DNA, 594 bp, Homo sapiens
cttcagatgcatttttgttgcaattgtttttcaagtaatgaaaactttttattgaagaatagcttacacgctgaaaggtacatacatgatcaataagcaatttgagagattttcacagaatgaacacatgtgtgttatcagcactcagaccaagagacagaacattaccagcagcccaagcgcccctgcaggccctcagtcaccagctccggaagggacctctcacccgacggctgttgcctgttttcaaacttaaaaaaaaaagaagactgactgggcacagtggttcacatctgtaatcccagcactttgggaggccgagacaggtggattccttgaggccaagagttcaagaccagcctggccaatatggcaaaaccccgtctctaccaaaaatacaaaaaaacaaaacaaaacaaaaaaaaacattagctggatgtggtggcgcatgcctgtaatcccagctactagggtagctgaggcaggagaatctcttgaacctgggaggtgaaggttatagtaggcagaggttgcagtgagcagagtttgcgccactgcactccagcctgggtaacagagtgagagtccatctaa

SEQ ID NO: 136040 - DNA, 342 bp, Homo sapiens
acaaacaatgagatcatgttattttcagcaacaaggttgggactgaagaacgtatgaaatatgccaggcacaaaaacataaatattgcatgttctcacttacatatgggagctggaaaattttatcacatggagatatagagtggaaagatagataacagagactgagaaggatgattggggctgagggtggaggataaaaaatagtggattaagatgtacaaatcatagaaggaataaatttaatgcttgacagcagacaatgtctattggctgtgctgtactcactgcttcaggcaataaaatccatgcccttttttttttaattataaaaaatttttac

SEQ ID NO: 136041 - DNA, 151 bp, Homo sapiens
gagggggtcacacaatcccacgggcgccactggcagaaatcatccaggcatggagttcagttaaatttaactcagtacaggaaatgttttctactccagctggatttctgcacctttgagctgtgaatttagatggatgagcaacaatctc

SEQ ID NO: 136042 - DNA, 582 bp, Homo sapiens
cagtttatcatcagttctggccacacaggaaggcaactcgcaccccttgcaggtcggtggccaggcccttaaaagcaccctgagagcccccagcattttcttctcctgctatggctgctgtggaagccgatgctgagatggtggatcacaacacagagggaacccaaacccccaggcaccaccaccagagggacagcttggatagggccaaagaatgcttcagcaacacaaagctgaagtgggcgtcagtgacacaaagacttccgttgtgccaagcctcggagacttgtaagtttgttactgcagcagagcctggcctgttttgatgagcacatatacttaaacgcacaaatcgatttcgggctgacaaaaactcaaaacagtttcctcctgaaggcccacgtggtaacaatcctctaatctgaaattctttacaaacacaatgatactcaaaaagaaaccaacaagaaaacctaagttgcatttattcacgtccacgccatctaaagctactgtgtaaagttagtgactgtctagaggaacaagacatcactacgtcaagaatcacaggcatttaccccc

SEQ ID NO: 136043 - DNA, 245 bp, Homo sapiens
cctctgggacgcttgggaactgtgcccctgtttacagacggcaagcccttagtggtagggccctgagattctgagaaacataaggtctgctttatttaatttcctctcgtttaccaagagtcacaacctattttagtaaataaattcaggaaattggtaaagcactttactccatccgttatgcctcggtcatcagcatggttgtcacggtctctctggctcacgggctgctgcggctcacagcc

SEQ ID NO: 136044 - DNA, 365 bp, Homo sapiens
gtgggttgaccggggcttgtgggttgaccgtggcttgtgggttgaccggggcatgtgggttgaccgtggcttgtgggttgaccgtggcttgtgggttgaccgtggctcgtgggttgaccgtggctttatcatctttgcctcaaagcagctccatgtcacctccagctcaaaacctcagtcattttgctctcacctttgagtaaggccagggacctggaaaagtgggactaaaatgtctccaggacgttttaccaggaaaactaccagaacctggtaccttcttggttatggatggtaaggggagagcaaaatgactgaggttttgagctggaggtgacatggagctgctttgaggcaaagatgat

SEQ ID NO: 136045 - DNA, 229 bp, Homo sapiens
ccagttactgggggagaggaaatgtatgcaactgtagtcccagctactggtggggtagcggggagttgggaggccaagggcagctgaggtgggaggatcacctgagcccaagaaggtcaaggctgcagtgagctgagcttgtgctactgcactcagcctgggcaacagtgagcaaagtgagacccccatctcgaaagagaatttaaaaaaaaaaaaagaagaagcaaca

SEQ ID NO: 136046 - DNA, 322 bp, Homo sapiens
gggtagaaaacaagaaaaagcaagaccgggattcccctagggtgggactctaacccacaattctagagggaatgccaattccgaacaccccagagcatctggcatggatgacaaacagtaccaagtgctgaaaaccccagagcatcttgggagtgtccaacagtgaaccccaaaggcatgagacctaacacagttgggggccacagtacaacatgactctggcatcccaggatcaacacagtgggggaccactcacaaccaagtgtcttgctttaaccaattgctcaactatccaaaggaaaaactacaaacgtgacaaaga

SEQ ID NO: 136047 - DNA, 268 bp, Homo sapiens
aaagtgttatttcagctgtcttaactctaatacataaattactgcatcagcaacatccatacttaagagttcagagagtgagaatctagggccttgtggcctagctagcatttccagtggctatccttggctacacctctgtcctttcaatatccctggtatacctacgttacagaaaatctgtgttaacaccaatgtactagggtgtggtgttatatacctctagtctcagctacttgggaggctgaggcaggaggactgcttgagc

SEQ ID NO: 136048 - DNA, 393 bp, Homo sapiens
tcgggggaatttgtgttcccgttctccttaagaagcttgtaccaatgttctttccctcttctgcagtcagctacccagcctcacctgtgtgatgggacatttgattttgaattgggtttcttttttaacatagtcaagttagctgacacagtgcagctactttgattgaaataggcccctgttgtttggatttcactttttgtgtggccttcactaggaccccaactggtccctaaccagatgtcaccgtcagcacacaaatcatgaccaccctccccagacccaaggcggcctcgctgggatgcaggcattccttccggaactcgccttgggccgcccattctcactcctgctctttcttctgtccatgaagtccccctgggccccgcaccc

SEQ ID NO: 136049 - DNA, 282 bp, Homo sapiens
ataaaatttatttgtaacaccaaaatcaatattcatggcactgaaaaagtgccatgaattcaacgggcatgaacaaaacagtgaaaaatttgagtcaccaaatgtgcacattctcagctgaggctgagcaaagcaacattctgtcttgttttagttctcaaactataaacaagtgtcctttacatggtctatttagggccacgctgttgtgcttttgtgtagattttgccgtttaaaagggcccttaagcacagtgctgaagtgctatcacgctcttaagca

SEQ ID NO: 136050 - DNA, 744 bp, Homo sapiens
acaattctaaactcttaaacataagtatctgataataattggaataaaatttatagtaacagtctgtgcctggttccctatccagttatatttccagttcctgtaaaacattattctttatagctccccctgtgtctctgttgaataaaactgtcctagtccatttctttaatgttgtatcttaatgatcagattaatatttttatcaattttttaaaagtatcaaaaaacaaaatgtggcttgctcaatttttacttttattttttaagttaaaaaataccagacactatttttgcatatttttttctatttgtaaaaataatcttcctgtcattatcagactgaaaatatttgcaatgaagactaattttctaccaaaaaactggctagatcaaggatgtgaaagttcagagaaacatgttgatgtactttatacaacaataaacagtgctgttttcaaagacaaaacaaaacaagaaacagaaagacacaaaagaaacaacacacaaacaacaacaagacaaaaaaacaacaaaaaaaaaaaagaaaagaacaaacaaaagaaaacgagaagacaaaaaaaaagaaaagaaaagacagaaaggaaaaaaaaaaacaaaagacgagaacgaaaaaaaaaaaacaagagaagacaccacaaaaagagcaaaaaaagaaaagcaacaaaagaaacacaaaaaaaaaaaacaggagaaaaagacaagaaaaagagaagaaaaaag

SEQ ID NO: 136051 - DNA, 288 bp, Homo sapiens
ctgaaccatctataatctgaaagctttttcaaatactagtaagccaggcacaattaccaattattcaaataacatttattatagctagtgatttccactgactatatctgcaataattagagctggtaggtttttaaaaatatagattttaagagtatatggaaagtccttgaaaggcaatgtttctgggctgttaggaataaggcattcctttaacacgaaataatgaattttaaacagtaataataataacaaggaagaaatgaatgactgaatgaatcagaaggc

SEQ ID NO: 136052 - DNA, 709 bp, Homo sapiens
agttcgacggaggactctcaagaagaagcctttcggtttaggttcttctgagagctcaatcactgggattcttcttttaacgactggaaaatgtctgcttgattaggaagttagtcatttcacattttgacatctaaaacaatgggaagttaaaaagcctcacaaattacatttataagtaacaggatacatcactttaaagatgaaaacctcaaggatttgtggcgcctttctttgttctcgttaatcctattttactttttgagtgttagatattctgtaaatatcggcatttgaattcaaacaatagatgttgataactagttctctaacttggtacaaaaacattattattgtctgtcagcagattttgtattctgagagttaaccttctgtatttgatgttttctttgtcaatcactattattctagcccgaatactgtcttcctcattccgttttaaaaccttaagcagttgtaagcacaaacacattattatttatattacggtagaattagagtggtaaaactgagacctcacctgaccaggtctccatgaagctgtaaataaagactttctcttccctctccagcacatatttctgatgctggtgtctctacagtgcaaaggacgagatgtaagtcagaggaagaggaggaggaggaagaggaagaggaggtggtggtggttgtagtggcagtggtagtg

SEQ ID NO: 136053 - DNA, 589 bp, Homo sapiens
tcggatgcaagtgtccctctaggacttgtgcagcaaccctcatccatgtctgatagcattcacatccgtgcccaatagagggacctgccccagcctctgtgtcccctccacacagtgggggcctcttcactggcagtggaactgcatgcctgccatactgcttaacatcatccagttaggggccttggactgtgaatgcaccatacagatccctggctgtgatcaaacaaatcacattccctcacatgtgtttcaccccataaggcagaaactaccacccatccaaccctctggccttaccccatgaaacttcccttggaccttcgacctttcctcctaccccctctcaccttgccattgatagagattatatcccaaagccctctaaccatctaatcctgcctggtgtagtcactgactcctgaccaggtctccatgaagctgtaaataaagactttctcttccctctccagcacatatttctgatgctggtgtctctacagtgcaaaggacgagatgtaagtcagaggaagaggaggaggaggaagaggaagaggaggtggtggtggttgtagtggcagtggtagtg

SEQ ID NO: 136054 - DNA, 503 bp, Homo sapiens
tcagtccccacaaacagaaatgctgttgcagggtgagtgtgctaaaaatactcctgggatttttcaagtccttggagacatccatcttaaaatagtgcaaaaagaaccgaataaatactcatttatgtgctattttaatgaacaactgcaggcaatatgcctaatatggcagggaggtcttcagtgtcctttctccttcattcttgattagcgtctgagctcagatggcatgcatcagtatgtttgtggcattacagaggtgctgggagtgagggagagtgcaggggtagggaagcattacatgcctgtaatcccagctatttgggatgctgaggcatgagaatcgcttgaactcaagagggagaggttgcagtgagccaagatcatgccactgcaccccagcctgggccacagagcgagactctgtcccaaaaataaagaaaagtcagcttctgtgctcctgcccagaaccactgaatcagatgctgggtgtcagctctgga

SEQ ID NO: 136055 - DNA, 111 bp, Homo sapiens
tggtggagggaaaggaggctaggagggggcagataactccagggatcctttgattggaaaaatcctgtttttagaactcctgtcagagtaacaacaaagcaaagaaacatg

SEQ ID NO: 136056 - DNA, 431 bp, Homo sapiens
tttgctccagctgtactgtaaacactctttgtttactgcataccctcagtaaatacctgttgaatgaccggatagatgtggcagcaggtacattacctcaacttctggtacaccttgggagaagctttcccaagaacaccctgggttcatttcctcctagcctctgctctcctggggcccagagattgaaggcgcttaacctgctcatctcaccacgtctcccgccttatctctcacccttctcatcagcaccctacactccaccacgctggcttcatagctccttccccgaatgtgccaggcttctctgtgaccatctcttgagcgtacagctggctatacctgggctgccctcctcccacatttcaggtctcagttcagacacccgcaaccccaccatgtatctccccagtacagccatactcctctgc

SEQ ID NO: 136057 - DNA, 2606 bp, Homo sapiens
  misc_feature (1384)..(1384): n is a, c, g, or t
ctaaatatagttccctcctcgggacaacaaagaagccatcctctgaatgactgcattccccatggccagcttctgggctgtttgtcagattcccccagcaggatgggagggaggagtgggggcaaacaggagtggccagggctggagaggagctgctgaagtccatgcagcagggtgctgtcttccagccatatgacatttgggcccagacgctcagtggctatggccttgaccgtgagttcctgccttctgtctctggggatgcatggggcccagagccctgtcccgggcaggtgctactaagttgtgactgaagaagaggagagagaaatggtgatctccccagcaggaaatgaaaagtgtctgtcggctccagtccagtcaagctgggtgacctctgggcagattctatccttaagtctcagtttccacatctgtgaagtagggataaggactatgtcaaggagactagagagaaattgtgccaggtggcgggcactagtggtcctatctggccagggctctgtgcctgcatgtgatggattgcaggcatagcctttgaagtgctttttgatgtgcctttcacttcaggatggagtccctcttctggtcccagggctaagaggtagatagaggccctgcaaggtactcattccttactaaaacaagaccccaagcccagagcccctgccttccctcccaggcctcttatttctgatctcagcttctcagccatccagagcccagttgggtgctgaggcccctttaaaaagcccagagcccccgccttccctcccaggcctcttatttctgatttcagcttctcagccatccagagcccagttgggtgctgaggcccctttaacaccttggctcaaatgtggacagaacccttgagcacagctaagagcaattagaattatggaaaagaaaaaaacctggatttctcagctcagggcctgtctgtgcttggagggcactgacacatgtcctctccacccacccactcagttctactaagggtagagggcctgacctcttcctcaggtctaacaaacactgggaaaggtgaggccagcccctactgctagcggtcttcaggagagactcaatacaaacagctttactggatggagagcctggcctttgtacaacaaaaggtcactctgccccaggacttgcctggggtggacatacaggccacttcccacctgtttgacaccctcaggatgtagataagtcaggactagatgtttgatccccgagtgctgaccaggacagagatgtcaagctttggtggatgccttaaggccctgttgatttagaccttcctttctgctcacagactggccccctggcaggggtgcaccatagcgggatcagncattggatgtgtggaggagcagatgcatagctatctgttgctatggccaccgttcaccaagcatgaactctgtacaacagccctgcaaaacagctcctgccttcatctttgtttttaatagaggtagagtcagcagcccaaggtttcacagctgttaagtggcaaaactaggattcagtttgtgcaccttggagtccggaagtctctagtatgaccacaattcttaaagagtgtgttcctgctgggaatggcagttgcacatccaactagacaagctggtgggctcgattataacaaaagcctcaagctttcttgaggggagtcatgtggaactaacctaccagcactccttgctgataccccaaaggaaaccagtagctttggtatatttaggtttttcaaaggtttttggcaaagttccatgccaaaattttttttccgtacctagaaaaacaattaagtttgaagggaatatgctttgtcatgcataggagcctgtttagggaaaggaagatattcctaaggatgaaaatgcacccgtcttgatggataattgtaaacagcagggtcttataggaattgatgctagaagaatcttagctcatatttttaattaaagatctgggagaggaaatgtatagtgaaaatcgcaagtctacgaaggcctttcgggggaatgagaagccaaattaatggaatgtatgttttttgctctagttctcaaaccattgctaatgatctgcattttgttggcctgtttgccacagtaagatgcaagtgctttcacccactcaacacatatttattgtgcgcccatgatgttccagccacagtactggccacaggcatgagtgtggtattattctgctttacagaagggctttacaaaagcttatggtttcaaaatttccctgcttttgtttatggttctaacccttgcttgttttagaaatcattatgcaaagaacaactgcattctttttaatgtctgcatggagggatttttctgtgaaatgactgtacaataatcagttccctctggttggacatttttgttatttctggattataaataatataacgatatagccttaaacacacttgttctcagatatttacatatatggacaagtgtttctgagggtagtcaccaggaagggaaatgattgggtcaaaggacatatacatttaactatttgatagatgctgatggattgcctgc

SEQ ID NO: 136058 - DNA, 356 bp, Homo sapiens
caattgctctgttttctgttcccttggaactatgtatatacctctactatagctatcacattttattgtaactttttttcctcaccagcctatagaatccttaaaagcagatgtcttatcatatccttcctaacacaaatttggtgaaaatgagtagagtgaatgaaggtcgaagaagaatagcaatacagccactctgcagattcgaggatggacatgtttgagccctcattaatcccatcttcaggaggctgcattggtactatatgtggcatttatttcaatagagatgctcaaggcaaaaacgatattttactggtctacaagttcccaaatttcctttaggaaaatacttg

SEQ ID NO: 136059 - DNA, 489 bp, Homo sapiens
ccacaaactagtcattgttaaagctgctcataagttcacagaggttcactgtactcctcctacctactcttctaggtgcttctaagttttcaaaataaatcttaaaaattatctttagcagatatttcctacaatttaatatacaagtccagataatccaattagtgaaaatacattctgcagctagctaatcaaggttcagactcagatattctctaaagtactttgaagttacttaacagcttttaggttactagtaatacctgctctgaaaaggttccaggctcaaactactcctgctcgagttccaccgcaggggattctgggaactccattcagtatttgttcaagcgctaaaacagacccaaaactactttcttggataactatgggctagaccaataggtaggcataactgctcttttcacccaagatgtgtaaatggcgaggttcaactgtcattgccgtatcattcccatcaacttctgg

SEQ ID NO: 136060 - DNA, 419 bp, Homo sapiens
agttcacagaaaggttcttgaataaatgcatatgcagtgaatttctatgaacttgagagtatttatttccctattctaactgaagaattacagatttttgaagagtacctagaatgtaataaacactatgtcagaagttatagaaataagaaaaatgttcagataataagacagtacaaactaaaagttgcattctttatgtactgaattatggaaatggattttgtctttgtgccttcattctacgtctttattccaaagcaaataccatataaccttttcaataaaactctgtcatgtaggccagagactctgccatcagctcgtgtttctgttccttttatgtttctgtaggatacaatgatttagaataggatgtgtccagggcttgctttttttgttttgttgcaataaggaca

SEQ ID NO: 136061 - DNA, 669 bp, Homo sapiens
gtgccaggaggatcttggacataattttcagggtgtataagccctgcactaaagtaaagtttaccagtgccaagagtttgacgttttcttcttcatgttttctttggctggagcctggctttagttgaagagttctgtcaacaaatggaattctctatttgggactgggattcttgattggtggtgcttctgtctcctcttgctgtgagtttcctcaaacttagagtcctgtgggatctgtgtttgaacagagactggaaatgcttacctcatctccacatttcttagccatttgtcaccagactgtagattgactggtgggatgcctgtttctagagagaaaagatactgcttttctctgactccagctgagaagaggttggttaaattacgaatctgatgactatctatgaacctaaggaggaaaagttaatttcttttgagggtttgcataatgttttaaaacaaatttatagaaatatagatgatggaaaaaagcaatagggtaaacctaaattattaaaaataaataatacataggaaataaacagcatagaaaagaaacaaaaaagagattgttaccaaaaaccataagtttttttttttttgaaaattctaagaaggtggataaatttctggaattttcaatgagcaaaaaagtgaaaagat

SEQ ID NO: 136062 - DNA, 249 bp, Homo sapiens
gctgccagaacacaagagctagaagctttctgactctgtagagatagaatttctacatttctagaaacacaagaattaccagaagatgcattaaaagaacatacaatggaaatagcacggtggctcatgcttgtaatcccagtgctttgagaggcaaaggcggaagggccacttgaggcccggagttcaaggccagcttgggcaacatagtgagaccctgactctttaaaaaaaaaaaaaatagccagg

SEQ ID NO: 136063 - DNA, 314 bp, Homo sapiens
taattgtttagggtctgcaggtgttcaccttgggaaacattgcaattgttgctcaggaataatactcttaaatgaaaaattcacaaaaggaaatcagtattctatgatagttacaagagcacatcaaaattaagttttaatatttccatttttttctttgatttttaaattttaactggagtcttctccatccagagaaacaaatgtctatgagaatgagttgcaaagagactgagctgctggctttattccctagaaattcatggtataatgaatttatttcctagaaatttattgaatgaattatttaatga

SEQ ID NO: 136064 - DNA, 358 bp, Homo sapiens
ctgggaatgagtgtggggtaggatgagcccttagatagcagagggtaaccaagggacatctgaaaggctactttaggaggaagctggcatcaaagactggaatccaaagaagctatgcagacaaaaagcaaccaggtcctagataataggaaggcatctaagagggggtaggagcccagaggcacaacctaaggaacagccacactcatgtctccagggaggctgcgcataagtaaatcagtcacaagctcccatcagttttgattattttctcttctttctgaatttgtttcctgtcttcctcacttgagtgtgggtgggagattgcccatggccatgtggacaatcttctctccat

SEQ ID NO: 136065 - DNA, 372 bp, Homo sapiens
ccagattcaagtgattctcctgcctcagcctcccaagtagctgggataccggctaattttgtatgttcggtagagacggggtttctccatgttggtcaggctggtctcaaactctcgaccttaggtgatccgcccgcctcggcctctcagattgctgggcatacaggcatgagccaccgcgaccggccctctgagtctttcttatctgtaaaatgggtataataatacctatctaatcggttttagtaatggtggagataatgcctgaaagtgctagtatagaggtttaatagccagcaaggactgttattagaatgaatagtaatatgactactgtcacattttgcaaatgtgtaaagaagagggctaagt

SEQ ID NO: 136066 - DNA, 181 bp, Homo sapiens
ttcatgtttaactaaataactaaatttatactattttttagactattacaactaagtattttgatagtaaagtacagtttttaaataatgcagcattcatttttattaaaactattattcgtgaacagctttgtattcatatactttttttttttttttttttgagatgaagtctcactct

SEQ ID NO: 136067 - DNA, 865 bp, Homo sapiens
taatatagccatgtgctttcgtcccttagcctttttgcaagtcctgacttagccatcctcccctaacttccattccagtgacttcaaacagggagatatattgccaccaccccaccccctgtggagtatttggcaatatctgtagatgttttgggttgtcaggtgtgtgtgtgttgcgggggaggtgctagaagtatccaatgggcagaggccaggagtgctaagcataaggcacaggacagtcctctggggggacaaagagctacctggcctgtaatgtcgatctttggtgattgagagaccccagcgcccaaagacatccctaaccttcaggatttaatcctcttcagtcaaacgtttccttaaccctatcagcccatgtttttcttttcttggtgaaagctgagcacttcataggctgtttacaggtccttctccacaggaaaatacttcctccaggacaagaaccctgtcttggttccaaactttcccaattataagagtcacctttgcgcttgttaaacctgcttccaggtgcttctcctgaggtttcctgattcagctagactggaggtgggacctgacgaggtggttggtttttagtgttctcaggagtgtggatgttttaataggtgttgggtcctcatgttaatcgacctgtgggtgtgtcacagtctttgtgtcacagatgtcctgagaaaggaaacaatttgaggatgagtggaggggaatttgtggtgtagagaaggccacagttaatatgtggggtgaatttctgaagacctctcagttcaaaacttgaataactcaagactcatcctgacaaaagccagtggatgtttcttttgccaaataaaatataccc

SEQ ID NO: 136068 - DNA, 1113 bp, Homo sapiens
cccacagctagctccctctcagccccacagctggactgtgggtgggggtgggggaattggtttcaacctccttcctggccctccccaccaaggagcatatgactgacaggctctccctgccccctgccccaagcgtaacaagtgaccactgctctctgggggcagccactggcttcaggttcgcctcctactccattgcctccataattacaagatgctcttagcctgactcccacggactcccatcacccagcgctcggctctctcggtggggagggcagagaatgtttcactgtccctctgtcttctgtggcatcctttgccttgcagccacagcccagctagcccaggccaagggagtccgacccccaccccgaagcacagggaagttgctgccctttcccgcagtgacaggaatcctctcaaaggttctggaaggcaaggatgcggccatccctggagacgccaaggaccatcatgtgaggtggcttttatcctcctcgcccctactggtacagacgagaagaaactgtgactcagaagttaagcattttcccatggtcactgggctacacagaaaggccaggatttgaacccaagcttctgcttccacccatcttcattaggagtcaagttatactgtgggtctcaaccatggctgctcactggaatcacctggaagcttcccaagtactgatgtctgtgtccccagcccagaggttctgatatcattgtctgggtgtggcctagccttggatctgcaaaagctccctaggcagttccactgcatgaagttgagaaccactgatacagagtgacctcacctccccacccccaatggaggtgctatggtttgaagagcaaaactcatgttgaaatttaactgttcttgcacctcctgcagagcctgggagctcccagtccagccaaggatgttggatctcatggtcctaagtacttctttgacaccccattcccctcagtaaaatagtttgaccccttctccaccaaaaaaaaaaaaaaagaaagaaatttaattgccatgatgatggtattaaaaggtgggacctttaagaggtgattaggttatgagggttcagccctcatgaatgg

SEQ ID NO: 136069 - DNA, 558 bp, Homo sapiens
cccacagctagctccctctcagccccacagctggactgtgggtgggggtgggggaattggtttcaacctccttcctggccctccccaccaaggagcatatgactgacaggctctccctgccccctgccccaagcgtaacaagtgaccactgctctctgggggcagccactggcttcaggttcgcctcctactccattgcctccataattacaagatgctcttagcctgactcccacggactcccatcacccagcgctcggctctctcggtggggagggcagagaatgtttcactgtccctctgtcttctgtggcatcctttgccttgcagccacagcccagctagcccaggccaagggagtccgacccccaccccgaagcacagggaagttgctgccctttcccgcagtgacaggaatcctctcaaaggttctggaaggcaaggatgcggccatccctggagacgccaaggtcagggagccctgggggaagggggagggagggcttgcgtctgttgcaggtcccaggcaaaggggctgctttccactcccgagggggg

SEQ ID NO: 136070 - DNA, 686 bp, Homo sapiens
ggatttttatcattttgattttcctcaaattgatgtgtaccttcataagaatgatcatagaaaacataaccactatcttaagcataaaatttagcatgcaagtattcacatggaaatgaaatatttgtaaaagctccctgtaattgtttttctgagaataagaaaatgcccatttggtatgtgtaagatgatctgtgtggagaagttgttttcccgagtctttgttcagcttgatcctgggactcacgcgctctgtggctgggcttattgtaccaggcaagcaaagcctcggctgttcggttgtcaatgcacagatgctcatccactgagcaacaaggagaagtcagcccctgtcaggccccagtgccaagctcactgcttacccttctgagccctattcctttccagtacctgggggccttcaacagggagaaacctacactctgcaagcataatggattgagtgagggctcacagtttttggaagactttactgttggtcctacatggagttttaaatcttgtgaaatcttccttggtatctaaatcaagttttatacctgagggcttcttttttttttttgagtcttgctctgtcgcccaggctagagtgcagtggcgcgatctcagctcactgcaacctccgcctctcaggttcaagcaattctcctgcctcagtctcccga

SEQ ID NO: 136071 - DNA, 163 bp, Homo sapiens
atttgagggatctggtgctcttcatgggcccttccacgagggcaatgggacattcctgtcgcagcatctggggcctcctcctgcccactcaaaggccagcatgtgtgggtggggccaggggaggttgttggcttgcttgagccccctgtgtgacctctgcctt

SEQ ID NO: 136072 - DNA, 816 bp, Homo sapiens
gaatgaaacagtaatcaagacttgtgtactataaatccttttctgattccttacagatttgtagtggtaagggttagatttaattttatataaggtttaaataatcatcaagcttatataatgtgatctgaattgcagttgtttgcatttcctctataaaaactttctctaataaggaaatcaaatgctttgtagacctatttaccttacttttgttgcagtcactgttgctgggatgctgtacatatattccggggtaatatatgggtacaaaactgtacaagatattgaataatttagctttaaaaaatcccacaaattttatgaaattttacagtcctgctacttctgcttttgaatctcttgccagaagacatgggtaaaatatctgcttctctcattttaagagcacagccaagtgaattattaaaatagaaagtatacacttaatacagctcttagtttgtatggaccctttacattttcagtattttttctttaatgaggttatcttaactctctagcattttaaaagtgtatttagaattgtttttcctgtagttcactatataaagcatttggtttgaaaaaaaaattgttacgtgtgactcttgataagacacagaaagagtgaaagagcatgagtgatggccaccttcctggctgtctctaagtagcagggtagatatgatcccagatgcactttagcaaacggaacttccaacttatctgagtatttatctttgacaaggtagggctaagcttgcctagatttgctttggatctttctagtataagaaatattcacagaaattg

SEQ ID NO: 136073 - DNA, 304 bp, Homo sapiens
gcgtaagattacataggcgaggacgctggctcacgcctatatcccagcactctgggaggcgaaggtgggcagatacctgaggtcagaagttgaagaccagcctgcccaacatggtgaaacccctgtctctactgaaaagaaatatcaaaaaattagccggggcgcagtggtctcgctccctgtaatctcagcactttgggaggccgaggcgggtgaatcatttgagatcaggagttcaagaccagcctggccaacatggtgaaaccccttctctactaaaaatacaaaaattagctggacggtg

SEQ ID NO: 136074 - DNA, 247 bp, Homo sapiens
gaatgacttacctcaacttcccggggtagctggggaaactcagtgatataaacagaagtactttggacactagaatctatctgctgtgcaaagtcagccgctaatgtttactgttacccacttaccaaaattattgatttccccctaaaacgcttttcagttgagttgattaaaatgttttctacttttaaaaaactaattggtgaatctggcaattgcttaagactcagcacagagaacacgtatc

SEQ ID NO: 136075 - DNA, 533 bp, Homo sapiens
gtcctgttataaacagtactgatggcattttatgtgaatatttatgagggaccttttaattaaaggatctcaaaattctcttatcacctgttagttaattttcacaatgtcatgctagagtgcgtgcatagtaatgttatatgccaagtacagatggagagatcaaagcctgcagatgttcagttacagaacttgccaagaacctgcagtgatcaactgggctttttccagcctggggcaccagcctctggttaccggtgccacccggctttccccagcttggtaaccagtgagaatcaggtctagggctagctggaaaacgacaggaatggtgactttggactcaccccaaccctttcctgccatgtgaactcccacctcccacccactcatcttcctttcttgtcagtctgtttattactctgagctgatttccactgaccccagaaaaggattaattgataactacaggggttagtaattattgacaaggtcacacttttccaaaaaatatatgcattttcaaatggaaa

SEQ ID NO: 136076 - DNA, 325 bp, Homo sapiens
ctgagaaagtcttaaaggcaaaagtgatttggggcagagatgtcttgcatgaggggcctcaaactttgtcatcccagaggccctagtgagacctgttgtcattttctactacttggacatgaaagcagcttctcaaaaataacttctgacaaattcaaacccaactgacctgctagtaccataataaaaataataaggtgttgtgactacaagaaagaatagagaaaattaaaggggcagtgatccatcatgattgaaagctagggaaagccgtgcatagtgagtaggctcagggcaaagaaagctgggccagatcttagtgccc

SEQ ID NO: 136077 - DNA, 672 bp, Homo sapiens
gggttttaagaaaggcattgacgtccttgggaactaggtaatacagtttcctctccttttcctatttttgattttggctttggctttgtatttgaaattctcttcttcacttcagatggaggtgtgggaggggatgtgtggggtgtagtatgtgtggccccacaggtagatcacctgatcagtcttttaccctaaacataagagagggaaaagcacaaaaaacaacagctctaagatggggcatgtacatgtccaaatttgaactcagtcatgtttttgtcaaactaagatgatgaactagttataagatgaagtttgactggacgaatgtagatcctattttgaccataaagctagttgcataagtaagcacaggatgatgttgaggggtttgtggcttaggagtagcacttaaggacatctgcggagggccaaatgtgagtccgtagtgagatgtggcaacaacaaaaataaaatctcagatgcattattgaaagaaaaaaagaatatctagaattgggggagatgataatcctatttatttttttttttgagacagggtcttgccctgtagcccaggctggagtgcagtggtatgatcacagctcacttcagccctgccagtagctgggactgtgggtacacactactgtgcctggccaacttttaaaa

SEQ ID NO: 136078 - DNA, 191 bp, Homo sapiens
ctgcctcagccttccagtgggctgagattacaggcatgaggtaccacatgccagtgaaaggctcttcttggagatagaactgggtgactaatacatgtagaaagaatgatgttttaaagtcaccatcttacagtccccatagtaataattgatttagtaattgcggaaaccattgtgtaaaggattgccag

SEQ ID NO: 136079 - DNA, 623 bp, Homo sapiens
cagccactgtgcctggactcatacgcatttaaaatctggcctgcacaagttgccagtgttcattcaccttaataatttattgttatcaagaatttatatgtgtttttatgtagaaactctacccaatgtaataatattacaaacataagcctcctaaatagcagtattatttacttttgatattttccttagattctcctgagtacagttgtttcattataactgttcttatgttgtttgtagaatattaaattgttcaaaaggaataacaatatgcaaagtatttgataataaaagctcgaaatgaggccactgcacataaagactaaatagattcatttgtgtagaaagccaaaaccacaacaaatgaatgaaaacactgcaagtatagttgtttgtctgtaaatatgaaggcccaatattaattatcccatctagtaataaatgcaaaacatgagtgactatacaccttgacaaaagcatctcattgtttctttcacacaattgaaagccaagtagaaagcagggtaaagttactgatataaatatacgtgcacaaaagagttaacataacaggtctgagtagctattgtcaggaaatcctgattgcaaggttggtattt

SEQ ID NO: 136080 - DNA, 661 bp, Homo sapiens
ggaaaaaacagtcctccttgagggacagctttgggcttcagttaagcctggagcttcgtggagacccagctccaccctaccctctatgaaatcctacgtactgatactggttttgtctaaaacacagatgaaatatagagcacgcctgttacaccagacctgggtccacatcagacatcactaatggatcagaattgccacctgcaaacgtgtgtctctgggggtgactgtctccgtatctccagttctggtttgcctgcacagcccagaaccctggatgcccctgcccaccacatggtccatttctcccttagggaggcagagacagcagagatgaagcacattccagtgccagcacctctttgttcctggttccacatccctggctgctcggctgcacacagctggtcggccagactgttgcatctgttcccaatattgatgtgattctcagtgatttgctttggaaatcaaaacctggggattgttggctttatctaaaaagcaagtcctgctccactggggaagaggaatgactcggctcacagcagagttgcgtttgtttggtttttcctgtcggacacaaacatccacccaacgggtcctgcccaacatggacgatgcgcgagcctcctctggagtttgatttgggaggataata

SEQ ID NO: 136081 - DNA, 152 bp, Homo sapiens
ccagctgccgcagactttcttacaaaactctaggaagattagacaaatatcttcactagaggttatttatgcaataggcattgtttctttttttcttttatttttggagacagggacagattggatatagtgattcttaaggaaaactatag

SEQ ID NO: 136082 - DNA, 159 bp, Homo sapiens
atagggtcttgctctgtttcccaggctgaaatgcagtgatgccatcatggcttactgcagccttgacctcctggactcaagcaatgccttcccctcggcctttcaaggagctgggactaccggcactcactaccatgcctggctgttcttattttttgt

SEQ ID NO: 136083 - DNA, 408 bp, Homo sapiens
gcggagctgacagtggccctcatctcaacggggtcaccatccatgaagcactgggtctggccctcggagcccgacaaacaaaaccaggtagagccgaggcgtcttagcaggtgctgctgagctgatggagaccctccacccgccaggcccgcgctgcctccacggacctgcctcccaagaagcacccctcctgccagcacccaaccccaacaggggcgcagccctcaatccagcgtgtgcaccatcagatcacagccccctctccccggcgggtggggctggctcttggccagcggatcccacagacgccccgttctctgggtgttgactgccctccctctccccagaaggaaagacagacaccatcttccataagcagctgagtgtatttctgctcatttcccaccg

SEQ ID NO: 136084 - DNA, 798 bp, Homo sapiens
gagactcaggacacaacctatgtgtggttgagatcttttcctgatgatcagttcatgtgttcaaaaaacatacagaaatgaagaaggcaagggccccaccccaggagacacaaagcctaagacaggaaatgagacctgaaaataatcatgataccaaaatagaaaaaattgaatgccacaagaaatcagagaaatctgatgggaaatagagctacacattggaatcactggaaaacatttttaaaagaggatgctcaagccccacccattagttccagtttaaaggtctggagacggacccaggcattggtaatttttaagtcttccctgacactactaacatgtaacaaggatggagaactcttgttgcaataggtagaacttaaaactaaatgaatgattttcagctagaagtactggaattacctaaggatctttttcaacatacataagactatacctttttggccctatttatgtaatcctcttgagaaacagaagctgaatggaaaagccaccttattttatatattacattatatagaaagcattttcaaataagggataagtgatgctaaaccttctctaaataatatttatgggaatgttaataatatgagtattctaggctgggtgcgatggctcatgcctgtaatcccagcactttgggagactgaggtgggtggatcataaggtcaggagatccagaccttcctggctaacacagtgaaaccccatctctaccaaaaacgcaaaaacaaaattagctgggtgtggtggcaggcacctgtagtccca

SEQ ID NO: 136085 - DNA, 610 bp, Homo sapiens
ctttcttttacttctgtattactcccgatatatagcaggcactccttgtgtatggatagatgaactgcatgaattttgtcaaggattaccaggaaaaacattgagcaacatgaacaagttgtctttttcctgtttcaagagctctcctgcccagtttacatgcgcacctgagcacagtccttcttccctgctaaaccttgctgaacgtccttttgcctttggtttgggaatgttgggcgcacatcccaccagatccagctctccctcccatttagcttcagcagaagaggtggcagaattactaattttagctgacatgatgtttactgctgcaagtatcactaattaatgatgtaaccgcagaataacaagtcccagatttcccttagcaaagcaaaactgagagtaaaccccacactggaccactccacagcatccgagcctaccaactggaaagagacaatcaccaggggctcaatctgacccagaatttgtgctaggagaaatttaaccccataatgccatgttaaagagctgcctgctacccactcaccccatgtgcagatcccagcttgtcagccctcagggagccctcagggaataggaccag

SEQ ID NO: 136086 - DNA, 434 bp, Homo sapiens
gctggactcctccaggtggggcgcccggagcactcccgaccacctgctccaaggacactgcctcctggaagcgtccctggtttcccttcggaggtgaactcgttcagggcacttctcggagtcgcagtctcaggtggccagggcaggccttctccctatgggtgctccccacgtccgccctgggcttggcaatgagaagcagccccgccccgcgtgaccaggacccgcctgcagcgcccgcggcggccacacgggggcagcaggcgagcgccgcccgaattcccgggtcccagcctgggctggaccggagggcactggcgggttgcctcgccccaagagcctcagtttctctgtctatataatggactaggctgtctgccagggcctttttggtcctagcaatctgaccccaagcgagctttattaacaaatag

SEQ ID NO: 136087 - DNA, 382 bp, Homo sapiens
aatgtattgaggataatgggaaactcttatggagatggggagcctagagagtctagccaacctatctcatcatttttgaaatctttggaggtgaaggattggaattggaagtgcaggtgtgactcatggttttatagatagaaagagatacacacacacacacagagagagagagagagaaactgagcttcatttatggaaaggacttagaagcagtgacagcccggccaggcgcggtggctcatgcctgtaatcccaacactttgggaggctgaggcgggcggatcacgaggtcagaagatcaagaccatcctgattaacatggtgaaaccccgtctctactaaaaaatacaaaaaaattagccgggtgtggtggtggatg

SEQ ID NO: 136088 - DNA, 372 bp, Homo sapiens
atgagtgagcattcttggttaagatggctccagcaaacatgctgcttgcctctgccacaccttgcctctcagattctgagaatccaagtttgtttctgcctcttctcaagggagacagcacgtagacacatcttcctcccaagggttgtgaaatgttaatgttattaaagctcatgcccttcttattggagaatacgtgtctctttgttgacgtgctgtttttgatatgttgttactctctgatctggagcatcctgaaagaaataattgcttttactcctacatagaagattatttaagtagtgcatttatctcaattagtcagccaacaaatatttatggagtgcttataatgagccagcccatgggcta

SEQ ID NO: 136089 - DNA, 346 bp, Homo sapiens
cctcagaggggaaccaaaataaccctgaaatagctccctgctctcctaagaggaaagggttactctggcaagagaaggaatttctcagtaagttgaagcaaagatttaattaaaagacagtggcctattttacaagattcctttggtgaagagattgggaaaacttagaccagatgaattcctttccaggccatacaggcattggataatgatttaaaatgaatatgagtcgggcaggccataacacttgaggtttgtaaaataaatctttcaaatgggtggacatagtgcttcgaagtccaggattcattataaacactgataaccattgtagtaaatgaatttc

SEQ ID NO: 136090 - DNA, 255 bp, Homo sapiens
aggtgaggtaatgaaatgagtagattcatacttggttaagaaggagaaagaaagaggagaggagagagatgacattagccaatgatatggtttggctgtgtccccacccaaatctcaccttgaattgtaataatccccacgtgtcatgggcaggccaggtggggataactgaatcatggtggcggttttcccaatactgttctcatggtaatgagtaagtctcatgagatctgatggttttataaatggaagttc

SEQ ID NO: 136091 - DNA, 560 bp, Homo sapiens
gaatgcaaagtagcttgaaccaccttgctgaccaatcttaggtatcatggttacctctgtggaagcacaaggtgggtatttgtttagacttgatccttcctgggacaaagtgctggtcaggatagtaaagggagattaaatgtacttaaatgtgcttccagaagacaggtatgtcatcataaagaagaaagggctattagctcctgacctacttagaaaaagtgtaactaaagtggaaccaggaattgtgtgagatctgcctatgtcctgttctctctctctcagggagagcagagggcaggaggtttcaccaggagctcacctgactctctcctaggcacctatgtttctgactttccttagatacaaccagaaagctaacacacttagatacttggagacatttgaaacaactcgacagccagttcactatccttggctacccaactgtttgggagagtaggaatgctccagaagaaaattgaatcggcaccactttcccattttgacccttgagaaaagaaagaaagaaaatcagcatttattgagtaatttgcctt

SEQ ID NO: 136092 - DNA, 197 bp, Homo sapiens
acattcaaagatcacgaattaaatattcagaggaccattgtttcatttttgaattaaagtctatgtctgtttttctaaaattggtattcaaatctcttaagaactacagtgtgtattccataggttaactttttgcttccccatccctctaatgggatccttgtccagaacctggccttatgccttaggccttgtta

SEQ ID NO: 136093 - DNA, 283 bp, Homo sapiens
cagagagtcagtgaagtgactgcagtgaagccaggatcatgactcaggccaggccacactctctccacgttgttgttattagaacctcactatacaaatgagcatccgtgacaacaggctggccaaccatcccagtttgcctgagattgagaaggttcccaggatgcaggacttccaggattttggtatttggttttgtctttgtttgtttgtttagagacatggttttgctctgttgcccaggctggagtgcacaatcatacctcattgaagcctcaaactc

SEQ ID NO: 136094 - DNA, 493 bp, Homo sapiens
cagaagagacaaaaacagcatcaatgaagagcaatcatagaaggttcacagttgcctcagaaccaattcaacaattcatagggggttggcatcacataaacagctgggaaaaagcagttaaatgattttctacatgctcttagggagagactgtgtctaatctgatgcagttgctccaaaggagcgcagctaatgacatctacaccaaatatcagttcaataaattgcttcctttcattaatctgagtgtcggtgtctgcattaacggtgttaacacagcagaaggtctaaaggagagataataaggacctgtttttagtgacatgtgggggcggccctgtgaaaacaagcaaatatataactggtcccttgactctggtgaatcaaaaccatttcatttattcattctgtcactccaaaattattctttgagtgactactatgtgcctggtcctgggctatgtcctcatgtaccaatggacaaagggccttc

SEQ ID NO: 136095 - DNA, 223 bp, Homo sapiens
ctctggtcacaagagcttcaggtggggcaatcccctgttcacttgtcactcctatttagctgtaagtgtgtagagttcaagactgctcttttatcttcagtgtctttcatactgcctggctcagactagctttcggaaaatatttcctttttttttttttcccctgagacggagtcttgctctgtcgcccaggctggagtgcagtggcatgatcttggctcat

SEQ ID NO: 136096 - DNA, 659 bp, Homo sapiens
aggctgtgttctgtaggcagtaggatggcatgcccagagctttgtgtgtgcacgtgcgtgcatgtttaatcactattgcacctcagcttaggctggtttagaaagagaaggcactacctaaacgaaaaccaaaccggaattcatatatggtgggtgtccatgaagtttccttatttccctttctacatggaagacttgctgaaggcagggattgtatcttcctgacctttgtatctcccatgatgtatgtcacacagaaatgaggaaggcttcaagggaaaggaaccagtttgactgcagctacaacccaagaagagatggaaagactgtaatcagccgagtagctacactgggaaggtgattaaagagctttcattttaaaaggctcgaggtccagagggtttcatgggtgtcctctgtctgacctttaatgaacaggtggctccagtgtatttaaactattccggaccataaagaagacggaaatttctataactcatatcatgaatccaacacaagcttaatagcaaaagatgacataaagaaattattgacgattctcctgaatgaacatagacacaaatactagcaaactgcatgtagcagtgtgtgaataaaacaattaagacttattctaggactataagggtagatgtgta

SEQ ID NO: 136097 - DNA, 307 bp, Homo sapiens
agtggctttcctttttttccccctttcatttttttccttacatttcattattctgtatggcatatgcccgctttacctatttcagcctgaaggataaatcttagatttacttaattgctttgttcgcctacatcgttgccattctctatgccctgtaacttcagtccacctgacttctagaatagagagccagggtaaacacaatattcctggcatttcaccttccaatgccccacaattcatatgaaatgtcatcttctttctgtaggagacagcatggaagaggaagactctgtcttaaaaaaaa

SEQ ID NO: 136098 - DNA, 622 bp, Homo sapiens
gttaaaaatgaaattatagaaaaatatttattgacatgggtaagtgtttacaataaacagtgttaaatgaaaaaaattaaatcaaatataccatatgatcctatttttacaaaaatgtacatatgtgattatatacatgcatagaaaatgtgaacgtttaaatacccaaatgtcaactgtggttatctctgagtggtgtgattacaggagagttttattttattctctttgcttatctgcatttattatattgagcatgttttcatgcataataagataatcagtaaaaggtattaaaatatacttctgttctatttcatgttgtgaaagttaaatgtcgtaccatttttcctcttagattgtaattatccttctatattcatccaactgttttgatccatgaattggtttagttggaagtaattagaaattctcactcaggtcagaaaagacaaagctgtaaagagctgtgttagttcataactcttgccccacctagaagatacaatttcagtttgctaacagatgagatgataaatggaatatagatttcaagttgactttattcttctactctaactaatcttgttattctgcctaagatttcaggtaatgttactcc

SEQ ID NO: 136099 - DNA, 378 bp, Homo sapiens
aaaagtagactgactagttataatagagtgagatatgaccagctgccaaatctagaaagtagtttgtttggtatagttttgttttgaaggttttactgaacagtccctccaaaatatttttttaaaacatacagcactattaagggtaatttatttactttctgacactactttttaaaataacattttatttttgttttttttttttttccataaaagctgggaagtgttgcaactgagaagctaagtaccacgtttattttagaggcagtaaacacagcctaaggccctacttataattatgacaggaaaaagactcattttggcttcatatggttttgagtcacaaaaacacatctgcactctacctttcctaga

SEQ ID NO: 136100 - DNA, 544 bp, Homo sapiens
ttcctaacttgggttccctggtgttttctgtctcccctaatgggtataatcaatccctgcaatttatctatagttcagcccctgcccatgggccacatactcttaaaattaatggttcttcattattaggcacacttatatgtgtgaaagtttgcaggcaagacatgtttgacttatcttccactttgtcctaattaaatcctactgataggattctcacacaatcactctccccagtaaatatgcaagcatccaaagaacacatgaaaacgatggttataagaatcatattcatttctgagtattatttacttaagtctaaaaaaatagctgaatgatacataaaaatgcagagaacctctagggggaaatggcaacacaacagagtattaataaaatagaattgcaagtctgaaaaaaccctatgatgacaaagatggacagagtgcagtcccgtgttccttcacaatggggatatactctgaaaaatgcatccttaggcaatttcatcattatgcaggcatcacagtgtacttacacaaac

SEQ ID NO: 136101 - DNA, 456 bp, Homo sapiens
aaaaagtcataggacaaaacaaggtgagaatggtctcatgaaaaccaaagatatagagtgtttctagaatgaaggattcattgaatgctgctaagaaaaagatgagatgaggaatgaaaacatcagggggactaatgaacaggggcactactgctgaaaccatacagtgtctttaagatgcagaagtagggttgaaaccacactgaagtaggtgacactctcttcttccttatccgggaatgagttggttgttggtgatcatcagtctgatccactccaagagagatcgtagcagggtccagtctgtgctctcctgcgatcattcgccatgactagaagttaaaactacacaaacgcgcgatcaaaacccgggacccgcacgcccagatgaccgggacgaggccatacttcacatcttctctcacagactcacaattacgcaacggtcacctcaaa

SEQ ID NO: 136102 - DNA, 531 bp, Homo sapiens
cacaaaggccatgagtccttggctctctatgttccaagtcaagcacacgttcaagtgggggcctcgtgatccaagtggggccacattttctcccctactccaaaccccatacctattccccaagttacagaaaattttgatgggtctgagaaaatggggttacatggggtaggggatgacatgagtgtaaagaggatagaaagaggctgtggttctaggactcacctctccagcctaatgtactattagcctcccataagcacgctgtgctgccataattcccagcaatttacaaatttaccaggaacattcccctcctgtgtctttgctcaggttccttgttcaaacaagagtgcctgcccttctctatcctatgtcctcctatagctgcacaactcactcatgtcttaattagattacatggctatgttttggttccttttttacctcgtatgtcttatctcccaacaaaactgaccacttggtgggcaatgacaatgtcccaaatcctgtgtttcttgcaacgcttag

SEQ ID NO: 136103 - DNA, 286 bp, Homo sapiens
ttgggcctgactcacactttcgaagcaagcaacgcttgcacactctcaagaaacacaattaaaatgtactgtgaagaaaggaaacatcactaatccgtcactaattcatatgcacttagaacatccctcagcctagtagacaagcagactgcctgtggatatggagaggtctcatttggctaaacgttgcttaaaagcaaaaccaattcttaacatacatccgaattctcaattctgtcatagattgaatctgtgctcactatggcaaggacaaaaaaatttcttt

SEQ ID NO: 136104 - DNA, 400 bp, Homo sapiens
ttaaactgtatgttgactccctacttggccattattaagtgctacacacttttttttttctttaagagactggatcttgctatgtcgcccaagctggggtgcagtggctattcacaggtaatcaggacacactacagcctccaactcttgggctcaagcaatcctcctgcctcaaggctcctgagtagctgggactacagaacacgccactgtgctcagctaaatgctacccctacgtatacttcttactttctctttaatctttgtagatgagaaggcaaaatataatggtgcctaggcctcagctaaatgctacccctacgtatacttcttactttctctttaatctttgtagatgagaaggcaaaatataatggtgcctaggccaaaaaatacattt

SEQ ID NO: 136105 - DNA, 579 bp, Homo sapiens
gttcaggaggctgaggcgggaggattgcttaagcccaggaggtcaaggctgcggcgagctgagctatactgcattcaagcctgggcaacagaatgaggctctgtctcaaaaaagaaaagaaaagagaagagaagaaaaataacacaagtttgttatcttgcagtttccatgggtcaggagttggaacccaggctagctgggtccttggctcaggcaactcaccaggtagaaatcaaggcatcaaccaaggttctagtttcaccagaaatgcagggtcctcttccacgctcactggtggttggcaggattcattccttgtggttgaaggacgaaggtcgcgttttctagctggttcttctccggctgtcactctcagttcccagtagacctctcttgggtcctatccacgtggctatctcacaacttcaaagccaacaaaagaatctctgctttttctaaagtgaagtcttgtatacactctcaggagtgactgactgtcttgtctttttgctatcaatcaaaagctgtgctccctctgaaggttctggggggcaaccaggggagtgacagcccatcata

SEQ ID NO: 136106 - DNA, 403 bp, Homo sapiens
tgggcctcaggtgcgagcagcgcatcggcccgtttctcattctgttatgactcctttttcctaggataaaatttggataaaataggagtcaagactgaggctcaggttttacctctgaaaactcttggctcaaagacccttaataatctgactcctgcttatctttccaaaataatttcttgccgttctcccttggtacttggcttaaactctcaacaccctctctgccccttagttgcagctcgcccctgagttagcagctcgcccctgagttagcagctcgcccctgagttagcagctcgcccctgagctgcagctcgcccctgagttagatgcagctcgcccctgagttagcagctcgcctgagttagcagctcgcctgagttagcagctcgcccctgag

SEQ ID NO: 136107 - DNA, 594 bp, Homo sapiens
tgggcctcaggtgcgagcagcgcatcggcccgtttctcattctgttatgactcctttttcctaggataaaatttggataaaataggagtcaagactgaggctcaggttttacctctgaaaactcttggctcaaagacccttaataatctgactcctgcttatctttccaaaataatttcttgccgttctcccttggtacttggcttaaactctcaacaccctctctgccccttagtactttgacttgtgtaacttccacttcctcacatctgccaaatactagtttagagttaattccctcttacaaatccctgatcctctgtgatgaccttcgtatgtgctttcattgcattatgtacttaccatcaatttgtgtgtttatactggactgcaacctcggacgcaggactgtgtcttgttcatttcattcctaaaacttagcacgttgcacgacacttaaaaagaggcgcttagtaattgctgggttaaattgagttgctagtaatggatttattattattattattattattattattattattattattattattattattattattttgaaatggagtcttgctgtcaccc

SEQ ID NO: 136108 - DNA, 216 bp, Homo sapiens
actgtaccatctgtgggcagtggggcatcccccggctgaccagcccttcagacccagctcagaccacagctcccatgggcttccccttcctcaccagctccgtctccacccttgtctctgtggggcagtctttcctcatagcagcggcttctccatccctctctgcttggatcattccagaaggctctggatatctctttcccatgcctttccctt

SEQ ID NO: 136109 - DNA, 404 bp, Homo sapiens
tgtggttccaaagatgacagaagagccttttaatgtcattaattaggcaagcttactaaaaatatatatatcctgctgttaatgatcatatgatagttgacagttcaggttcaatatacgtctctacaacagggtccaacccaaacattatgaatacttcagagcacttgacaaaagtgttttagtgtaattatatttttgaactataatttagatattagtttataagcaactttgggtgtgttttagattgataatgtatgtccccttccttacatgtttctatgatatagctcagtgcttaatctctagctttttgcatattaagcctcctgtagtatttcttcaatttatgaatgaccaaacaaaccaaggtgtgtcagagtaaattgctttagtactag

SEQ ID NO: 136110 - DNA, 640 bp, Homo sapiens
gtcataaaaaagaatgaaatcctgtcatttttagcaacatggagggaactgtgggtcataatgtcaggtgaaataaaccaggcacagaaagtcaaatattacatgttctcactcataggtgggagtttaaaaagtagatctcatggaggtggagactgaaatcatggtaaacagaggctgggaaggtgtattcgtccattatcacactgctataaagaatactacctgagactgggtaattataaaggaaggaggtttaattgactcgtagttctgcaggcttaacagaaagcatggatgggaggcctcaggaaacttacagtcatggtggaaggtgaaggggaagcaggtaccttcttcacaatgcatcaagagggagtgtgtgcaagaacaatgaagtgcccctctttaaaaccatcagctctcatgagaactcactccctatctcgagaacagcatgggagaaacagcccccattatccaatcacctcccacctggtccctcccctgacatgtggggattacaattcaagatgtgatttgggttggaacacagagccaaaccacatcagaaggaaaaggggaaagcgggtagatgaagtgaagctagttaatgggtacaaaaacgcagttagaaaaa

SEQ ID NO: 136111 - DNA, 739 bp, Homo sapiens
caagtaggaaacggaagatcactgctcactgtctgcatatagactctggcctcgtttctcaaagccagaggcacctacacaaagaatgtctgtcaatccagagtggcgaagaaccaactgtactggtttttaacatttccctgtgggaacgaaacctagcaaattaatgatatcctctgcaatggagtacggagaaaatccacttttccattcttacttgccacagagcttgggagaatccagccaattaatggtacaatctctattagaggtaaaatgaaggagttgcagtgtgagggcagatgtgatgtctatggagctacaaccatcctgcaaccagaaggaaagaggctaaagtttccaggagccatgaggaacataagaatagagccaactgagagggcttatgagcagtgagatggatcttggtgacatagttaatacctggatcaagctatgcctgaagctagttaaccatgtacttttcaattacaccaaccaacaaactctttttacgtaagtcaatttaagttgggttttctgttccttataaatagaagaacactgagggatacctagattcactatgtagatgctggtttataggctaagtctctgattgagaggcctaccttctcctgcaacacagatacatggtactgtaaaaattgtgccatcttgaagatgacaagtagacactagcagaagtcctttaatagctgatcccttttgtaacctc

SEQ ID NO: 136112 - DNA, 533 bp, Homo sapiens
caagtaggaaacggaagatcactgctcactgtctgcatatagactctggcctcgtttctcaaagccagaggcacctacacaaagaatgtctgtcaatccagagtggcgaagaaccaactgtactggtttttaacatttccctgtgggaacgaaacctagcaaattaatgatatcctctgcaatggagtacggagaaaatccacttttccattcttacttgccacagagcttgggagaatccagccaattaatggtacaatctctattagaggtaaaatgaaggtcagtgaagttataaatataaaaggggacaatgcctactggccagcatccatctgcttccatggggtctttaataactgttcagggactaccaagcaaaaaatgtgcagtaccacattctgagaaacccaccattttaagtagcttcctgattttcactataaattctactctttcctttcttgatttggttgtgtcagccctatgacagcttgtctccacaggacctaagctgggagagatgagttaca

SEQ ID NO: 136113 - DNA, 771 bp, Homo sapiens
caatcacagctacctatgtgacagtgagataacagtgatttttgaaagcctctgttgtttttccggctacaagacatctaaggcggcatggacttcctagaaagttctttttacagaccattttcatctcagagctgcctcaatcgccaaagataagcgggagctatttgcgtctggtgatgctctaactccaagtgatttctcttcataggaaatgttcatgatgtcaccctcaaagataaaagcttgttggaattgttaacaattgactttctcatttataaaggcaataccttgcttagtcattttctgcgtctgtgtcctctacttcctgacctcccattcagagcttgctttatgtctcccagattactggccctgttatcgtacctagcgccagacccagtacctctacaaaaaaaaaaaaaaaaaaaaaaaaaaatttggggggggttgggccttaaaaaatttcataaaccactcgtggggcgcgggcccaagggtaggtacacgggcacactggtccaaggaaccgggccagacaggcgggtcccccataaaagcgcgggggaccgaggttgtacaacccaagggggctgaggcacacgggaccacaagagagccacaagccgataatcgccccccggcggggcgtaaacagaagaaggacacacgacaacacgaaacagcacacacacaacagaccaactacaacgacacgacacatacacaacgaaacacatgaccagtgaaagaaaaggcaagacaaca

SEQ ID NO: 136114 - DNA, 226 bp, Homo sapiens
agggtgggactgggactgcatcccaagagcagtggcattgagcaattgtagtacatctttatgcctacgtgtgccccagaatcttcagggagttgcctgtcttcaagagagagacagacttaagccatgaggctacaggcagaccagcatgaaataaaaatagagagcccttctagaattctctggaaggcataagctctaaagtcagtgctggtggtgccaaagt

SEQ ID NO: 136115 - DNA, 274 bp, Homo sapiens
ccacccgcacggtaaatacaccacggagcccccaaagaaggcaaacttacttgaaatattcctgttctattacctccctcaaacaattaagctgctgaaagcgcatgtgagtgaccccagagacagaattgaatgcagaaagaaccacagattattgtgtgtgttaaattatgtatggacagctttctttgtgttgaagaactgtaagatagtaaaaaatggaaaggagcctgactatatatatgtatatgtatacacatacacacatatttcc

SEQ ID NO: 136116 - DNA, 493 bp, Homo sapiens
gattgggctgaggttgggaattcaagaccagcctggccaaaaggtgaaaccctatctctaccaataatacgaaaaattagccaggcgtggtggttcatgcctgtaatcccagctacttgggacaggcgtggtggttcatgcctgtaatcccagctacttgggaggctgaggcaggagaatcgtttgaacctgggaggcggaggttgcactgagccgagatcgcgccattgcactccagcctgggggacagattgagactccatcaaaaagagaaaagaaaaccacaaaaaaactcagacaattctataatagagggagaatacgcatgcaacccagggatttttctcagataccctccccattctcaaatagcatgtgctctaagctcctatggtaaaagcttcatgcccctgcaaaactcacacacctgatcccactcctcaagcacttcatggagaagcagcagctcccagctctataacagataggggat

SEQ ID NO: 136117 - DNA, 610 bp, Homo sapiens
aagtactgtttcaaattaatggttcctaagcttatctgaataaaaaaaaaaaagcacttggagagttcattaaaaacccacattggttaccagaggctggaatagaaggactggggagatattagtcaaaggatataaaatttcagttagatagaaggaataaattcaagagatctactgtacaacatggtgactacaattaataacaatgtattatatatttaaaaattgcagagagcagattttatgtgttctcactacaaagaatgatgtgtatattaaatagcttgatttagcccttccacaatgtatacatatcaaacaaatcatcatgttgtataccatagatatatacaattttgcttgttaattaaaatgaagaaacaaaaaacacaaactcctgagtcctcactgtgatatacttaatcagaatttccaaggtagacatctagtgatctgtgtatttaacaaacacatctaggtgcttcatatcatggagaaaaatggaaaacacagttctgaaacaattaattcatggagcatgacccagtatcattgtgggataagtttccttccgcatcaatgtaggtctggatatttcccttatgga

SEQ ID NO: 136118 - DNA, 259 bp, Homo sapiens
ccccgcctgtccaataccccatctcaataatgggctcatatcaggcagggccagggttcttctcttcccataggccaacacactataatatttgctttccttccttcctttccaaagcctaccagattagattgctggagtcccatccagctcactgagacagatggaaaacggaaagtaaggcaacccaaactgttcatggtggaaaaagagagggggcagagcaacccaacgtcccagcacccagatcctcttttcc

SEQ ID NO: 136119 - DNA, 792 bp, Homo sapiens
cacggtggctcacgcctgtaatcccaccactttggaaggacgaggtgggtggatcacaaggtcaagagtttgagaacagtctggccaacatggtgaaatcctgtctctactaaaaatacaaaaattagctgggcatggtggtgcatgcctatattcccagctacacgggatgctgaggcaggagagttgcttgaacccaggaggcagaggttgcagtgagccaagatcacgtcaccgcactccagcctgggtgacagagcaatactccatctcaaaaaaataaataataataatttttcaccgataagatttgagcattcacaattcaacatataacacatttcaaaattaattacacattagtaaacagtgcatacaatgaatcagctcacaggcctctcaatgataagatcacttttaacttttttatcttttcgctacaagttctaccagctgcattcagacaatttttatagaaacaaagactataaataatttttacacagacactacaataccggcttccaggagaccatctactctccttggctggaagcccagaaaataaagaggtgcgagacacaccacgagaacaactggcaccagtaagcacgagtttgtacttgctttcagccatcctctggggttacaaaaaaggtacctttaacaataattaggcaccaattaaacagatgatttcaatcttacctcttgctgcctaaccttccaaactttttcaacaggtgacatacactattggaccccaaagaaactatcttatcttccccctaa

SEQ ID NO: 136120 - DNA, 187 bp, Homo sapiens
cttttttcttaagcacagcctcaggggagcctgccccatccagatattaccgttgccccgattctgcccatagctcgcgtggctgggggcagtgggaggtgtgtctcctactgaggacgaggagtcgtcggacttcagtcccgcgcagccacgttggaaacggcgacctagcggcttggcaacccag

SEQ ID NO: 136121 - DNA, 298 bp, Homo sapiens
agtcatctatctatctatctatatagaaaaacatttttaagacgttgggatatgtgattgtgaggactggcaagttcaaaatctgcaaggctggccaacagctggaaattctggcaagaatgggtgttgcagtctttcttgggttaaaggcagtctggatgatgaattcttttctcccagagagacctcttttcttttaaggatttcaactgattggatggagtctatgcatattatggagggtaatctgcttttctcaaggactactaatatacatgttaatcacgtctctaaaact

SEQ ID NO: 136122 - DNA, 449 bp, Homo sapiens
cctggctgaggcgagcaccagctgcaggaacctcgacatctggctaagcagacaggagcaggggaagcaaggggtccgggttggcctgcaaagaccagacgtcaggtacctagagacctcagtgaaacccctcccaccaagaacaacctcacccactgccattcactgaacacctcctgcttaccaggcatgtgacctcatttaatcctcacatttaatctccgaaaaggagggcctagtatcatcctcacaaccattcatccaggaggcgacagctgggatgtaaaaaccaggtgtgtctgagttgtgactttgacatgggtctctaagtaactcaaatcctgtatctcagcctggaggcaatggggtgtcagggaaggcttcctagaggaggtgacacctgcaccggatctcttaggatgataaaatgaatccagccagtgagggag

SEQ ID NO: 136123 - DNA, 418 bp, Homo sapiens
catagaagctgcatggtgagtgcatattgagcaagttcccatccgaattgttctgctgtctcagtgaatactatggggcagatcagctgctctgagtgtgtgtattgggcatgagacttgggtatgggcaagggggtgaagtggaataggggtttgaggaaacccaaagaggttttaaatagctgctgtacaaatcccacttctctgaatcactttatctcctttcccagtgtgcctacagatgcctgctgctgttgtccataacagaaaacaattatgttaacaggcaaatctccaactatgggaaaatgagctgataaattcagctacattaactcaataaatcattttggcaagaagaggctattctctagccacgtctcatgagatttatctctgggcttgacaaattctgaac

SEQ ID NO: 136124 - DNA, 698 bp, Homo sapiens
gggtccctggggggcatcttagaattctgcctaccacagagagtgtgtcatgaattaaaacagaaagtacatgaagaagggcaatttcattggggttaaatattgagttttgtcttcaaatgaatattgtttgaaatatctgtgtcatgtggtagagaatactgtatttggtgactttctacatagtacctatgggctctgacacacattttgtgtcagctcaaatcctacaaaatcatcttcctaatcactgtagtcacccaatggaacaaaagttgtaattgcatggatgacaagagcatcttaaaatgtctttgcatcgttacaatcttaatgtaaaaatttcatcttatatgctttcacttcacttattgttttgtgtctatgacacacatatacacacacatcttgaaataatataaaattatttcacattacatatttgcttgcaggtagtgtgagatattcttgtgaaaggtatatgtacaaaatgcttcttttacatattttgccaacagtatacatttattccccaatgctaatggattctctggcttcaggacagaaactaaaacacattctttcttacactttgaattttaagaaaaagtatctttataatgatatgttattatgtactgctacagagtgaacctcatgcagtaaaatatagtttatgtgatgcctgatactacaca

SEQ ID NO: 136125 - DNA, 331 bp, Homo sapiens
ggtgccagagcatggaggggaatcaggggtaaataatccatcccagggaggcagagaggcagcaggaggcgggactgtacgggagccaaaacccctcgtccccagtgcatgcttcattgtctcatcacacttcgcttacaaaacataatttcaaagataaatttgttaacaatttcaagataaatactgtagagtacaggacccttctaagcactgcctctttccccaggctctcgacacctattgactctgcccccaaaccagagttctgacactagaaagaattcatgaacaattatcatgttaacatccaaactctcttgctttcttc

SEQ ID NO: 136126 - DNA, 413 bp, Homo sapiens
agaaagtgttcagtataagagcagtgaagtcttctaaatagtttctagagcaataaggcaaacaattagaactcagaataaaataccatctgtgtgctaactgtgccagatctaacagcacacagtttttctttttttctttttaagacaggtaatgcacagggtattagcatacatttttaagaaaaacaaattctaagttgtgagtggtttatttattgaatctttaagaaaccgcttaatccaacagaaaataaatgtgtttcccagctgaacaatgcatactcccctcaaaaaaagacacatacgtgtgtaactattttaacagtctgcaatctattctaattataatatagctaagcccaagttgctcctgatcactttcttcccagatccagcagataaggtgtgtt

SEQ ID NO: 136127 - DNA, 687 bp, Homo sapiens
ccaattttctgtacggaccaaaaccaaaggataaaaaaggcaaaaggtagcatgagaggacaccgaactgtactccaggggaagcagacaagtgagaattcactcccaacttctacaaccccactcaccatagctgaacgggaacccacacactccactgttgtctaagtaactggatcacgtctgagatccgtgtacacatcggcacgtggatctcagctctgcacttgttcttgaccccagggctttgaagttttgtcagctaaggcaagggtattggaaaatgctaatccagtctcagtggttaccggtgcagctcaccttacacacctgtgccacagaaaggccgtgtgagaaaggccatgttgagagccacactttgggagatgggcttattttgtaaaactaaagtgtccaaatataaagagctcctacaaataaacaacaccccaatggaaaaacataggatatggaaaaaaaaaaagtttacaaaacacaaatgattcttaagtatataaagagttgctcttctggccaggcgccagtggctcacacctgtaatcccggcaccctgggaagccgatgtgggtggatcacctgaggtcaggagttcaagaccagcctggccaacattgtgaaaccccatctctactaaaaaaatagaaaaaattagccggtcgtggtggt

SEQ ID NO: 136128 - DNA, 792 bp, Homo sapiens
gtgcccgtgacctggcaccatatggaggatggtttccatggagtgctcaggaccattgacatgagcttcttgcactttccctgctccatgagaattctgagtgcattagttcaatttgtaaagggactgtgaccatctttcttctctgctggtactgcggtgtggattccactggcatccagcctcccacagggctctctgttgctgatttaggtggtgcatagtggggctagggagggggtagaggttgctgtcacctttctggtccaggttttagaaccatacaatgcatgctcctgatgtccagaggacgtggtagaaaagacaggtttggaggtgggagtgtggctgtctctattctctgttgggaaaacctgggctgacaatattcagtggccatttgtgggagtgaatcagccggtaagagctgttctcagcctccctaaggggcagttcaggctcccagattgatccagactgtgtgtgactttcgtccatttgacttgactttggaatagcacaagggcatcatgtacttcacgaggctttcccaatgtggctcagaggcaggagctctgatgctctgggctgctgtgaggtggtggtggtggtggagaaactggcttcacccacctagtattctgtgaacagtagtgacttttcccgctgtttctcagcctgtgggatcagagtcttcactgtctgggctggaaactttaagatagaatggatagagcttccacagtggttggcatctagtggtggatgaagcacagcgtgcagctgcccgac

SEQ ID NO: 136129 - DNA, 346 bp, Homo sapiens
tcatacacaagagaaggccatgtgaggacatggcaagaaagcagctttctgcaacccaggaagagagcccacactagaaaccaaccctgatgacactgtgatcttgaatttgtggcctccagaactgtgagaaaattaatttctgtttttaagctacctgtctatgatattttgctatagcaaccctagcaaactaatacagtcccgtttcactttttaaaagattaaaaatacaaggtgttaaatttaaagataaaaatacaatgaaacattttttgagatcatagaagagagagacaccatttattataaaaacaatgtgtattttaaaagaaggggctgggcg

SEQ ID NO: 136130 - DNA, 685 bp, Homo sapiens
atagaatggattcctttgatggggagagcctggaagtagagaggtcaattcggagacttttgagaacaaatgaaactcaaaggactaaactgaattagtaccatgagaataaagagaaagactgataggcattgatggttgattggatattgggagaagatagagaaggataagttaaagattattccaagaggtatgggagaagaatgaaagggaagaaaaatctgtagaataaaataatgctttttatatttgaagcaacagttctgcatctaatttgaaatgtccatttgtcagatgctgtatgggttggattgtatccccccaaaagatatggtgaagtcctaactcccaatccctcagaatgtgaccttatttggaaatagggtcttgcagatgtaagtagctgagattactccagtatggtagacccttactctgatgtggctagtgtccttataagaaaaaaagacatacagagacagagacaaacatggagaatatggccacatgatggtagaaccagatactgaaatgatgcatgtcaaggaataccaatgattgccagcaaaaaccagtagccagaaaaggcaaggaaggattctcccttacaggtttcagagagagtatggccctgctgataccttcatttcaaacttctaccctccagaaattgtgatatgat

SEQ ID NO: 136131 - DNA, 285 bp, Homo sapiens
tattatctttatcgaacacatcctattttttgcccactatattcgttgcacatcagttaaggtggtgaacaggaagtatgaatgaaaggctttggtgaggtggtatattagtttttccacaaacaaaaagtggtttacagaaaatttcaaaaatttactttgaaaaataagtcacactggtaagtatgtacttcttcatgtaaatatgcatttgtatttaataagattacaaaaatgctaaattatcactttaggctgaataatccatagggacccagaagatca

SEQ ID NO: 136132 - DNA, 600 bp, Homo sapiens
gtaagatgacatctcattctggttttggtttgcatttctctgatgactggtgatgctgagcttttcttcatatacgtgtaggccatgtgtatgtcttcttttaaaaaaagtctattcatgtctttgcccaccttttaatgggatcttcttgtttttgctgttgttgaagtgtctgaattccttgtatattctggatatcagttccctatcagataaatagtttgcaaacattttctctcattctacaggctgtctcttcaatctcctgctgatttcttttgctctgctgaagctttttggtttcgataaggcccatttgtctatttctgttttagttgcctgtgtttttgaggtcttagtcactgattctttgcctatatcaatgtccagaagagttttccctaggttttattctagtatttttatagtttcaggtcttaacgtttaagtctttaatccatcttgagttgattttttgtatatggtgagagactggggtccaatttcattcttatgcacagggcaatccaatttttccagcaccatttctttaagagggtatcctttctctgatgtatgttgttggtagcgttgtcaaag

SEQ ID NO: 136133 - DNA, 363 bp, Homo sapiens
gagcattatggacctttcgctgagtttcacttggacatatgaacttctgatctcaactgactcatttagttggagcagggaatcccaatgcctttggaaatagaaaatggatatgactcaggatgaaacatcagtggaaacagacctttcaagattttttaaaaaaatataactactggttagcatagtcataaaattagatagttcttcttccttatttagaaaacagaatacagaccgggtgtggtggctcatgcctataatcccagcactttgggaggctgaggcaggcagatgatttgaggtcaggagttcaagaccagcctgaccaacatggtgaaatcctgtctctactaaaaatac

SEQ ID NO: 136134 - DNA, 456 bp, Homo sapiens
gcaccaccatacccagctaatttttttgtatatttggtagagacagggtttcaccatgttgcctgggctgatctccaactcctgggctcaggagatccgccggcctcgacctcccaaaggtgtgaaccactgccctctgccttaacaaggtttaataggtgttaactattattacttttattatcacttgtactaatgttatctatttgtaagcttctcaagggccggtctcatcctcctcactgttctgatattagtacataatactcaaatggtggttgaaccaaaccaaagtgtccaggccaccactttacaagagtcaggtttccatcgatgggattttaaaatataagtcatattttcaaaatcagtaggatagcttgctatttacagaattcctgtagaaaattatttttgaaagattaatcatttcataattcaaatcacttatgtctc

SEQ ID NO: 136135 - DNA, 757 bp, Homo sapiens
  misc_feature (1)..(2): n is a, c, g, or t
nngcttctgtgcccggcctgaactgttaagtgtttgtgaagaattatttgggggcctatttgagagctgttatatggatcatcctcctggagagggttcttaagcctctgagaccgggtttggggctgaggctttctgacccacacaagtcatgctgacccctgaagggccgcaggccagatcttgccaggtgagcactttccccgctcacattcaggatagggcgagggggttggtaccgattcaccctcagggcctagatttgggggcttcagcttgctgcagataggtgctcccttcactctcacctgaggctgggctggagcctggtgtctgccccaccctgctggtcagccccctaggacctgagccccgtaagcctggactggccacgccctggggcagcagcactgggtgcttggcgctcacgaccttcctgggcccctgggtccctcacttctcccttgtttctaccttcctggcttgtcagattcccacagctcttaaggagaaattcagtatttactgcagcatgtgttttcagtgtgatggttcatctaggtaccctagcctgtcattgctggagttggaaatctctgttgtctgctgttgttttgtgaaacaagcgtgtgaggttataagtttccctcaacgtaccacactaaccacatttccctaagttttgatgtgtagtgttttcactgccattcagttcaaaatattttctcatttcaagtatgatgtcttctttgaaaaa

SEQ ID NO: 136136 - DNA, 327 bp, Homo sapiens
catcactggcatattatcaaatgcttcgaacaaatgaactgagcaaacgtttaagatgggccttctgaggttatgatgaggatggaaatgagttaacctcagtgcatctgtgggtacatcgtaggtgttcagaagggcactctgccttcccagctccctcataagtagcccagtaaagggccgggtaggtaactatttcaatcagcaaagaagccaccccaatcctgggctctccaaaaaaaaacaactttcctccactcactcatcaggtggcccaccccactgggccagataactattggggttccttcccagcagcagggtatg

SEQ ID NO: 136137 - DNA, 784 bp, Homo sapiens
ccacggttgccaggaggcggacaggggcggctcctggggggctaccacctcgaggccgttccgccagaacttgagcgacttgggaaggcacagtgtcctgcccttgaagaggaacctgtgtcctggaggcagcagcctgggagctcctcctctgaggacaccgcagaggcgagtgactctggcggcgcagcgctggctttcccgtccgcagaggagagctgtggggctgggtgagctggaccagggagcacagctggctgctctcggcctccgatggggagtggacagcttagggggttgcccccgtgccagccagcctgctggtcactctgggcttcatcacaccctcacctgcctgcgcaggcacctagcactgcaggctggagcttctggccatgctggtcaacttccccaacgagcctctgctgcctgggaacagcaaggccagagctacaccgccctgcacttggcagccatgtaccttggagatggtgaagctgctagtgggaacataggacgccgatgttgacatcagggactacactgggaaaagggcctcccagcatgtgagtcagagcatcacagaagagattgagaccctgatgggagtcctggacaaggacgatggggagagcaccgccagcagcgggggtgagtactggaagatttaaaagctgccccctccatctcaccacctacaaactctcacacgtcctggaagatggggggaccctctccaccatcaccacttggctgaaggtggtccagacgtgaagccaaggat

SEQ ID NO: 136138 - DNA, 443 bp, Homo sapiens
  misc_feature (208)..(208): n is a, c, g, or t
atatggttatctctatatcttatgtctttaatattggattttgaaatactaaagatttaatcaggtaaatgtaacctagtgatctggtgaaaatcatctagatgtgaattggatgccttggtactgttttttatgcttctagttgacaattgggttttatcaatgtcttagacttcttgttgttggtataggctataccacctcacantgtagaacagcaaatgacatttttacagtatttttttgtaaagcaaactattttgtgccttgaatttggtatatgtgtattagtgaaacattgtaaaggtgaacttctacctctgtatctaaatgtataccatccacttgtaaatgactataaactattatgtgattgcttttttttttagaatgtctggttcaaatagtggccaaggtttaaggctgttaaaataagccaactg

SEQ ID NO: 136139 - DNA, 387 bp, Homo sapiens
cctgtcaagaatagacaggagctcataagcagagttcaaatttaaacgtgcacgggaatcatctggggatgttgttaaaatgcaggttctgattctgcaggtctggggtggggcctgaaataggcactttcagcaagctctcagctgatgctgatgctgctggtccagggactaatccttaagtagccaggccatagaggagctgtggttgaatcaggttagcctgattgttttatgttgttgttgttttcttttttttttttgagacggagtctcgctcgtcgcccaggctggagtgcagtggcacgatctcggctcgctgcaacctccgcctcctgggttcatgccattctcctgcctcagcctcccaagtagctgggactacag

SEQ ID NO: 136140 - DNA, 248 bp, Homo sapiens
tgcaaagatctttcccatcaaggcctcctcttttctggggggtggggaaaagggacccagcagacaatggagggcagtcctttggtcctgctccctcctgaacccctccccagtgcacaaccctccaggttcttaggtgtcgcgctctctgcaaactacaccacacactgcagcctgtcactctgatctcagctaacagtgcctcactcgcttcctgagccctgtccttagccccactacccaatcca

SEQ ID NO: 136141 - DNA, 794 bp, Homo sapiens
attgttaataatttttttttcatttacacacagctgtgttattaacatcagacttaacaacaatcatgaatcaaaaaggcacaacatgcacaaaatcactgcttggctgtggtaaagatcttgaagatacacatcccattctccattatagcaagtactttgtatacctgtatatatacatacacttagttatctgagctctgcttggcaagaaaattataccatactgaagatagaggtacaacaatcctcaagaaaaataaatatataatttaataatccataaaatataactggataatttttattttatgctaccaattgacatcatcccataggctgtaaaatcagatctccagatatttgtcaccaattgaatggacatgcacaaatcagaaacaggtacagaaccagaactagactttgctaagaaaactagactcattctggaaaaagaattagaaaacgttagaacgctttgagtcaaaaactaatgaccacatgggactgttttgtatcttggctgtatcaatgtcagtatactcactgtgatatacactacagttttgaaaaaggttatctttgagagaaactgaataaagggaacatgggctctttgtattatatcttacaactataaatgaatctacaatgatctcagaataaaactttaacttaaaaggtaaacaatcaacaatcagccacaaaggcagagatagtaaaactgtcctactactgtgtgtgtcagaaaaaggatccatcctgtaaacagcttccaaggtgttcttcttggt

SEQ ID NO: 136142 - DNA, 328 bp, Homo sapiens
tttaccaccctggtatattttaatctatgtagtcagagtcttctggaattccgaaagttttatcaattttattttcttcaaacccaaattttcttttggcccaagattttattgcaaatatgttatcagtctatctgttagcaagtactttatttgcctgatgtatttcttcaacaacttgcgggtcacattatttgcatttttcaacttctgcctttgatccaagagtgaagaatgctctttggctaacacggttcactccttcatctcatgttggccaattttagtttttctgatgcttttctgtaagtttgcatgcttttggctt

SEQ ID NO: 136143 - DNA, 325 bp, Homo sapiens
ctagaaggagtcctaaatgtggaaacaaaatcttgatatacaccaaaatagaacctccttaaagcataaatctcacaggacctacaaaacaatatcacaatgcaaaataaaccaaagtattaaggcaacaatacagaatggcagaatggataaaaaaatccaccaaccaagtatctgctgtcttcaagagactcacgtaacacataaggactcataaacttaaggtaaagggaaagggaaagatattctacccaaatggaaaccaaaactgagcaagagtagctattcttatatcagacaaaggagactctgatgcaacaatagt

SEQ ID NO: 136144 - DNA, 352 bp, Homo sapiens
agtacacaagcaacatgctatcattgcagatgccagaaagtaggatcacattgttgtgctatagatctccagaacttctttatcttgcaaaactcaaaaactctatcatttctcaaactcaaaactcaacaattctccattccctcttcctccaccccatggccaccaccattctactttgtctctatgaatttgaatactataggtatctcatataagtggaatcatccagtatttgtcatcttaagatttctttctttgtgtaacgttatcaaggttgatccacattgttgcgtgtgtcagaagttcccttctcttttaaaggctgaatatttcattgctttatagactg

SEQ ID NO: 136145 - DNA, 367 bp, Homo sapiens
agcaggagaatcacttgaacctgggaggcagaggttgcagtgagctgacatcgcgacactgcactccagcctgcgtaacagagtgagactccatctcaaaaagaaaagaaaaaaagtatagaaagttgacatctcaaaatgtaatcttacatatttacataaattatattcctcaaagaaaagctctctcctatctatatctcattccatataagttttctgtgagctaagaagctccccttcagattgcctgacctctagtcaaggttcttcatcgccatctaaatgtcagatttattctctatgtcttcttactaatagtgttttggtttaagtatgtggaaaataaagccaataagactatctg

SEQ ID NO: 136146 - DNA, 183 bp, Homo sapiens
gggatcacatttctctagagcaactatccaacatgaggcacaagaactaagtcgaactgggctaaaattgacaaaattaaagacaaaagaattatctcttttaaaaattggggcctactgtgctctgacagcatgctaaaggacaaccatcgtttggaaacattgtttcagaaccagagaaga

SEQ ID NO: 136147 - DNA, 411 bp, Homo sapiens
attgtgagacaagtaaccccttacccctcactctcctctatttttcttcaaagcatttgccacctggcacattatacatgttttattgtctgtctccctccactgcaaatataaattccttgatggcaggaacaaatacatacttcgcacatattaggcactcactaaatattcatcagatagatgggtaaacaaatcacaaaataggaaaagcctcaaagctactccttggcaaaattatagaacagtactcatctagtttctacacccttctctcacttaacggtatcatccattccttccccagacctcgaacgtcctctgctttttcacacacttttgcttatgacatcacctcttacaagccttcttagtaaagccccaccctctaaaacttctactttcttttct

SEQ ID NO: 136148 - DNA, 333 bp, Homo sapiens
ggagtgaagaggaggctgccgtgatgcgcagtccagagtgagcaggagtgacctcccactcttccacgccaggttcctctctctcccttctctgtcctgtgctttccgaaatggagctggctgacaccacgttttccatccttcaaaccaactatcttctgctgactcccctctcacctccaaaagctaggcctttctcaggggctccagttccttgatcccgcctctctgaagtcctgcagcaccggcccgtattgccatacatgcaggctgctcacacgactttcatggaatcataaaattggaagccaccccggaggcccatctagtgct

SEQ ID NO: 136149 - DNA, 437 bp, Homo sapiens
aaaatgagaatggaaatagaggtcggagtgaagtggatgtgcagaatactcaatatcattctgatttttttccccatgtggcactattaactttagccactctatttaaaattgcttattgtggtggggggtgggaggaggtggttagaaaatgtatgtttaacctattcacttgcctttatttcttgttccttaagttttttaatgctttctatgacatcgctatcccaatctctactatgcttgtgtcttctggtttacccccatgtttctttcatgccttctcccagaggagtgactcacagtttgcatatactagacccaaatttttagactacagccaaagtaaatccacgtacagacataggggaaacactgagattggggatgatcttattttgtttaatttctagaaaaccaagttaattgagataaag

SEQ ID NO: 136150 - DNA, 719 bp, Homo sapiens
cacagggctgcccggcttctgccccacagggctgcctggggtcctggccactttgggtgaggagaggatggctccagcctcctgaccttggaggctccacagacagaagacgccgccccgggacatgagggccctgcctggctttgaccctcctctgataacaggggacagccgatgccctgctgggcccacggggaacagaagccagtctgggctgggccatcccctgcaagtggtccactccccccaccggctgatggtggagtctaggctggcctggtgacatgtgggcctccagaggtgacagaaggaattttcaaacttccaaggccccagaggcctccacccctgcccaagcacagttcaaaccttcaagctcttgggggtacttttgtgatggctgggttggggctggtgcttcatcttctcttccagtcagtggagtgaaacagcaggtccatcttgcatgtctgtgtctgcagacggatggtccagggccatccctacaccctcctgtgctgggcccgcagggaagccagttctaccagcagtctgcaggtaacagggtcccaggccaggcgctccccttgaccccctgtgggtttgttcctgccacccgctctgcccctccctgggtgccccccacccccagatctcctgcaagatggacgtcagggtcctgggagaaaacagttctgtgctggggccgctttgactcc

SEQ ID NO: 136151 - DNA, 276 bp, Homo sapiens
attatgcctttataccaggaacaaaaatatgtgtcttaaaacattgtaatttaatagtttttactgttcacaatctgtattttttaacaatacacttccaaataaatcagaatttcaaagttcttgaagtatatagaccattagtggttcactgcctcacgctattcctacctacacacccctttctcctaacacatgcatatactttgcaaactacttgaaagcaggaattatctgaatcatctttctattttacaacacaattaataaactgct

SEQ ID NO: 136152 - DNA, 456 bp, Homo sapiens
acacagggtttgggataaaactggcttcaaggcaagaggctgtaaaacaggctgactgcttgaattgacaaaattcctatactccctggattccctccctgttggcctacaaatttccttccctggagatatgtcactcctcattcttgagaggtccttcttctgtaacttcatgctgattagggatgccgtgtccagagatattaggggagtgaaaatctctagacactaaatctaaatgtgttttgaggtctcccaagataggctgcaaaggctggtattgttggaagctgcagttgtaatttttctaatctggaagatacaaattttaccaagagatttaagatccagggaccaaacaacagtagtacaaacaataaagttagtagttctactaggggcagaatattaccaagtaattggtattgcccatttgatagcttcccaaatagtcag

SEQ ID NO: 136153 - DNA, 352 bp, Homo sapiens
tgggagatttcaatcacagggtcaggagattgaaaccatcctggctaaaacggtgaaacactatctctacaaaaaatacaaaaaagtagtcagacgtggtggcaggtgcctgtagtcccagctactcgggaggctgaggcatgagaatcccttgaacccgggaggcggaggttgcagtgagccgagatcgcgccactgcactccagcctgggcaacagagcgagactccatctcaaaaaaatatgtatatttttaaatttctcagttgtaacttctaacatggtgtacttggtagagataacccatatgaacaaaaatgctttggggtcctctttctaagagtgtaaaggga

SEQ ID NO: 136154 - DNA, 708 bp, Homo sapiens
tatcatcttcaccaattttaggtgtacagttaattcagtagcattaagtacatccacattgttgtgccactgtcgccaccatccatccaacagaacccctctcatcttccttccattcatttctaatagggactaattcactacaggaattgtttctaaccattcattgagaagtaacctagcatcaccctcccactggcagcacagaaagggggttaagtcagacacaaaggatttctctcacactcaggctgagggactttgtgatcacacataatcatgtagtgcctcagtatttgggttaatggccaaaagaactttgtgaatggaattaaacattatatgagcagcttcctcaagagaaattgctctagtctccataataactgaactcctggaggttctgacctttcaggttaaaatgtagttgcctctcagaggttaaaatctcctccttcttccttgctttctacttccttcctatttcttctcagcaacccctgtcctcacctcagtggcatgcacattactccaatcaaaagactcaatcattgatctttaattttcaaacttttgcaaagtagccttctaacagttgaaatcttaaacagcctctaacgtccaatgaatcccatatctagtccattctgggcacttcctgaagaagggaaattcagttgtctcatgatcacatgttgagccagctag

SEQ ID NO: 136155 - DNA, 414 bp, Homo sapiens
aggtgactcatttctaacattttgtctgtatcatcagctgaagtagtttttttgatgctggtgttaatttcttaccattctacaaattgcatttaatttctcatctaaactctaaaaattagtctgttttaaagccctgagtgagatatttaaagccagctttttccacagttttctcataaaaatgataagcataaaataaaaggtgctggcaaatgtgggaatagactcatttcaaaaagcaaaaaattgacactatcagacttaaaatatactacaaacctatagtagccaaaacagcatgatactggcataaaaacagacacatagaccaatgaagcagaatagacaatgcaaactttaatccacatatctacagccaactgatttttgacgaaggtgcaaagaacgctc

SEQ ID NO: 136156 - DNA, 390 bp, Homo sapiens
caaaactatagtacaatagcacaaacaggatattgacattgatgtagtcaagatacagacaatcctaccactacaaggatccctcctcttggccttttataactatacccgcttccctcctgccccacctctgccctcttaacccatggcagcaacttatctgttctccatttgtgtaactttataatgtcaagaatgttatatgaatggaataatacagtatgtaaccttttgggattggttttattcacccagtataattcgctggagatttcattcaggtggttttgtttatcaatagtttattcctctgtattgctaaatagtaccagttgagtatccctaatccaaaaatacaaaatacaaaatgctgtaagatctgaaactttt

SEQ ID NO: 136157 - DNA, 378 bp, Homo sapiens
gtcttctgtgcagcttcctcacatcttaaatggaatatttatgtggccagatagtttcctacctcaccctctctgtttttcctcaacttcctggaaaagtgtgggaagttcttgccacttactttaggtccatatacaacattgcagtttatcacaagcttcaaggagatttggagctttcgagtctctccttccatgtcactttctattccctgcctgggattccctccagtaggatgacataacattagagattggcattgactggggtgagtgttgaattaaagacacacaggtagacacatctgggagaccaagaaaccttagctcaggagacacaaagaatgaaaaagaactcttgttgactcaagaaggagg

SEQ ID NO: 136158 - DNA, 150 bp, Homo sapiens
tgagtggtgactgagtcaaagaagtacagttttattaaagttattaagctgtgtagttactataattcaggaaacatgggttacatttgtatccactatgaactaaagtgctcttttaaaaaccagatcaaagcaggttcatgcctgtaa

SEQ ID NO: 136159 - DNA, 523 bp, Homo sapiens
gcagaagaaacagcaagtgcacaggccctgagcttccctgggggagggggtggaggatgagcttggcttgttcaagggacagcaaggagcacagtgaggctgatcccagtggccaaggggagagggctgctggagtccagggagaaagatcaggacggattttcggccatggtgaggaggcgggactttatcttaaacgtgaagggaagccacctgaaggtatgtgatccatcatgcattcattcaacagccgtctgtggaatcttctttagaaatgcagagacacatcctaaaggatcctgtccacagcctaaggagatgccataggggaacctggggggcttccaggaatggcctcacctaaacccctgtgtttcacagacattcagggaaggccatgaccaacccaccaccccaggccacagagcacaagggccgagaccccaggcttccgggctcctagtccagaggggggactgtctggctcctcttgttccatcccccccacctctcctttttgtaa

SEQ ID NO: 136160 - DNA, 680 bp, Homo sapiens
gataaaatacaggacatcaaatatatcacatacattcatatatctcaagaaatgaaagcaatgaaagagctgtgatatgatccatattttttgtttattgacaactaatgcaaaattccaaacaataatgaagcaactacagattggggaaaatagtaaatcagaaagagcaattgagagagcctttttagaaaaaagttttctcctttggaattatgttacattttgagtaattattatgatattcaaccattaatttatacatttgtttttaatttaacatatattttgagtactaaatatatcaggcactattataggtgcttgtgttaattaacaaccagttttctagaatgtgtaaagtgccatagaaaatacctcttgggttctatgctcactacctggatgatgggttcagtcatacccaaacctcagcatcatgcagtatactctgtaacaaacactcacatatatcctcaaatctaaaagttgaaattaaaaaaaaaaataaaaagcaaataattatattaagtatattaactaaaacaaaactgattccgttttagaaaaagaatttagaaatgagggggagtggagactagaataacacttatggtgttcaatcagaatcaaaactatcaatatatacttaagtttactttttttctacattagataga

SEQ ID NO: 136161 - DNA, 833 bp, Homo sapiens
gagacttatatcaaaagaattgcaggaattagctagcatactagcaggagccagggatgtatccttggaattagatttttagggtgtttgatcaaggggactagaatgtaagcatagataagcaagaattaatttactcaggagtactatctcaggacatgggatttaacacccttgcaaggaccttaggggataaggcaaattcactgctgaggtggcttttagaagcttggaaaatgctgtggctaacactcagggaaatggaaaggcctgagttgcccttacagatggcacaggaaaggttaaagaggcttaggaaagtaggcatgctggaatagatgtgtaatgtaagaccagacatctaaccagagaatcatgggaggacccagaggacacatcattcaccatcattcacaggcctggtgaaatgaggttgaagatttggacactgaaaactacagcagcagagactaatgttgaacccctaacacagcactgttctctgaagagaccaaccagctagttggtgccaagtcaagtatatcagacttctttcaacccaaaagagcaagagttttatcttcaccaggtatagatacttattctgagtatggtcttatacttcctgcctaaagattctcagcttctctggggcttacagaataattcataggcatggaattccacacaacatagcatccaaccactttacagtgaagagggtgtggagtagtttcatgaccatgggattcattggcaatatcacatgtaccatcctaaagcagccagccttatagaacactggatcagcctttgtaagtacagatgaagtg

SEQ ID NO: 136162 - DNA, 629 bp, Homo sapiens
acagcaaccagaaaacatctgctcacttccttcaaaatgggaaagatcaccttctacgaggacagggccttccagggccgcagctacgaatgcaccactgactgccccaacctacaaccctatttcagccgctgcaactccatcagggtggagagcggctgctggatgatctatgagcgccccaactaccagggccaccagtacttcctgcggcgtggggagtaccctgactaccagcaatggatgggcctcagcgactccatccgctcctgctgcctcatccccccgcactctggcgcttacagaatgaagatctacgacagagatgaattgaggggacaaatgtcagagctcacagacgactgtatctctgttcaggaccgcttccacctcactgaaattcactccctcaatgtgctggagggcagctggatcctctatgagatgcccaactacagggggaggcagtatctgctgaggccgggggagtacaggaggtttcttgattggggggctccaaatgccaaagttggctctcttagacgagtcatggatttgtactgaagtatttacgttttccacttttctcctttaaaatctaataaaatatttagcttgtgtttctggca

SEQ ID NO: 136163 - DNA, 714 bp, Homo sapiens
ttaccagggactgaccctggtgttcaaactcagccatttacttgtaacgtaattctacatcatgcttcataaaggacaggcattagaatcacctggaggtcttcttaaaaccagatttttgcctaccctcccacccctggcacagaatctgggaatttgtatttctggcgagtttccaattgatgctgatgctggggtctcaaaacccctttgagacaccacttccctaccgtatttaattaaccaaggttatgtgagcacagcctccccagttatcagatggggaaagaaaggcttttaaacttatggggcattttaaagcacacttggtcaatttaactttttcttgatcttataccttcctcttgctgacactattttctatttggaaagctggcagctttaatatgagaagatattttcactttaccttcgctgattgaaaatacccttagcttatatattctttcaagctgctccagagacagaggatatctgataggaaaggtcgtgaggatttggccacgtctttggaaactcagtgtaatagaattggttttaaggtacccagctgatacagtggcccgttttttcacgactaaagaaaactcagtttgactctagagacagagaggtgaagtaagactcttccttaagaatctgggactaccaattgagaaagtttagggagttaaatattttaaaaattataaa

SEQ ID NO: 136164 - DNA, 297 bp, Homo sapiens
atcctgcaggtggggtttagctctggtgaaaagagcacagatcctttgatttgggtttgaatcccagcacttcctcttactaagctgtgtgatcttgggacattactaacctctgtgaggttcagtttttcttggctgcaaaatgtaagcacaatactaataagtaactgacagatgctgtgcttctgccagacactgtacccagtgctttgtgtgtattggctgagtgaatcctcatgacaccctaatgaggtaggtctcttctcttcttgctttcattttacaggagaggaaaat

SEQ ID NO: 136165 - DNA, 453 bp, Homo sapiens
acttactctgtaagggatctgctctttataaacaatgcactttactctgctctaaggagaatagcccacccatcacaataacgtcaaaataataactaagagaccatcactcagaaatcctggcttaaaataactagaaggtcaggctttaacctgagacaggaaattcctgagttaagatagaaactttcttacttcaaatcccttcttactttcatgttctgtaaattaagtagaaataaatatttactcattttcaaaggtctcttacaaataatttttatcagttttaatagttagagataacgaagtaaattaggaaaaataattaaatcttcattttgaattttttgacttagcgtgacagccagtttcctggagttgctttggtttaatttcactacagaagacttagaagacaattcttttcttacatttttttccttaagaaat

SEQ ID NO: 136166 - DNA, 179 bp, Homo sapiens
aggttatgcatgcaaaatgcttaacacatgcctggaataaattgtagcagcctaggatgtattcatcctaggatcagcttccattattttattttctacattgtagcatacacaatctagaacagtactaaaagagactagttgtaagtcatgaggagggtgaggctaaggttaaaaaa

SEQ ID NO: 136167 - DNA, 482 bp, Homo sapiens
aacaaaacttatcaaatactagcataccaatgagaaaaaaaatcaaataataattaacataattatgatgttttcataactatatcaagaaaggtctatgacaataaaaatgtaactgtaaaattatacattatgatacttagaaaaatatgtgtttaaatggaaacaatgagaaacaagcaaaaaaagattaaactgatacattaagaagctgggatagtaaaatgtttctttaaaaaaagtgttacattatggtatggttatgtttttttttttttaactaaaagtaaattattctcttctcactcactactcaaaaaaaaaccttgttggctgggcccccagcatctgggttccccattccagggggtccctcagggcccggggtagcctccggcggctgggatgccagtacgtcggaccagaggcctccattcaacacaggagggtcccgcagcggaaggcggggaagggcgcccccc

SEQ ID NO: 136168 - DNA, 358 bp, Homo sapiens
ttttcttgttttccaagaccttgaggaataatgttcaagtattttgtagatgaccctgtatttaaatttatctgattcttttcctcatgattagtcttgggttatgggtttggggagcaagaccacagagttaatgtaccatctttatcacatcctgtcaatggcatatactaccaacatgatttatgactgttcatattgaccttgatcacctagctgaggtcatttgtcaagtttccccagagtaaagttactctgctcccctccctttcctccaccctcaactttccattctacactctttgggaggaagtcactatgtatagcttacactaaaggagtaggaatttatggtccc

SEQ ID NO: 136169 - DNA, 209 bp, Homo sapiens
cttttaccaatgtgtgatgtccttctttgtcccttgaaacagtttttgccttaaaatctactgtttgacattagcatagtcactccagctatcttttgattgctgcttgcatggtatatctgtttctatactttcactttctacctgtgtctttgaatctaaagtgtgcctcttgtagacaacatatagttggatcatgttttttgcca

SEQ ID NO: 136170 - DNA, 377 bp, Homo sapiens
acaggtacttgttttgcattttgttaatatatctcttaagcctctttaactctctaagttccccctcgttctcttattttttttattctttgcaaattatttgttgaagaaatatagtcaattattgtttagacttttccagagtctggattttgctgattgagtttcaatgatgtcatttaacatgttcccctggctctatgtttcttacaaaatataagctaggcagggtgacacacacctgtagtccaagctactcaggatgcaaaggcaaaaaaatttctttagaccaggagttcaaggctgcagtatgctatgatcacacctgtgaacagtcactgtgctccagcctgggaaacacaatgagaccccaccca

SEQ ID NO: 136171 - DNA, 405 bp, Homo sapiens
catagagccaaggaccttcatggtcttcatcttctattagccccattcccagaatcttcacacagtacaatcataggtttcttggccactctccaagtaaacctacaaactggtgaattcagcttcttcagaagcataatcacagcaccttcaagcacagatgaatcttaaaaaaatgctttatcccaatggctcacatattttatataaaagaaaactagccaggcacagtggctcacgcctgtaatcccagcactttgggaggccgaggtgggcggatcatgaggtcaggagatggagaccatcctagctaacacggtgaaaacccgtctccactaaaaatacaaaaaattagccgggcgtggtggcgggtgcctgtagtcccagctactcgggaggctgagg

SEQ ID NO: 136172 - DNA, 493 bp, Homo sapiens
tgcacaagcacatatttcaaagtctctattataaatctattcaaagatctttcaccccatttttttgaggatgctttcagagtaaattaatctaataaaaaaacagggttcaatactgaaattatccccaaatatttctgcctctttactgatacgatgttaagctaacacctttggctaaatgcttacattttcttgacagatcagcaaccagcacagcaactggtcttaaatggtgagtctccttgacttctctaaagaatactattttccataagatttcacaagtttggtaatatttccaagtttgatgagaagttttattgtgagcagttctggaggctaatagtagataatgaagagctctgctgccatgtccatggaatacctgaaggctacaagagaacattaatagaccttcaagggtaaacagtggaaatggaaagtagaaaatgcttttagctgcttttctgatgctcctagcactagtgaa

SEQ ID NO: 136173 - DNA, 289 bp, Homo sapiens
agtaaactctacgggttgtgtacatccccatagcttttgatcttaattggctggggagaagtcaaagctcaaagaaattgtttatacctataactctgacgcataaggagactttttgccagcctagaccctgcatacactcaacttttaattgctgatccagaaagaatttactcaaaaagagctatcccaggatacataaaatatatttcaagaacaaatggggaaggaatgtgaaaaacagggcataagaaaccccataaaaaatgttttcatcgaacaaaaggaa

SEQ ID NO: 136174 - DNA, 894 bp, Homo sapiens
  misc_feature (601)..(601): n is a, c, g, or t
  misc_feature (653)..(654): n is a, c, g, or t
  misc_feature (662)..(662): n is a, c, g, or t
agctctgtggcgtgcaaatggaatcttgctgaagctcaacagaaacttggtagcttagcactgcataattctgagtccttggatcaggagcatgccaaagcacaaacagcagtatcagaactgaggcaacgggaagaagagtggcgacagaaagaagaagctctagtacaaagagagaagatgtgtctgtggagcacggatgccattagcaaggatgttttaataagagtttattaatcaagataaaagaaaagacacagaagatgaagataaatcagaatcatttatgcaaaaatatgagcaaaaaatcagacatttggtatgttgagtcgatgggatgatagccagagattttgtctgaccatccataccttgtatgtgaagaaactgctaaatatcttattttatggtgttttcacctggaagctgagaagaaaggggctttaatggaacaaatagcacatcaagctgttgtaatgcagtttattatggaaatggcaaaaactgtaatgtggatccaagagggtgttttcgtttatttttccagaaagccaaagcagaggaagaaggttatttgaagcattcaaaatgaacttgaagnttcaagtcaagagtaagacttattctcaatcacaaagtttcactatgacagnnagaatcangtccccatcggggtggattaatagctattagaatctttcccagaatcgaagtattttcgattttatcgacaaggttggagtaaagggcttaaagaaggtgacccaggggcggtattgtgaagggggcaggtttttgaaaagaagtttgaaggggggcaataggggggaaaaaaaagggggttagaaaagaggaagtttagatagcaaggcagtttaaaataagaaaatcgtc

SEQ ID NO: 136175 - DNA, 835 bp, Homo sapiens
gagttagaatgcatgggttcattctacttcacatttaaatgggacagtatttcctgagctagagggctgttgtgagaattaaatgggatatgtttgcctgacatttagtatattgtgagatataccacctttccttgacatattgtgttagtaaaagaaaatttatgctgtaggaaaattgtatattatccatcttcaagtagtctgtatagatgttacagctgtgcctagaagtcagcagaatcccaagaaatatctttgtgttttaggttggtttgctggtgtttcacagttgttgtgatgaagtaatgaaactctgtgtcatggatttaattttagtcaagtttttaaatgttacactttttcaataagagacttgaatagatattttatgccctaataaagtactgaatacttgctgtaaaaacagacaaaaacaaaaaacagaaaaaaaaaaaacaacgaacacaacaaaaaaaaaaatatgaaccaacaagaaacacaaaccaacacaccgtgtgtgggcgcaccagggcgacgcgagctggaagaaagagcttaagagaacacctatgagtgagagcccgggcgaccccagagagaacagacagaagagcgcgacagacggagcacccaagaaaaaagcccgtcgggagaaagaagaaaaggagcaggcagggagtcgcccacaagagaaaaaaacagcgcggcgggggaaaacacaggagtggttactcacagaacaaccaaaaaggagggcacaacgaggggacgcacaaggagaggaatcaaacaagaggcggagcaacgggaggggcaaaaaaaagagacgcgg

SEQ ID NO: 136176 - DNA, 267 bp, Homo sapiens
ggtcgacgtttctctttttgtatatttaaaatttttaatctatactctgatttttgtgatataaacatctagctagttttctccaaaaatgaattatgaacaatccatcttttttaaataatacaaaacatcaccattatcaagcgctaaattcctacatatatttcggtatttctaaatttcctgttctgttttattcattgatgtcttttcagctgttagtaagcaatttgtggaaataaataacatgcacattttgacatctgg

SEQ ID NO: 136177 - DNA, 434 bp, Homo sapiens
gggaatgggaagggaatgaggacaaggatctgaacagtgagctctgtgagtggtgggattctgagggctgcaaggagaacattcttagaagctttctgaggccagaacctgggactgccttatcctctctgagtccccactgacctacacagctcctggtacatgtaggttctcaataaatattgaaaagcagtaagtagtaattgagtgttccaagaagaaatagttgagagagaagatatggaagtaggagagcagactggaaggcagctttcatgtaggcgaattccactttagggttggagccatgtgagagggagtgaggtggtgtgtacaggtcagtgtgagccgaagctccagttttctcatagtgctttcttcacctccaaatggacatttccaaaacatttttaaaaggttttgttgattttgtt

SEQ ID NO: 136178 - DNA, 470 bp, Homo sapiens
agctcggtacctacttttcacaggaatcgtaattgaaacagatttgtttgttagaagagggggaggtattaatgaggctacacaggcactgctgtgaaccaggaaaactacacagtgtgggtatgagggagtgaagaatacatttatgttttaggtctcacttctttctttgcctgtattaagtagtaagggggagaactaacaaggtacctctgcatttaatggttcttttgcagtttggctgaactgtgtcttgaaatccttgaagagcattactaagatggtatagaagttacttgcttaaaaggagaaaagaaaaagctttaatatagacaactcaatagctgaactactcttgcaatgtgaatagccattccttgggtttctaaatgattttcacacttcccacacttgtttaaatttgtaatatcctttatggttttcctttattggccaggagaagaaaaaca

SEQ ID NO: 136179 - DNA, 372 bp, Homo sapiens
ctggacatattccgacagggcaggctgtggctctggatggggggcagtgagggggtgcatgcatgtgctggaactcacatccgggagagaaagcgcggcagacaggcctcacgaatgaatgtgtgttttgaaacattaggttcgatgtctaaagagtacaattcaacaactcaggccaccaggaacaggccccactctctcctggagctctatggcagggttatcagaggatggctggtgccagacatgtgctgacagggatctgggacagtcagaccagaagcaaatgatcaggcgcgacccaatcaacgtggcactaaaacaatgcgtgcaggttcgatcatagttacctgacccacccccagaagagtg

SEQ ID NO: 136180 - DNA, 637 bp, Homo sapiens
tgatacagattggtattggtacatgtgtttctactgtgattagtacttccctgagagatggaagcaattttgtagatcttttacaagaactgggcagttttcagtagttaatttagccttctttactagaatctctgttgttactaaagatcactctctgggcagcatgatgcccaatccatagcaggtgttcaattcatatttattgagcgaatgtttagattcttttgggaaatgttggtcttctcgctgatgttgcctatcactaaagctccaactagtatgtcttttgactttgtatgtggtattcttgtgtttgttttctatttagaagttcaataattttattgaattcaagtctgtcaattttctccccttgttatttgcttttgacattatgcttagaaagcctctccactttcagattataaatatcacatgtatttttaaagatattgatcaatattttataattagatctaaatttttaatccatttggaatttggtgtatgctataaagtaacttaattttaacttaattcttctctagtggttagttctttattgaatataatcgtcctttctcaattgaagtgaaatatataacttagactgatttttagtattcttttactt

SEQ ID NO: 136181 - DNA, 97 bp, Homo sapiens
aggactttaggttgggaactactgcactattctgcagtgaccacaattttcaggagaaaagccaggactcatggtgtgacaactatgaatagatgta

SEQ ID NO: 136182 - DNA, 464 bp, Homo sapiens
gtcagatctaaaacccttggtaattgactggttgagtggttggtttggatcctggggaacttgtggcagaagatattgctcataataggaataataataataattagtgttctgccatgcttttgcttacaatgttgtaatagtatattcttgcaagtaagtcaacatgcaaccaaaaaggctagagtaatagttgtccaaagaactgctctaattgaggaggcagtagcatagcctgaaccagcttctaggtttgctttccattttgctgtaaatctgggaaagtctctctctttttctctctgtgtgtgtgtgtgtgtgtgtgtgtgtgtgtgtgtgtgtacgtgtgtgtattttatctttcttttttacgtatcatattttatctccatgaaacatgaccttaggaataagccttccaagtaatgtgggacctgaacatcctggcgacaagggacaagctc

SEQ ID NO: 136183 - DNA, 195 bp, Homo sapiens
gcacggagtcctgcactgaatccacacaaatgaagtgagttgtaggcgttgggtattaaaaggaatctagaggtgatttaaagtgtaccggagaatgcaggtaggtttctgcaaatactgcaccattttatatcagggacttgagcatccacagatttggtgtctgaggggtcctggaaccaatccccccccccc

SEQ ID NO: 136184 - DNA, 420 bp, Homo sapiens
cgacctgccttccaagaattctgtcttctctgaattccctttttactgattacagcaatgacttagtttaggtttttattctctgacctgtgaatttattttgtctccttgactgatcagtaattctttgagggcgaagaccatggcttgtttgtcagcatgtggcatggagactgattcaacatttatttgttgaatgaatagatgagtaaatgaatgaatgaatgaacaaatggggagctagataaacataattataagatagttgaagacagaagtaaacacagagcatcatgggagcaggaaggtaaaagcagattggaagtggcagggtgaagggagattgccacatggaaagggaacagaagtcagatggtggcacaatataaaaagaacatccctttcatacacatctttgat

SEQ ID NO: 136185 - DNA, 419 bp, Homo sapiens
cagggtctcatagcttacagctggctgggactggattcaagttgagacagtctgaaatccagtgcctgccctctaaagtatactatgatgcctatgtgcctaatctcacagattcctaaatgtggaactggccgtgtttcgatgaccctgcctttagtgttgtcccactaagtctctctctccttttaaagctggcctcttagaactcaagaccacaaaataacctcctgttcctctgcacagaaatcaatgtggactagttgtacaggctatttgcatttcccattttgatttaattggttgattattttaattagccaacaaatttgatgaatttttcaccagtgaactcagtggtgattttcatgtatcttaaaaactaggcttagcctgctctctggtgaactcatgaaatagct

SEQ ID NO: 136186 - DNA, 629 bp, Homo sapiens
agaaaagaaaactgaggcttagggaggtaagcccttgtctaaaacagaaccaagatgtgaattcagatccgacggtggagtctgtactcagaaccaccatgacatgctccaggtgtgtcctgcaatctctcaggtgcatggtgggtggtacagggaggcgagccgtgatctaagggccgcggatgttccagacattgaatggctgcccccctcccagggggctggcagatattttgggccttatttcccagaacgcattcatttttcccagtccctcccacacaccctaaccctctttaggattcttcccagacgcttcagacacagaatagtgaatggtgactgaggtcagtgccacaaaagaacaagggatagcaggaccaggaacactggccttgaccaggcaatgagataaagggcccttgtctgtgcccactgttgcttaggaagagcctcacatcagagggggtgaggatatgtaaagcccacagatggcccttgagtgaggaggagagcaggggtagtgggagagggaataaggctgcccctggctttgcaccactgtgggccagatgggctggagtcgagcttctgtacccaggagattcaagtaccctggcggtgggcac

SEQ ID NO: 136187 - DNA, 416 bp, Homo sapiens
cttgagcctgggaggcagaggctgcagtgagccatgaccatgccgctgcattccagcctgggtgactgagcaagaccctgtctcaaataataataagaatcatcatcatccagggggcctttaattaacaatgaatcgttatctgattctaaaaaatattctccattgtaaaatacttactataatctgttattttctttgtaatctcaaactgtcttaaataattttaatatttcctccaatgttaaaatattgcacacttcctactttttgcctgttctaccacacacattctccatggtcaggcacagtggcttacatctgtaatcccagcactttgggaggcagaggtaggcagatcacctgaactcaggagttcaagcccagcctgggcaacatggggaaaccgtctctac

SEQ ID NO: 136188 - DNA, 347 bp, Homo sapiens
gcttttcacacgggacgtggactagctgcttgcctgagagaccacccttctggattccagaggacccagccagagtcgtcacggcagggtctgcagggttggagaaggctctgttggggccgggcacagcaggtggtggcaggaggataatgccggggcctggacagggggtacaggggcgggaatggatgcacaggtacagaccctgctcttacgtctaggaggcgggtatagtcaatgcgatgtgtaatgtgtacatacagtgtgaaatgtatgtagcatgtaaagtacacataataaagtttatatgatttgtaaagtacaaatgctatgtcaagtgtacatac

SEQ ID NO: 136189 - DNA, 171 bp, Homo sapiens
accaccagaaaagtgatgtgcacagtaacacagggttcacatggaagggcttattacagggaatgttgaccttgatcaatggtgacactgacctctctgccaggtttctacaatgcaaagttactatctttcctgtgtagttaatttttggggactgtggatttttgaaag

SEQ ID NO: 136190 - DNA, 196 bp, Homo sapiens
ctgctggagctgggattgctatacgacagaaagacatacctcgtataaaccaatgttgtgtggggtctctgcagcagcattatattccagcaaatagaatgaacagcctcatgctgacacatttgttcccaaagcccagcagtctcctgctttgctggtctaccacttgcttgtgtccttttattgatatccaatt

SEQ ID NO: 136191 - DNA, 477 bp, Homo sapiens
agtgactgctaatgggcacagggtacatgaaaatgttctggagttagatagtggtgatggttatacagctctataaatatattaaaaaccacagaactgtacattttaagataacaaattgtatggcatacgaattatgtctcatcttttttaaaaaaggcattgttaggaccaccccatatttatttagttccatttttaaacttccctaaaaactcttgctagatagactaaagcttgtctacagagccacactgccaataacactgactggtcaaggtagtcatgtacccaggaactacccttatttccttctctggccactcaattgcctcttggcatggtgaagacatgcttaacactcacttgtgtgggattaaacagaatacagtgtgagtcgcaaatacagtgagggcaaagcagaaaacagctagaacagggaataaaaagaaggtatccatctatcatcccagctac

SEQ ID NO: 136192 - DNA, 437 bp, Homo sapiens
ccgaggaggcccttctcctacagcagccttgacaggtctgtctggcctctgccctgacacctccagggctggccatctatgtggggaagattatgattggaaggaaggtttttcttagagctgccagtctttattttctacctgctgctcttcattttgtcctcagaggaggaacgtgtcctctcttccctaggacgtctgtcttggtattgaagacagtgcttctgtgcttcttacttatcttccttgaggttagccatccttgtctctgcaccctctccctcagtcctggccactcccatgtgaacctcagtgtttattcctgacccaggatacctcagctccaactggaccccaggcagtaagaggcttcctcttagagtcagcggattcccactgatgcagcccaagattacctgccccgtcctcctcctcct

SEQ ID NO: 136193 - DNA, 449 bp, Homo sapiens
tcacagggaaccttcgcgtcccccacgctgctgcagcatccagagacactgccgcaggggtgcatgcggccagcctgctctgtgccagcctctgccaggcagccccaggggagggagctgagctggcaccagtgcttgtccttggagaggagcgggcctggctgatcatgaaggcaaggctttccactggcctctaaatgtgtgggcctgaccgggacactggggaccccaggaaccccagggctgtaggactagatctgaaagagcctcaggcaaagtagcatttgaagcaaccggagggacatgggtttagaactgaggtctgggtttgaatttcaacttgactttgaacaagttacttctgtgatcagggctggcttcatggatgcatgacctgtgtggtcacacagggccctaactttggttcactgctctgctgttaccctctt

SEQ ID NO: 136194 - DNA, 316 bp, Homo sapiens
tatcttcatgcaatctatagttatcttgtttattcttcatgcaacctataggcgagatagataccatgtacgataatctcccttttacaaatgaggaaatggaggcaaagggacataaagttttgcagctggtaatcggcagaatcggggtacctggggctaggtggggagtgatcttgctcccatcactgtaccttttacctctgcacgatactgccttatttgtaaatcaagtagcatattacgcacatgacggatgcataacattgaaaggaatttcctagtgaatgcttctataaaataaagaattctgctg

SEQ ID NO: 136195 - DNA, 542 bp, Homo sapiens
ggatattgccccaaatgaacatacctggatgaatttcattaaattatatagacgtgtaaagcatattcatatacattctccctacatatataatttgcccaattctctgtgcctgaatatttgaaaaggatatttgatcagcatctaattggactatgagggagctggtgataggtcctaccgttcaccaacactgggctccctaaattataaggggacgcagtgcggcatagcagttaagagttccgttactccagagtcagacagaccagattgcaatctcaactgcaccacttactaaatgtgtgaccttggccaatatttatattatccaatttacagctactccaactgttgtcaaaacaaaactagttatgataatgctccctatctgctaaaaccactgtgaaggttaaatcaaataatccctgaccgatgacagactgataataatccctgaccgctgacagacagactaagagagagggagcgaaagagagagagaaagaatgctatgtgaaacaaaatctgcaatactagca

SEQ ID NO: 136196 - DNA, 308 bp, Homo sapiens
gtcttagagcagttttaggttcatagcaaaattcagtggacattacagagtttctgtttactgcctgactacccctacatgcacagttttccccacgatcaataccggggtggtacatttgttatagttgataaacctactttaacacatcatcatcaaccacagtccaaagttttagtttattctgtaattgattctcacatgttgaaccaccctccctttttgttttttggtttttattttgataaatccgacatggcctttgtaaataatccatttaacatgctattgaaacttctaaaactagg

SEQ ID NO: 136197 - DNA, 230 bp, Homo sapiens
atacgtactgtatgcaaatgataaagctgccattttccttcgtttctctacacatttttttgtgatttgaatacctatctcctattccaaattattttcacgccaaccaaccacctatttattctttgaaccagcatttcctgtgtagtttcttcattctaatttatacaccaattcaggggttaagaatttttttaaaagacacaatataaggaaatactaataagata

SEQ ID NO: 136198 - DNA, 654 bp, Homo sapiens
gcaaagagtagcagtgagccgagatagcagcatagcactccagcctgtgtgacagagcaagactctgtctcaaggaaaaaaaaaagagtttatttcatgaggtatgaagacatcctgtcttcagggactgaggcaaccttgcttgtccttttggccattttcaaggttatggaagaaaaagtatgtgtagcctgttctttttctagccaataatccatttgcagcctgacttgctttaagatgcttttccaaagagcttccagattatggttgtggaaactgagtacactgagtgcctaggctatggcagaccctagaggtttaatctccccaaacctccattttcaacccagtctctattgcagggcatgtaaaaaagaaaagctcactctcccaggctctcttgcagctatgggtgaccatgtgacttagttctggccaatgagatgttggcaggaagtccctgaggagatggccttacttccaaaatagaaggcaaagctctatgtggcgaaagccttctgtctttcctccagcctggcatgaggacatgaggcctgcaacgatgaaacaacaaccaggagaatatgctaaggtgccactgctgggcatctatgccaggactggagtacacacctctggacaatttcttat

SEQ ID NO: 136199 - DNA, 634 bp, Homo sapiens
  misc_feature (252)..(252): n is a, c, g, or t
agagtgcaaatcatgacaggtaaggtaagagacacgactgagcccactctgactgtggtgtacactgaggaactggcagggagagaggccttccacattcagctgggctcaggaaaaggaccacacaacattgtggccaccagggggcgggctgcacctgctggaccactgacccgtttgaaagccttattcttgggagtgaagtgtctttagatgggaaggatgctgtccccaggtcccacctgacaagtnagagaacatccctggggacaagggtagaggtagaagatggctaggaagccaggtgtcagtggacatagacatttgattggaagaatccatgtgtgatgggggagagtgggtcttggtaagaaaggatcaggatgttgaggaagcatgggagttatgggtgttgaaggcagaaggatgagcttctggggatcccttagggatggtgtcctggaacaagctgagtggggaatacagggtgtcttgaggtgtaaggatgtcctctgcctttcctaacaccttgatcatcccggttatggggaaaagtagtagctggaggtcacatccttcccctagagatctctatctccttgcttcagatgctactcgcaggccactccagccc

SEQ ID NO: 136200 - DNA, 779 bp, Homo sapiens
caaacacaataatagggcttaggacagcttttcttgtgtgtgtgcttaatagtaaatcaaggtcacccacatgttcacagctgtgttgctctgggtggcatgggcatcggtactgtattagtccatttttacactgctgataaagacgtacccaagactgggtaatttataaagaaaaagaggcttaatggactcacattaagcctctggggagccctcacaataatggcagaaggtgaaaggcatgtcttacgtggcagcagacaagagataatgaggaccaagtgaaaggggtttccccttataaaaccgtcagatctcatgagacttattcactaccacaagaacagtatgggggagactgcccccatgattcagttacctcctgctgggtccctcccgcaacacgtggaaactataggagctacaattcaagaagagatttgggtggggacacagccaaactgtatcaggcacacgcatcgctttagggagttctcatttccttccattcaacctgatcctttatctgcttgttctttcctcctttcccttccattctctttcactccctcctccctggcttccctctcttctgctctccctccctccttccttcttcctgtccccatctcctgtcttctggtgactctgggtcaaaggaccctggtccagaagggttccgtgtggggatgtgttgtgctgaacccctgttaacctcagtagggaaggtaccaggttcaagaggccaaagaagagacctggagccagcaaacaag

SEQ ID NO: 136201 - DNA, 606 bp, Homo sapiens
gaggtagaagccaggctccatattctaatttgaaggtgcatcagcaggcacaaggtactgactcaatccaagcctcaggctgctcatccacaagctgagatcataggcccttctgtatgaagctcttgtgaaggctaaatgagctagactgtagaacgtgtcaaatgcctagcacagaggaactgttgggtaacttgttgaagcaaaaggatatacatcaaagaacactacaaactctaaagtgatataaacatgtaagaaattattataacaaggacaaaattctatgcaaaacactaacgcttagctaattgcttaagtattatgggaaaattcattatactgtccaaatgtaaaacatgctcatttacagcagtttcccctacagctgtgccagtggtgaggtagagaatatttgaagatttattttaaacacagctgctttatgtattattgtcaattttctccattttcttcagtttgaacctttgaactccatcttttatgtttctaaaatggtcagaacagtagacatttgatgaaggtaactcacaaatgcgcaagtgaacactccaaagtgagatagaatccatatgaattcctttt

SEQ ID NO: 136202 - DNA, 1436 bp, Homo sapiens
gctacctagagttaccctttctctgatcgctcttgactagagagactcgtcatgtgatcaactgtggccagagggcatcctgcagacagctcctgtcacaccacactgaccagactcttatgagtatttaagcatcttcagggaagcgattgactgtcttataatggtcttacaagtacggaactttattacctgctaataatcagagcacatgatggcacaatagaatatacgagtgaagttctaaatgcaaggttgttcttattctgtgagtggcaaaactcatgcagtgagcagataaagctggcaggaggcattggcgccctaatgctgggcactaaccacctgcccggactgcgaatatctgttgggtcctttctatatctggtctattctcgtgtttgattatatcctggtggcaagaatagcaaaatcaactctccttcctatcccatgtggagaggcatgatttgagtcagagagcattatcctctctgcgttatccaaccccatgtcccatgatgcactttgtagacaagcaagtgtccctggtggagaatccacagccacacatcctcattggttgcaaggatcagtgtccaatatctactgccatgatcattctcagttttacatccacagagcttcatagaattctaacaccacaggtccaagtagaggttttggcctcagagtgggctagattccacctctgacagcagctgtgggactgtttttccatctgtaaaatggagacaagagtatcacctacctcatggtgttggtgggatcgttaaacagaattctgatcatgaaacccttagcctgctccctgcataggctgcatgcgctcagtgagctatggctctgtttcatgctgactttaccatcatgtaagcagttttaaaaatgctagaagctttagtcatagaattaccatatgatacagcctactgcagagtccagaggctgaggcaggagagttacttgaacctgggaggcggaggttgcagtgagccaagatcgcgccactgcactccagcctgggcaacagagtgagattctgtctcaacacaaaaaagaagacatgtgtccccatcacagtatcatacagagtgcttccactgccctaaaataccctgtgctcttcctattcatccctctcttcaaccccagcaaccactgatccttttaccatctccatggttttgcctttcccagaatgtcatattgttggaatcatacgctatgtagcctttgcaaatgggcttctttcactgagcaatgtgcattgaaggtgcctctatgtcttttcaagggttgatagctcattcctttttattgctaaataatattccattgtctgaatgtaccacattttgtttatccattcacctactgaaggacatcttggttgcttccaagtttgggcaatt

SEQ ID NO: 136203 - DNA, 2013 bp, Homo sapiens
  misc_feature (1957)..(1957): n is a, c, g, or t
tttctagtctgctttttttgtttaattcttgtaatgtaagcaataaatatggagtgtcagtagtctccttccaccccagaaatgtgttggtgtaacattctcgtttcttttaacaacctggaagtacctttcttgtgatcttcactgaggaattagaactatgatagaagttaggctgtggcaaatgggacattcgtagagtgggatagaggtggcagaatgaacctggtgtagggcaggagtatgttgtgtagttacatcaatttgatgcatgctttccatctgcactccagacggctttctcagttccaagattttgcagagagaaggagcaaaccttttcattggaaaaacagaaacaaccctcccccccattttttcccctctattcatcaaacctttatgtatctttcatcttccagttacctctaggcatttagatagtgaaatttacctttgagatataacaataagtgattaactgttcactttcagatgtaatggcaaacaattgttaaaagttattaactgatcacagatttgcctggacttcccttcccagggagggaacagaagttaggaggcaactttgggatggtgctagagcatggaaagcacagagaatggacaaacaggtctttttctcttttctctgatgttttacctttaaaagatccaacatccttaccgttggtatttttagtaaggttatagtaaatagctttacaccaggatggattctgaaatataaattctaaattatatttgttataactatattttatgttgtatgttatcaggagccatcagagaatgacctttttgtgtttggaacacttggttccatgaaaagtatgctttgtgttttaactgttaaaataatttaaaaattaattattttacataattaaagaagttaaaaactattaacattaaataatttcacaatttcaacatgtcaaacctatgaagggagataggaaacaatgagaaacttacttttgctcctttatacagaattattaactatattttactaactaaaaaactctagtattctttacctaaagtcaattggctggtaagagggagagatgcaaaattctccagctctgaacttggagctacttcacactctactcttaatggaaacttgaactaatgatagatagtatttttttcctctatttaaaatttttgtcttgattaggagatttttcagttctccatataataattttctacaatcagatctatgctgtggcatattttgctttatttaaaaatttttttttagagatgagttcttgctctgtcacctaggctggagtgcagtggcatgatcatggctcactgcagccttgaccttccagcctgccaagtagctgggattacagacaggcatgtgctattacacctggctaatttttaaagttttttttgtaaagatagggtctttctatgttgcccaggctcgtcttgagctcctggcctcaatcgatcttcctgccaaggttttggaattacaggtgtgagccaccatgcctggcctgctttgacatattttatagtgtgttaattacaaatagtcttcatatgccagaatataagagcaagtgttatctactttttagatgggaattgcagaagctgcatcaaaagtatgctttgaggtatatatagtgaaacagagcctttctgaagagaattatatcaaactaattacaaccaagaaataatagtatgaagcggatgctgtttggaggacaggaaaatttatcgggaaaattacataatccctctgattccactatccagagatagccattattattaatatttggtatgtacatccttatattatttttttcttatgcatgattttgtatatatggttatttttctttccataaaaatggtattaaactgtatatactgttttgtagcctacatattncatatagaagtatattgttaacattttccatgtcaataaatattcttctatggctt

SEQ ID NO: 136204 - DNA, 2876 bp, Homo sapiens
tacgggctggatttgtacggtgggctccacatggacttctggtgtgcccggcttgccacgaaaggctgtgaagatgtccgagtctctgggtggctccagactgagttccttagcttccaggatggggatttccctaccaagatttgtgacacagactatatccagtacccaaactactgttccttcaaaagccagcagtgtctgatgagaaaccgcaatcggaaggtctctgctgctgatgaagctgtgaccaaacgcacccaacccttggcagccatctgtccctgcagccatagcccacattcccatgacctccctctgcttgttttgggaccatgtctgtacagcctctaggccccagccccggaggtgaatgccatgccatgattctggtgtgctccatggcatccccagcctagctcccaatcccactttggcacgatgttagccaacagctcctcaaccaacagttctgttctcccgtgtcctgactaccgacctacccaccgcctgcacttggtggtctacagcttggtgctggctgccgggctccccctcaacgcgctagccctctgggtcttcctgcgcgcgctgcgcgtgcactcggtggtgagcgtgtacatgtgtaacctggcggccagcgacctgctcttcaccctctcgctgcccgttcgtctctcctactacgcactgcaccactggcccttccccgacctcctgtgccagacgacgggcgccatcttccagatgaacatgtacggcagctgcatcttcctgatgctcatcaacgtggaccgctacgccgccatcgtgcacccgctgcgactgcgccacctgcggcggccccgcgtggcgcggctgctctgcctgggcgtgtgggcgctcatcctggtgtttgccgtgcccgccgcccgcgtgcacaggccctcgcgttgccgctaccgggacctcgaggtgcgcctatgcttcgagagcttcagcgacgagctgtggaaaggcaggctgctgcccctcgtgctgctggccgaggcgctgggcttcctgctgcccctggcggcggtggtctactcgtcgggccgagtcttctggacgctggcgcgccccgacgccacgcagagccagcggcggcggaagaccgtgcgcctcctgctggctaacctcgtcatcttcctgctgtgcttcgtgccctacaacagcacgctggcggtctacgggctgctgcggagcaagctggtggcggccagcgtgcctgcccgcgatcgcgtgcgcggggtgctgatggtgatggtgctgctggccggcgccaactgcgtgctggacccgctggtgtactactttagcgccgagggcttccgcaacaccctgcgcggcctgggcactccgcaccgggccaggacctcggccaccaacgggacgcgggcggcgctcgcgcaatccgaaaggtccgccgtcaccaccgacgccaccaggccggatgccgccagtcaggggctgctccgaccctccgactcccactctctgtcttccttcacacagtgtccccaggattccgccctctgaacacacatgccattgcgctgtccgtgcccgactcccaacgcctctcgttctgggaggcttacagggtgtacacacaagaaggtgggctgggcacttggacctttgggtggcaattccagcttagcaacgcagaagagtacaaagtgtggaagccagggcccagggaaggcagtgctgctggaaatggcttctttaaactgtgagcacgcagagcaccccttctccagcggtgggaagtgatgcagagagcccacccgtgcagagggcagaagaggacgaaatgcctttgggtgggcagggcattaaactgctaaaagctggttagatggaacagaaaatgggcattctggatctaaaccgccacaggggcctgagagctgaagagcaccaggtttggtggacaaagctactgagatgcctgttcatctgctgacttctgtctaggctcatggatgccaccccctttcatttcggcctaggcttcccctgctcaccactgaggcctaatacaagagttcctatggacagaactacattctttctcgcatagtgacttgtgacaatttagacttggcatccagcatgggatagttggggcaaggcaaaactaacttagagtttccccctcaacaacatccaagtccaaaccctttttaggttatcctttcttccatcacatccccttttccaggcctcctccattttaggtccttaatattctttctttttctctctctctcgtttctctcttctctctcctctcctctcctctctcttctcctcttctctctctctccctctctctcctttgtccagagtaaggataaaattctttctactaaagcactggttctcaaactttttggtctcagaccccactcttagaaattgaggatctcaaagagctttgcttatattttgttcttttgatacttaccatactagaaattaaagcgaatacatttttaaaataaatacacatgcacacattacattagccatgggagcaataatgtcaccacacacacttcatgaagcctctggaaaactctacagtatacttgtgagagaatgagagtgaaagggacaaataacatctgtgtagcagtattatgaaaatagcttgacctcgtggacttcctcagagggttggtccctggatcacactttgagaaccatacttgtcctgaagtattggagttcatgtctaacttcttcccagggcattatgtacagtgctttttattactgtggggagagggcagtgctaaataaattaatcactactgatagtcttcatggctcagggttttcct

SEQ ID NO: 136205 - DNA, 2715 bp, Homo sapiens
gagcccagcccagagcaggcagcggaagccagcttggggcagcgcagagcaacacggagcacaggtctctgctgctgatgaagctgtgaccaaacgcacccaacccttggcagccatctgtccctgcagccatagcccacattcccatgacctccctctgcttgttttgggaccatgtctgtacagcctctaggccccagccccggaggtgaatgccatgccatgattctggtgtgctccatggcatccccagcctagctcccaatcccactttggcacgatgttagccaacagctcctcaaccaacagttctgttctcccgtgtcctgactaccgacctacccaccgcctgcacttggtggtctacagcttggtgctggctgccgggctccccctcaacgcgctagccctctgggtcttcctgcgcgcgctgcgcgtgcactcggtggtgagcgtgtacatgtgtaacctggcggccagcgacctgctcttcaccctctcgctgcccgttcgtctctcctactacgcactgcaccactggcccttccccgacctcctgtgccagacgacgggcgccatcttccagatgaacatgtacggcagctgcatcttcctgatgctcatcaacgtggaccgctacgccgccatcgtgcacccgctgcgactgcgccacctgcggcggccccgcgtggcgcggctgctctgcctgggcgtgtgggcgctcatcctggtgtttgccgtgcccgccgcccgcgtgcacaggccctcgcgttgccgctaccgggacctcgaggtgcgcctatgcttcgagagcttcagcgacgagctgtggaaaggcaggctgctgcccctcgtgctgctggccgaggcgctgggcttcctgctgcccctggcggcggtggtctactcgtcgggccgagtcttctggacgctggcgcgccccgacgccacgcagagccagcggcggcggaagaccgtgcgcctcctgctggctaacctcgtcatcttcctgctgtgcttcgtgccctacaacagcacgctggcggtctacgggctgctgcggagcaagctggtggcggccagcgtgcctgcccgcgatcgcgtgcgcggggtgctgatggtgatggtgctgctggccggcgccaactgcgtgctggacccgctggtgtactactttagcgccgagggcttccgcaacaccctgcgcggcctgggcactccgcaccgggccaggacctcggccaccaacgggacgcgggcggcgctcgcgcaatccgaaaggtccgccgtcaccaccgacgccaccaggccggatgccgccagtcaggggctgctccgaccctccgactcccactctctgtcttccttcacacagtgtccccaggattccgccctctgaacacacatgccattgcgctgtccgtgcccgactcccaacgcctctcgttctgggaggcttacagggtgtacacacaagaaggtgggctgggcacttggacctttgggtggcaattccagcttagcaacgcagaagagtacaaagtgtggaagccagggcccagggaaggcagtgctgctggaaatggcttctttaaactgtgagcacgcagagcaccccttctccagcggtgggaagtgatgcagagagcccacccgtgcagagggcagaagaggacgaaatgcctttgggtgggcagggcattaaactgctaaaagctggttagatggaacagaaaatgggcattctggatctaaaccgccacaggggcctgagagctgaagagcaccaggtttggtggacaaagctactgagatgcctgttcatctgctgacttctgtctaggctcatggatgccaccccctttcatttcggcctaggcttcccctgctcaccactgaggcctaatacaagagttcctatggacagaactacattctttctcgcatagtgacttgtgacaatttagacttggcatccagcatgggatagttggggcaaggcaaaactaacttagagtttccccctcaacaacatccaagtccaaaccctttttaggttatcctttcttccatcacatccccttttccaggcctcctccattttaggtccttaatattctttctttttctctctctctcgtttctctcttctctctcctctcctctcctctctcttctcctcttctctctctctccctctctctcctttgtccagagtaaggataaaattctttctactaaagcactggttctcaaactttttggtctcagaccccactcttagaaattgaggatctcaaagagctttgcttatattttgttcttttgatacttaccatactagaaattaaagcgaatacatttttaaaataaatacacatgcacacattacattagccatgggagcaataatgtcaccacacacacttcatgaagcctctggaaaactctacagtatacttgtgagagaatgagagtgaaagggacaaataacatctgtgtagcagtattatgaaaatagcttgacctcgtggacttcctcagagggttggtccctggatcacactttgagaaccatacttgtcctgaagtattggagttcatgtctaacttcttcccagggcattatgtacagtgctttttattactgtggggagagggcagtgctaaataaattaatcactactgatagtcttcatggctcagggttttcct

SEQ ID NO: 136206 - DNA, 2089 bp, Homo sapiens
tacgggctggatttgtacggtgggctccacatggacttctggtgtgcccggcttgccacgaaaggctgtgaagatgtccgagtctctgggtggctccagactgagttccttagcttccaggatggggatttccctaccaagatttgtgacacagactatatccagtacccaaactactgttccttcaaaagccagcagtgtctgatgagaaaccgcaatcggaaggtctctgctgctgatgaagctgtgaccaaacgcacccaacccttggcagccatctgtccctgcagccatagcccacattcccatgacctccctctgcttgttttgggaccatgtctgtacagcctctaggccccagccccggaggtgaatgccatgccatgattctggtgtgctccatggcatccccagcctagctcccaatcccactttggcacgatgttagccaacagctcctcaaccaacagttctgttctcccgtgtcctgactaccgacctacccaccgcctgcacttggtggtctacagcttggtgctggctgccgggctccccctcaacgcgctagccctctgggtcttcctgcgcgcgctgcgcgtgcactcggtggtgagcgtgtacatgtgtaacctggcggccagcgacctgctcttcaccctctcgctgcccgttcgtctctcctactacgcactgcaccactggcccttccccgacctcctgtgccagacgacgggcgccatcttccagatgaacatgtacggcagctgcatcttcctgatgctcatcaacgtggaccgctacgccgccatcgtgcacccgctgcgactgcgccacctgcggcggccccgcgtggcgcggctgctctgcctgggcgtgtgggcgctcatcctggtgtttgccgtgcccgccgcccgcgtgcacaggccctcgcgttgccgctaccgggacctcgaggtgcgcctatgcttcgagagcttcagcgacgagctgtggaaaggcaggctgctgcccctcgtgctgctggccgaggcgctgggcttcctgctgcccctggcggcggtggtctactcgtcgggccgagtcttctggacgctggcgcgccccgacgccacgcagagccagcggcggcggaagaccgtgcgcctcctgctggctaacctcgtcatcttcctgctgtgcttcgtgccctacaacagcacgctggcggtctacgggctgctgcggagcaagctggtggcggccagcgtgcctgcccgcgatcgcgtgcgcggggtgctgatggtgatggtgctgctggccggcgccaactgcgtgctggacccgctggtgtactactttagcgccgagggcttccgcaacaccctgcgcggcctgggcactccgcaccgggccaggacctcggccaccaacgggacgcgggcggcgctcgcgcaatccgaaaggtccgccgtcaccaccgacgccaccaggccggatgccgccagtcaggggctgctccgaccctccgactcccactctctgtcttccttcacacagtgtccccaggattccgccctctgaacacacatgccattgcgctgtccgtgcccgactcccaacgcctctcgttctgggaggcttacagggtgtacacacaagaaggtgggctgggcacttggacctttgggtggcaattccagcttagcaacgcagaagagtacaaagtgtggaagccagggcccagggaaggcagtgctgctggaaatggcttctttaaactgtgagcacgcagagcaccccttctccagcggtgggaagtgatgcagagagcccacccgtgcagagggcagaagaggacgaaatgcctttgggtgggcagggcattaaactgctaaaagctggttagatggaacagaaaatgggcattctggatctaaaccgccacaggggcctgagagctgaagagcaccaggtttggtggacaaagctactgagatgcctgttcatctgctgacttctgtctaggctcatggatgccaccccctttcatttcggcctaggcttcccctgctcaccactgaggcctaatacaagagttcctatggacaga

SEQ ID NO: 136207 - DNA, 2717 bp, Homo sapiens
gagcaaagagcagtgcccagcccagctcagagggcaaatgggacagatcccagaggccctgaggaggtctctgctgctgatgaagctgtgaccaaacgcacccaacccttggcagccatctgtccctgcagccatagcccacattcccatgacctccctctgcttgttttgggaccatgtctgtacagcctctaggccccagccccggaggtgaatgccatgccatgattctggtgtgctccatggcatccccagcctagctcccaatcccactttggcacgatgttagccaacagctcctcaaccaacagttctgttctcccgtgtcctgactaccgacctacccaccgcctgcacttggtggtctacagcttggtgctggctgccgggctccccctcaacgcgctagccctctgggtcttcctgcgcgcgctgcgcgtgcactcggtggtgagcgtgtacatgtgtaacctggcggccagcgacctgctcttcaccctctcgctgcccgttcgtctctcctactacgcactgcaccactggcccttccccgacctcctgtgccagacgacgggcgccatcttccagatgaacatgtacggcagctgcatcttcctgatgctcatcaacgtggaccgctacgccgccatcgtgcacccgctgcgactgcgccacctgcggcggccccgcgtggcgcggctgctctgcctgggcgtgtgggcgctcatcctggtgtttgccgtgcccgccgcccgcgtgcacaggccctcgcgttgccgctaccgggacctcgaggtgcgcctatgcttcgagagcttcagcgacgagctgtggaaaggcaggctgctgcccctcgtgctgctggccgaggcgctgggcttcctgctgcccctggcggcggtggtctactcgtcgggccgagtcttctggacgctggcgcgccccgacgccacgcagagccagcggcggcggaagaccgtgcgcctcctgctggctaacctcgtcatcttcctgctgtgcttcgtgccctacaacagcacgctggcggtctacgggctgctgcggagcaagctggtggcggccagcgtgcctgcccgcgatcgcgtgcgcggggtgctgatggtgatggtgctgctggccggcgccaactgcgtgctggacccgctggtgtactactttagcgccgagggcttccgcaacaccctgcgcggcctgggcactccgcaccgggccaggacctcggccaccaacgggacgcgggcggcgctcgcgcaatccgaaaggtccgccgtcaccaccgacgccaccaggccggatgccgccagtcaggggctgctccgaccctccgactcccactctctgtcttccttcacacagtgtccccaggattccgccctctgaacacacatgccattgcgctgtccgtgcccgactcccaacgcctctcgttctgggaggcttacagggtgtacacacaagaaggtgggctgggcacttggacctttgggtggcaattccagcttagcaacgcagaagagtacaaagtgtggaagccagggcccagggaaggcagtgctgctggaaatggcttctttaaactgtgagcacgcagagcaccccttctccagcggtgggaagtgatgcagagagcccacccgtgcagagggcagaagaggacgaaatgcctttgggtgggcagggcattaaactgctaaaagctggttagatggaacagaaaatgggcattctggatctaaaccgccacaggggcctgagagctgaagagcaccaggtttggtggacaaagctactgagatgcctgttcatctgctgacttctgtctaggctcatggatgccaccccctttcatttcggcctaggcttcccctgctcaccactgaggcctaatacaagagttcctatggacagaactacattctttctcgcatagtgacttgtgacaatttagacttggcatccagcatgggatagttggggcaaggcaaaactaacttagagtttccccctcaacaacatccaagtccaaaccctttttaggttatcctttcttccatcacatccccttttccaggcctcctccattttaggtccttaatattctttctttttctctctctctcgtttctctcttctctctcctctcctctcctctctcttctcctcttctctctctctccctctctctcctttgtccagagtaaggataaaattctttctactaaagcactggttctcaaactttttggtctcagaccccactcttagaaattgaggatctcaaagagctttgcttatattttgttcttttgatacttaccatactagaaattaaagcgaatacatttttaaaataaatacacatgcacacattacattagccatgggagcaataatgtcaccacacacacttcatgaagcctctggaaaactctacagtatacttgtgagagaatgagagtgaaagggacaaataacatctgtgtagcagtattatgaaaatagcttgacctcgtggacttcctcagagggttggtccctggatcacactttgagaaccatacttgtcctgaagtattggagttcatgtctaacttcttcccagggcattatgtacagtgctttttattactgtggggagagggcagtgctaaataaattaatcactactgatagtcttcatggctcagggttttcct

SEQ ID NO: 136208 - DNA, 482 bp, Homo sapiens
ttctgcaacccttctttgcccttaccatgccctatctttagagggcctccatttctttgtgcggtgtctgcagctgtggttagtgcgtgagataaaagtgcaggatcctataaatagataaattcagagtgttccagagtaagagacatggctagagaaatagtcaaagccctcgcttcatttaaccaagttatcgttacctgttgagtacttttcagagtagaagatcatgttgaaacagttaaatcactgaaatttataaccaagaaggaaagctctagttattctgatacccctcccccactttcatactttctctactctgaaacagatcaacaggctgactgtagtgattgttttccttttcatgaggaagtatgaccttatctgtcagtggatctgtacaaataccaggagttgatgtgaatgctcctgtgcaccattgtatgcttggcaggtcttaactgcactcatctaattat

SEQ ID NO: 136209 - DNA, 548 bp, Homo sapiens
atgcattctgtatgattcaatttatattaagttccaattatattaaaacagaaaaaaatacatatctgtagagatagaaatgaggccagcggttaactggagcagggggtaggatggaggtcactgactttaagaggcaagaggatgatttctggaaagatggaaacattctatgtcttgctcagggtggtggttgcatgagtgtgtactttgttcaaatgccattgacctgtacatttaaaatgtgtgtattttgctattttaaactaaacctgcacaatgttgatttttaaaataagtcatttaaaataaacatttgaatttcaggattgccttggaaagccacatgtgggaatactgggcaagtaatcctacttaaccacagccaggtggagctgagctacagccaccctgttcagattggagcagcctctcacaaggctctcacacaccctcccttttcgttcatttatactatttgtcagatcactgcttgttggcctctgctctttaaaaagcgttcatttattcattgacttttttttcag

SEQ ID NO: 136210 - DNA, 153 bp, Homo sapiens
gattcagactctgtcttgtgccgcttccctaagtgggaggactgagggctgctctgagaaaggttgggttggatccatatctgcctcccagagccaggcacttcctgggtgcttggaaaacgcatgctgaataattgagtgagctgttattga

SEQ ID NO: 136211 - DNA, 342 bp, Homo sapiens
ccagcatgcagcctcaagagcatgatattctcgccctgggtcacctagctggaagaaggctctggtgtccccacctctgcaggtcctgacacctcctggccagagaccatggtggaggcgccgtggctggggtctggcctcggagagcctggtggttttcattccccatgagcctcacggattccccatgagcctcatggatgccccatgatctttacacttaaacagcttatgtgcctccttgtcaccgaggaaaagtgcaacctcccagattctgtctttcagttcttgccatgcaattgcaaagctagtgattcagtaaacatttccatttctctatgc

SEQ ID NO: 136212 - DNA, 320 bp, Homo sapiens
ggtggatggatcacgaggtcaggagttcgagaccagcctggccaagatagtgaaaccccttctctactaaaaatacaaaaattagccgggcatggtggtgggcgcctgtaatcccagctacttgggaggctgaggcagagaactgcttgaacctgggaggcggaggttacagtgagccgagatcaggccactgcactgagtgacagagtgagactccatcttaacaaaacaaaaaacaacaacaacaacaaaaatggattctgcaggtcaaagatggtagttatgtgaaattttctttgcaaattgaacgtattgcttgg

SEQ ID NO: 136213 - DNA, 634 bp, Homo sapiens
ggacccattgatgtcttctttaaaactttaagacagtagcagaacttaaagggcaccaaggttttatatttttaaagataaagtagaaatcaggtcccagggcaggatgcacacaggctaaactaagtagcatatggtctggcaacttttcagactgtagaggcagaggcatcaatcagctctcgcgatctcacgcaccctgttgcatgacagagctgtcagtcgagtgcattgttaaccacaggcctgatgaggagtgggaagcacaacttttgacatttgactttgcagatgaatgaattcttccaactttacagtctttgaaataaaggactctctctaaagttctgtgtggcagactcatgctccattactctggaaagagattgtattagaaaccagtcagatcaggatctgaattggtcttgttggcgttgaaagtcccccttgactttctatttgctttcctattactgctccaaaaccattctactggttcacttagcgatttttgaggctgatgaaggaagtgattggggtatggactgtgaattggttggtttgcatttgaggttgcattcattatatcactactctatgaagataattggcaaaactgttcattcagcagaga

SEQ ID NO: 136214 - DNA, 318 bp, Homo sapiens
acaagacaatcagcgccccaagtggaagaaaataaaaggtagatataattcccaaaccatgacaaatgcaatccagatctaaaccatatcataccatatccaaaaatatgctgaatgctcatatctaactttctaaattaaagtctataaagtaaaatcacaaaagtatcagaagaaaatacaagagattggccaggtatagtagctcatgcctgtaatcccagcactttgggaggctgaggtgggaggatagcttgaggccagaagtttgagaccagtctgggcaacacactgagatacgttctctaccaaaaaaaa

SEQ ID NO: 136215 - DNA, 686 bp, Homo sapiens
gggtagacggaatcaagagcttagaaactgttgacgttgccatgtctaagaagaaaatttttctccaaagttttcttcttagacatggcagcttcagcagtttcttccaaagaaatccaagtcaagagactccacattaagattttgaaatcaaaagggatattgggtgcactctttccagagaaatataactttctgaaagcaaaaaatccttgaatgtgaagagaacaaaaatccgtgaaaaccatgaggtagtcaaaaggagaaaaataaaagaactgctccacacagacttggctcggctgaaatgaaatggcctggcttggctgcagaaggcagtcagcattgatcttacgatgttctccactgctaaggaagggagaaaacaaacagggttgccaagggctgaggaaaggcagggcaggaacagaacagcccagcactgggatgggcagaccccggggctggggcagacaagagctgcagaaggccctgcaagctgcagaagggccaaggaaagagagattagaaatcagccaaaaacacaggtttagagcgagtgaggaggagggagaaccagagtcagctatatggtgtgggcgagccagtgccatttccagatgaacttcaaggtggtaaaagcagagcactggacccagcacaggacctcgaaccaagcacaggat

SEQ ID NO: 136216 - DNA, 364 bp, Homo sapiens
aaaatgatgaagaaaaacatataaaatatatcacacaagtttatttctccctaaaactgccttatttcttcccataagtaaaattcctactttatcacaatccttgtaatgtttataatttgggttctcacatagaaaaacaaacatccttaacgtttcaagttaacatgactttaggaggtaatatgatggttgtttatttttcagaaaacatttttatgtgtttgtttttatctagggagtctacttagaaaatgtcatctattgcataatgttagatgtaaacttgcagagacttcagccacgtcacttaactgccctgaaaatgtcttctctacagtaaaataacagcagtgaacgaggt

SEQ ID NO: 136217 - DNA, 252 bp, Homo sapiens
ggagggagggaagggaagggcatgtaaagctcttagcacagttgctagaacatagctagtgtcctaaataaataaataacaaacagtaagtaaggcaatacaaaagctactactacacaactttttaaaattatttctaactagcattataaatcattttttaaaagacaacctgaagaatgggagaaaatatttgcaaatcataataagggcccaatatcctgaatacataaagaactcttgaaactcaac

SEQ ID NO: 136218 - DNA, 344 bp, Homo sapiens
cgcctagataatcccagctactcaggaggctgaggcaggagaatcgcttgaacccgggaggcggaggttgcagtgagaccggatcgctctccactgggcgacagatttgaatctacgctgtgcccatctatgcagaatgaagatttccgcaagccgtaacagatggttccctacccattccagagctgctaattataaccaccagcttcaggcggtaggctgagacctttattgttttgtgtacatttagtcatcagtaaaccccatggaataaagccaagtatgtctgctctacaaataagaaaattgaggcccagagagactgcccaaggtccctcacagta

SEQ ID NO: 136219 - DNA, 527 bp, Homo sapiens
cacggtggctcacacatgtaatcccagcactttgggaagccgagtcaggaggatcacttgaggtcaggaattcgagacccgcctggccaacatggtgaaatgtcgtctctactaaaaatccaaaaattagctgggtatgggagtgcgtctgtaatcccagtttcttgggaggctgaaggaggaggattgcttgaaactgggagggggaggttgcagtgagctgagattgcgccattgtattccagcctgggcaacagagcaagactccgcctcaaataaataaataaaggtaatatcaactcactgtagaaaattatttatacatgcatacatgcacatatatataaatgtgtgttcatagatatacattatatgcatatataaataaaaatgttggctgtgccgtggcattcaaggacacgctccttggagtacagttttcgactgcagctgtgcctccacaaagaaaccacaagaacaaatccagggggagggctattgttgaaagaggtactccgatacttctc

SEQ ID NO: 136220 - DNA, 445 bp, Homo sapiens
agccccaccctcggtccctggctcacttgctctcccttccctggaacaacgccctgcttcctttgcgcccctgccagcttcatggcctctttctctgctcctgcaagtctcggagctgggggagctgggggagctggggattatctcgcaaactgcattttacagataaggaggctgaggactgacagcttcctgtctagttgggggaatgaggtggaaagaaaatgacagccaacagccaagtcactgagggaggccagcagatgccccaggagagtgagtggccatggctgaccacagcaggcaggggcttccaggaggaggtgacagctctcacaatgtctcaagtcctccaaagagcagcagcccacagctttggggtctcagccattcctcccacaaacataaaaagagaaggggcctggggtctctcagattagcagac

SEQ ID NO: 136221 - DNA, 387 bp, Homo sapiens
atatttcattgtgagctaacatttggctgatgttcatatgtgggaatcttggggccctgggaaaggaagccttctcctgggaggatttgtatgtgctttgttaggtgctttggggcctaactcctgagaactactctgagctaacttcttgaatttggatttcactgatcatgcaggtgttgtaaatttgaaacccaaactttatgaggacaggcctgtggccttaaattctcagtaacacttgctttttcaccacctagagctgggcgtcattcagattaattcccgtgtcccttcttttacccagccttccatttcacagaggctgtagctttgaaggattcaattttgtggtgacttggttccagtcatcactttttgtctctt

SEQ ID NO: 136222 - DNA, 164 bp, Homo sapiens
accccttagtagagaagttcaatagcacctagtgttagaagttcaatagcaaaaaaagaggaaaagaggtctcatgtacccaacacccaccttcccccagtggtgatatctttacatacctatagtgcattatcaaaacgaggaaattagttggcacaatacag

SEQ ID NO: 136223 - DNA, 597 bp, Homo sapiens
tgcccagagaaagaggaagaagctgagtgtgagacagaaaggaaatgggatgacagagagagaatagaagaggaaaattagcaagagagactaaaagagacagagatcaaagagaaacacagaaggtaaaactggggagacaaataatgtaaaaggaaaaaagagtacaagacaaagtgagagaatgctgagaggttggcagggctgggggaagtttctggggacttaagcaacaaggaggtgcaggggaagggtgcatgcagtgcgtggccactgaggaacgacaaaacccgggaactgggggatggatgcaagtgagaaagggatgtggaggagagtttaggatcaggctgcttgaggtgtaacgggttgcctacagcaaaaactagatggctgtttatcaggaggtggtcaaaaggattcaagttatggaagagtaaatgaataagataacattaaggttttgttgttttagtgagaggctggaaggccaccaggggcagttagctgtcagtaaggcagcagaagggctggggtcgctacataaggaaaatcagtactagggttgtaaactcaaatgactacagggccagcaaa

SEQ ID NO: 136224 - DNA, 404 bp, Homo sapiens
ccccaccgggggcctggcctggagcagaacgcagcacacagcaggcgctcaaacgtgtctgtgatctggagccacctctgggagatggacttccccggagctggagccatcctgggagatggacttccccagagccggcaagtccctccccaggcagtgccaggcccagcccaccaggcagcacctttaggattctctgaattcactcgtcaatcaattaaacattcaggaaggaggctctggaaaccagcactgtcagccaacggggagaaggcggggaagaaaggagcgctgaccaggtgccctctccacacggttctcatgcaatcctcacacaccaccaagagatccagcgtgtatcagcccggctgacatgctggggaaactgaggcttgcatgacctg

SEQ ID NO: 136225 - DNA, 119 bp, Homo sapiens
tctgatgcatagccaggtctgtagtgagctgccgatgagggacttggcagtggccaagagacaagttccctccagaatgcaggtaagcatgggagaatgccaggctagctctagcccca

SEQ ID NO: 136226 - DNA, 425 bp, Homo sapiens
ttatgggatggtgaaaacaagtggaggttgggagtcaatcagagacaggatcaagacttgtttgtgggctcaagtgtcttgtttgggtgtgttagatgaatcatttaaccccacgtataaaatatcagtatgtttgtatgttttcgcacctctcacagaaatattgcagttacaaagtaaatggcatcatctggttccccgctccccccacaataaagctctaccaacacaagaaaaaaaaataaataaaagaaaagaatgtgtaaactaaggcacagagaaattaagtaacttgcccaaggtctcacagttaactagtggcagagctggggtttggagttaggctaacagctgtaggcagtggctacaccaaatggctcaatccattattcgtcattttcagtcttccataagtgacttccctt

SEQ ID NO: 136227 - DNA, 603 bp, Homo sapiens
  misc_feature (538)..(538): n is a, c, g, or t
aaaattttcttgctacaccatctgtaaagggggttgaatccttttattcttcacagcaatttataggctgagttttgagataggtactagtctagtgtgcctggataagatggcacatgtaaaatcatcccctgaacttgcatacaccccagctgttgcaactcaagtctgttattacatgacagccaagaaagagacttggtaccttttccttattcattactgtaacagttggttctgtttggacttcctgtaatttctactctattgtgaaataatttacaccttgggcttccgcaatgaattccagaatctactcctggccatcatgctctcggccactttaaccattcccatctggcagtggttcttgacccggtttggcaagaagacagctgtatatgttgggatctcatcagcagtgccatttctcatcttggtggccctcatggagagtaacctcatcattacatatgcggtagctgtggcagctggcatcagtgtggcagctgccttcttactaccctggtccatgctngctgatgtcattgacgacttccatctgaagcagccccacttccatggaaccgagcccatcttctt

SEQ ID NO: 136228 - DNA, 1061 bp, Homo sapiens
  misc_feature (70)..(70): n is a, c, g, or t
gctagggcccggataggaagcaaggggctccacccaccattctgaccacctgcttggctgtccacccccncaccctcaaaccctcagaggaaggattatttttcccactacacaagtgaggaaccgaagcctggaatcacacggtcagctgactaaggtcactccaggcccagaacctgcgcctccctttcttcctgtggtggtctttactctcaagatgtttctgccacagaaacaacaggtagctcctaccttcctcatctaaagcctcagatgggtaatgggcacatcaaaaaaacaagcaagtaaacaaaaggtggcagaagcaaggaaaagccacaggaaatgcaatgactactcatcacaaacaatcacacaaaaagaagggtttgctattgtgaaatatgtatttggtcttcatcccgggcacttggcagggattccaaacctaaaatcctcggaatctccacagtgatgtctttttgcatgtgaatgattgactgagggctggcagtccctaggcagcttcaggatggggctggttaccagaaagaccaaggcaggatcagtcccggtaaggggagatggactgaagattaggtttatcaccaatggccaatcatttagtcaatcatgtctccataatgaagcctccataaaaagacataaggacaggctcaggaagcttctggatggctgaacacacaaaggttcctgaacggtggcactgaggtatggcatggaagctctgcactccttctcccacacctggcctatgcatctcttcatctgtatcctttgcaatatcctttataataaataggtaaatataagtcaatttcgctgagttatgtgagccactctaccgaattaattgaacccaaagaaggggtctcaacttgaagctggttggtcagaagttccagaggcgtggacttgcactgctgggaagaaaggagtgttcttgtgggactgagccctcaacatatgggatctgaagctatctccaggtaaatatcagagttgaactgaaggacacctagctggtgtcctgcaaaact

SEQ ID NO: 136229 - DNA, 633 bp, Homo sapiens
  misc_feature (70)..(70): n is a, c, g, or t
gctagggcccggataggaagcaaggggctccacccaccattctgaccacctgcttggctgtccacccccncaccctcaaaccctcagaggaaggattatttttcccactacacaagtgaggaaccgaagcctggaatcacacggtcagctgactaaggtcactccaggcccagaacctgcgcctccctttcttcctgtggtggtctttactctcaagatgtttctgccacagaaacaacaggtagctcctaccttcctcatctaaagcctcagatgggtaatgggcacatcaaaaaaacaagcaagtaaacaaaaggtggcagaagcaaggaaaagccacaggaaatgcaatgactactcatcacaaacaatcacacaaaaagaagggtttgctattgtgaaatatgtatttggtcttcatcccgggcacttggcagggattccaaacctaaaatcctcggaatctccacagtgatgtctttttgcatgtgaatgattgactgagggctggcagtccctaggcagcttcaggatggggctggttaccagaaagaccaaggcaggatcagaagctatctccaggtaaatatcagagttgaactgaaggacacctagctggtgtcctgcaaaact

SEQ ID NO: 136230 - DNA, 422 bp, Homo sapiens
gtgcattttatggctgtctggcccaatttatatcagttaaaaatatacccacaattttttaaaactttttaagtgagaatgcttgatttagaactggatgttacagtcatataccattcattataattcagtagagacacatacataatctgcagagaaatatttagattctctttctcttcgttgttttctttattcactttagagattgagtaaacaggctatctttataattattatttttcatacagctaagtctatattctactttctttttctttttctttttgacatatagtcttactttgttacccaggctgctgtgtgatggtgcaattatggcttactgcagcctcaacctcccaggcttacgcgatctttccacctcaacctctcaagtagctgggccacagttgctcgcc

SEQ ID NO: 136231 - DNA, 153 bp, Homo sapiens
tcatggtacccttaaatctacacctgccatgctaaaactatcaaggtgtaaactggtcctagaagagacaacttaaatttgatcatacttaacattagcaattactttgtaattactttatttgatttgtttccatgggaattttgagtgttc

SEQ ID NO: 136232 - DNA, 606 bp, Homo sapiens
tgaagacacaatgtggaaggtctggcgcacctgatgatgggcgaccaaggtaaaagtaaagattaattcaacaaatctatattctagagcagaaatacaatcatgactatgacatggcatccacagagtgttcatataacaaggaaatgaaaacatttgggcaagttagaatgaatgacagaatggaagtgctgtgagactggtacaaagtgaagtaggaattcagaaaaaggaaagcataacatcaatccaagtctgtcttatgtgaatatccccaccttgtgccatctgttggaggaattaaaaaaaaatctggaaaaaataatttaggaactttacattgcaatttcctatgtggagttaaatcctagttgtgcataaaatcggggttaagtctggacagtttatataactgatttacagtgtaaacttatgtttcctaaatttttatatctcaatataatcatggagcaattttctcaatttccccacttttctcttgtgtgagtagtgaattcaggggatctggaatgaagttttgtggattaatgtctttctttatgaaaaaaagactataaaaaaataaattcaagaacatcttcatta

SEQ ID NO: 136233 - DNA, 144 bp, Homo sapiens
aatatgactaccaacttaatttcttagtctttgtttcagataatatatctcagtggagtatttagagtttaagaagatgagtaatcatggagctgagtacttgataagtttgagaacatgttcatgatcattgtggggatatga

SEQ ID NO: 136234 - DNA, 209 bp, Homo sapiens
ctatgtcacctacagcatatacactggtccttttgaccctacacattcccatcctctgaccctacatgatcttggctaacctgccttcctataccagcagaacctgtatttcttttttagaccctgacaaatgttaggtcaatttgtcagtgcatttgtagtcaaaatttggttgtctagatgtggatgaaccctggcgtaggtgcaat

SEQ ID NO: 136235 - DNA, 405 bp, Homo sapiens
aacgctagtcaacaggcctcaaagtgtacacatgaagacacatcttccttcatcctctcgccagttgacaaattaatgattacacgttcaggcattttacccagatgcaataaaattaagaatgacatcttagaaaatgtggttcaagagaagacatacgcagggattgacaaaatccatcttacttcctttcgaatctctttgatggttacttggttctcaaacacagatcactgctaacaggactcaaaaacaccacttgggaccatcaaccagtgctgcttcgggcgacccgctgggaacacccccacctgacccaagcgtccaccactccttgagcacaagctctgggggtgacctgtgcctgccggcttagttttagaccctacgggaacagctgacatc

SEQ ID NO: 136236 - DNA, 147 bp, Homo sapiens
aacttggaagacatccattcagttggatggagagtatttaatcatttaaaaagtaggccaaagagacttatctcaaccatactgctaaatagttatgagctgcatcatacataaattaagtgtgctctaactgggggtatggataga

SEQ ID NO: 136237 - DNA, 668 bp, Homo sapiens
tgtccgtgttttgacaattcctggaaattaattggtacgcgtatttctcatggccctaacatgacgcaaagcgggagaaagcaaagcaacagtgcggggcccggagaccacgctggaactcgctctgctagaggttcccaggtctctcggctggcatgtgcatttcacagaatgtttaaaaaatacaaaataccaatttctccccttcagggcttacttcaagtgcctcttgactttcactgaagtctttgactgcttcttctcttcccctccagttttacaaattattctcattttcaatttaactttttcagtccttaagcttccctcatctattttcataataaaacaatattgacagatgagaaaacggtaacaaattagataacttagatgaaatggataaattcctagaaagacacataccactgagactgacccaagggaaaagtaaaaaatctgaatagacctataataagtagagtgaattagtaatcaaaacaatacccatggagaaagttcaagactaaatggctttcctggcaaattgtcccaaatctttaaagatgaattaacagcagttcttcacaaacttttcgagacagaagagtaagaagcacttctcaactccttccatgaagccggtattaccccgataccaacaccag

SEQ ID NO: 136238 - DNA, 515 bp, Homo sapiens
agtcagtgctcgccatcgtcatgtgctggtgccataggaagggtgggcaccacaggaagggtgggtggctgccataggaagagagccagatgtggcaggagtgagccagtggaaagctgttctgagaggcagctgcctgaggactgggtagaccctggacgcaacagagctgccacctgcccagagcaggctcagtaatggtggccttggagggcaggggacagggcccaggggtctccaggagctgtacccgtgagtgaggctccaggatctgccagtgccctcaggactctgccccaagggccttggcactgaccaggtgccttggatggacaccgaagtctgtgtcctcagtgggagggtcacactgggctcagggccaggacaccctgggccttccatcccaggagagacgagcccccagccagtgcaaggggccctggctgaggaaaccctgggcctctgcttgcccagctccaggaaaagttgccctgccaggagggaggtgcccaggc

SEQ ID NO: 136239 - DNA, 173 bp, Homo sapiens
tcccaattcagaatgcccaaatattctccatcctttgaggaagtgacttgcctcccattttcttcatgtagattgtttgtttttgtctctatatattcgtttagacacttgttgctcaaagcaatagaaacccagtttaaatggcttttaataaattgttttgagtaaccacc

SEQ ID NO: 136240 - DNA, 240 bp, Homo sapiens
caatgttacttttttgttactgaatagtattccatgatatagatatatcatagtttagccgttcgtccattaaataacatctggccgggtgcggtggctcatgcctgtaatcccagcactttgggaggccgaggcaggtggatcatgagatcaggggatcgagaccatcctggctgacatggtgaaactccatatctactaaaaatacaaaaaattagccggtcgtgatggcggatgcct

SEQ ID NO: 136241 - DNA, 201 bp, Homo sapiens
aaggggaggaagaaaaacagggaaaaaactggtcggtggtccattcagaacacataaacatttatagattacgctgactgtcttatagtggtgtagtttgtggtgtcccaaaacaattacaatagtaacatcaaagatcagtgatcagctgggcgcggtggctcacgcctgtaatcccagcactttgggaggccgaggcgg

SEQ ID NO: 136242 - DNA, 394 bp, Homo sapiens
tttaaagaaacttagtttaaaacccactttaataacaaaattatagagactgagaacagaatagtggtttccaaagaatagtaacaggaataagtggtgggtgtcactacaaaggagtagaatgaggaggtctttggtttcatggaacagttctgtatcatgattgcagtggtgctcattctaatctatacggagaatcaagttgcgaagaactatacacacaggttgggggaagtgaaagtcccagagggaactaggggccccagaagggagtgctttaaaggctgagaaatacggtttgaatgaggagttgggggtcctagaagaaggttgaaggtccaagaagttgagtgttggaaggtgtgagattaggatcccaaggagtgttggaagt

SEQ ID NO: 136243 - DNA, 100 bp, Homo sapiens
atatcccagtcagatgggagatgtagcagaatgtgtttcttgacctattagaaaacatgctgtgagataatggggtaggagagattaatcccactggacc

SEQ ID NO: 136244 - DNA, 404 bp, Homo sapiens
atcaccaaaacacattgtaactttgaaaaactctttcccttgggaaccgtcatttgatccatatagtggctatgtgatggtggttcaagtgatactgggcaccaagtaattgaacaagaatttcctaaatgtgtttggtggaatactaaagtgagacttctttttcaaaattttgtttttattttctatttttaacatttttgtgggtacatagtaggtgtatacatttatggggtacatgaagtgttttgatacagacctgtaatgtgaaataagcacattatagggaatggagtatcccctcaagcatttgccctttgagttacaaacaatccaactacactctttaagttattttaaaatttataattatgttattattgactatagtcaccctatcccta

SEQ ID NO: 136245 - DNA, 809 bp, Homo sapiens
gacaactgagtgatgtcagagcaccagggggtctgtgaaacagttcataagaaaccataaatcaggggccatacaaaagagctgagcaaatgagacatgccaagtgaccacgtgacagtgtgtgagaaacttgtaaagctgtgcacgtgtgtccgtgatgagctgaccatatgaagaaaatgacggtgtgcacgactgagagggcatgggtgactgtgggtgacttatcgagggcctagtggtgattgtgaaatactgaccgagtatatcagaagctgactgagggacagtgatgactgagacagtggctgagaaacggattgtgtgtccatgggtaaaccctttgcaagagactttatgaaaggctgtaaatcaaggactgagggtactggaagctgattgagaagaaacgtgagactaggtgacgacagtgtctgagatactgtgtgattgtgtatgcgtgtgaatgtctttgtgggagaggctgtaatcagggatcgtgggtgtgtgaaaaagtggcttgagtgagaaaggggtaggagaggtgatttttgtgcatgtgtgggaaacttcatgagagactagttagtggtgactataaatcagtgactatttgtgtatgtgagaaagtaacaggccaaatgagtgcctaaacgtttcatgagattgtgtgactgcacgtgtatgtaaggaactgactggtgagagaaactattggcaatattgactgaatgagacaggctgttaaacatgattgtgtgtgtgaaactgttaggagactgtagtaaggctggaatccatgacacaga

SEQ ID NO: 136246 - DNA, 680 bp, Homo sapiens
gagctcggtaccgacgctctctctgtggggctctgacacaacaggattaggttttataagaagagactccaggccaggcatggtagctcatgcctgtaataatcccagcactttgggagaccaaggcaggaggattgcatgagcgaagccaggagtttgagaccagcctgggccacataatgagaccccgtccctacaaaaataaaaattaaatctagccaggtgtagtggcatgtacctataatcccagctgctcaggaggctgaggcaggagggttgttgagcccaggaatttaatgctgcagtgagctatggttgtgccactgtactccagcttgggtgacagagtgagaccctgtgtcttagaaaagaaagcaaaaggtaatgacattttgacactaataaagtaggaaggccatccttttagagtaagggataatcaccaaggtattctgtgcctgcaggctgaggagtaggggaaggaggtgaacacgtgagccatccttgtctccagccccatcctgctgtgcatgttcccctcatatctcccaggcttctgttctccaagctgctaatggccttcatgaaagtagttcagtttctcagtcttcttaaacagaccagacacctgcctgactggcagagaagcttgctggaagaccgttcactgcctggttggc

SEQ ID NO: 136247 - DNA, 460 bp, Homo sapiens
tgctttgcctcatccaatcatcattcatctcttggttaggtggtgtttaaatgaagcatggaataggtcaagccttctcatagcatttacaacatataagaccttataggatctggcctctgtctcctctttccctcagcactttatcatgtagccacaaactatttgtagttccaccagattctctgggatgtatcatacataactctatgcctctaaactcttcgctctgcctgaattctccttttctctcttttatcttagtgaacatcagccaagacccaattcaaatgtaagctgaactgtaagactttctctgaacaccatctctgcttctccactgcaatttgaccactgcctccctctgccatcttggaatcttatataagtaagtatattgtagtttttttttttttttttttttttttttttttttttttttctgggggaaaggttttag

SEQ ID NO: 136248 - DNA, 181 bp, Homo sapiens
gtggcacatgtaccctagaacttaaagcataataaaaaagaaaagaaaaaaaacccaccacaaaaaaaataaaaaaaaataaaccaacaaacaaacacaacctaaattccctgaatgggcttaacagtggaatgaacattgcagaagtactgatgcctcaagatggatcaatagaaatgat

SEQ ID NO: 136249 - DNA, 252 bp, Homo sapiens
gaggaaaaagaagaaattcatccataagtgagaaccaacagacactggctacaaggcaggctgtcccatgctcagtaaggggtgctggatcatgcatagtgttcccaggtcattctatgcttggtaaggggtcctgggtcacgcacagtgctcccaggtcgtcccatgctcggtaagggtgctggatcatgcacagtgctcccagtatataagtgacaggcactcagtctgtagctatttgcctaagttttt

SEQ ID NO: 136250 - DNA, 493 bp, Homo sapiens
tgattttcttgaggttactgatagaatccatattttagttggatttatttttattcattctcaatattcccaacctgtttccttctcagtctttcccttctctgtaaatgtagtaaccagctgccagaagactgggagtcaccctccattcctctctgatgcctcctatcaaataaagattgcctgctctgcctccagaatctctctcatttctgctcacttttctctatgctctgccaccatcctagttcaagtcaccacaatttctctctgtaatatcacgatagattatttgctggaggtgcagtttttaatatagagaaaaaattgaccatttaaacccttttcagatgtacactttagtcatttttagtatattcacaatgttttacaaccattactagctctagaacattctcatcaccctgaacgggaagtggaggtcgccccactgcaccagcctggatgatgagtgaaactctgtctcaaaaaa

SEQ ID NO: 136251 - DNA, 797 bp, Homo sapiens
tgattttcttgaggttactgatagaatccatattttagttggatttatttttattcattctcaatattcccaacctgtttccttctcagtctttcccttctctgtaaatgtagtaaccagctgccagaagactgggagtcaccctccattcctctctgatgcctcctatcaaataaagattgcctgctctgcctccagaatctctctcatttctgctcacttttctctatgctctgccaccatcctagttcaagtcaccacaatttctctctgtaatatcacgatagattatttgctggaggtgcagtttttaatatagagaaaaaattgaccatttaaacccttttcagatgtacactttagtcatttttagtatattcacaatgttttacaaccattactagctctagaacattctcatcaccctgaacgggaacccaaacccattaagctgtcattcctattcccctaacccctggcagcctctagtcactttctatctctacagatttgcctattctggatattttataaaatggagtcctggccaggaacagtggctcatggctgtaatcccaacactttgggaagccgaggtgggaggatctcttgaggtcaggagttctggcaaaaccctgtctctattgaaaatacaaaaaatccagccaggtgtggtggcgcatgcctgtagtcccagctactcgagaggctgaggcacaagaattgcttgaacccgggaggtggaggtcgccccactgcaccagcctggatgatgagtgaaactctgtctcaaaaaa

SEQ ID NO: 136252 - DNA, 640 bp, Homo sapiens
caggaagtagtcctgtggtgggagggagagaaagggtaagtgtatgtgttgtgttacaataccattgtaattatggtagtacgagtgctttaagattattaaagagcctctccccacccctgatgtaattcgatttctttgaaattgacttttggatttatatctatacaattaaactagttgtattaaaagaagtcttaaaagccctcctgtctatagtaacaacttttccatgattttatcatcatttgattaaggaccagtcatttaacactgattgtgaaataggaggaaacacccatttaaccttgaaagataaatttaattattttctaattttgcattcattctgttggttttgaagaaaagtcacctgtaatctttaaccacttaatataaccactattaacattttatgtctttttcctatgtataaataagtttttaaaacatacctaaatacctgatcttatcatttaacatttaaggagaatggtctttattcctctgcctttttcctaaatgttgatgtgccggaggtggaggttacagtgagccaagatcgcgccactgcactccagcctgagcgacaagctcaggactccacctccaaaaaaaaaataaataataaacaaagggg

SEQ ID NO: 136253 - DNA, 573 bp, Homo sapiens
caggaagtagtcctgtggtgggagggagagaaagggtaagtgtatgtgttgtgttacaataccattgtaattatggtagtacgagtgctttaagattattaaagagcctctccccacccctgatgtaattcgatttctttgaaattgacttttggatttatatctatacaattaaactagttgtattaaaagaagtcttaaaagccctcctgtctatagtaacaacttttccatgattttatcatcatttgattaaggaccagtcatttaacactgattgtgaaataggaggaaacacccatttaaccttgaaagataaatttaattattttctaattttgcattcattctgttggttttgaagaaaagtcacctgtaatctttaaccacttaatataaccactattaacattttatgtctttttcctatgtataaataagtttttaaaacatacctaaatacctgatcttatcatttaacatttaaggagaatggtctttattcctctgcctttttcctaaatgttgatgtgccggaggtgtccttgggtctgtcacctttatggtgaccat

SEQ ID NO: 136254 - DNA, 684 bp, Homo sapiens
ccttcggtttgaggaaatcctttactattgacctggtcaaccttctctgttacccggaagctgtcttcccttctcccccttttgacctttttaaacttttctcttggtttccccgctgacagaaagataacaaccctctcaatatcgtgccctcttagagactcatgtctctcggcttccttgcacagccaagacctgaaattgaaattatccttactatctcaattcttggtcacattctctttccccatccccactcttcaagctacctctgtcaggctgctaccaccaaaacttttctggcagatgtcaccaagaacctcctaactggcaaagtcaggaagcactttacagttctcactttatttgacctctgaggcattcgacatttgatcatgtttccttcctgacattctctctacccttgacttctataccactctcacttgtttcttttcctatttgtgtaactgttcctctccagtctcagtagatttttcttccttagcccctttttatgtgttgatatttgctgtgattcttgtttgcttctaattttgttcaacttctctaggtaatctgactccatggctcaaagcctctgaagtctgaatctttagttcagacagctctctaagctaaactttctactaaatattcccactgggataactctcagacacc

SEQ ID NO: 136255 - DNA, 462 bp, Homo sapiens
tgcatatgagctgttttaatttttgttgcaaaggatttctggggagtcaaggggtatgtcagaaattagagccctagggcagaacttacaaaaaccttttagctacttccttctccccggcctcggaaatgaaaaagccaaaaggtcacccagcgcatccgccacccagtcagccccaaggccagccgtcctcaccccagtccgggtcctcgccattggcctctccgctgcacacggccacctgttgatgccctcgcgcccacagccgagttgcaaacggccgctagagttcgttctaattccccagagcagagctgcccgggaagccccgacgcgacgcgcctgctaatctgcagggcgggcggggactccgcagagcctcccagccccaggctccctttgttttctcgctgcgctcgaagcttctaaactagcccccagaccgcatcccctcgtccccgc

SEQ ID NO: 136256 - DNA, 430 bp, Homo sapiens
tctattatatatcttttaggtgtctcaggagctgtcccacacaccgttgacaatgcaaacccaattcttaaaatgaagatatttccatttgtgtacagaggccatgcaattatcacaagtaattcacttaagcaaacacctactgccttgagtcatcttttcatctttacatatacttcacaccatacataatgtcaagggctccaggcctaataacaatgctcctagaagctaagtacttaataccaactcttctgggatgaatttggatagaggatgaatatttgatatcataatgatgtgaaaaggagaatctgaaactgggttcatttgagtgttatcctctcagtgggcaattaacatgaaatggtcttactttaatcacgtcaaggctaccaaactttttcttttcttgagacaaagtctcact

SEQ ID NO: 136257 - DNA, 441 bp, Homo sapiens
atatcgaagtctagaactggcacagcatcacttatgcctcattctactggtcaaaccgcatcataaggctaaattcaaggagagggaactagggatgctatttttgatgggaggagtgacattgagcattgagaggtgggaagaatttttggtgattggatttgtagaaactgtggttaaatagttgacggattatttgtatataagtctgtgtcccttccatggtagttccataatgttttctgcctggagcaactagtcttgaccgtatctgctatgcatagcacagtacctggtacacaaaaagatttcagtaattgattgttgaatgaattaataactgtcttgccattttcagtactttaattatttttccaaaaagtggatcaaatgttctttttttaaaaaaaaattacatgtttttttaattttcaaaaaata

SEQ ID NO: 136258 - DNA, 469 bp, Homo sapiens
tggaggataaaaggagtagttttatgagcaaagcttaggggatgcttatatcattttccctccacttcactgcctcagaaatatgccctgcttaaatgtagtacagctgtgtgcccagaaaggaagcatatggccagcccctgccacagttgacctcttataacctaatagtttcttaattgtgtttcttggatattaaaggcaactttatttacctaaatgtatttataacctaatttcactgtctgggacctggagtaaatgtggaacactatcagtgttggttataatttggtgtttcctgtcggtttctggtaagttttcccaaacaagttaaaatgtctaattctattaaatatgttttgacatcctttgaaataatcatgattctatcccccaatctattaatagtattgtgatagaattttttctatcatgaaacattattacatttttggaataaactcaa

SEQ ID NO: 136259 - DNA, 427 bp, Homo sapiens
gatgtgcgatgttctaggaacgtccggctgtgtttctgatcacggctgcacacgagaccgaaggccctgaatctcctgttatgtctaccccagcctgtgaggaagggcgctcccaaacatcagacgtgttaaaataccataagcgagttaaggtaaacatactctgggtagagtttctgcaagacacaagcacaaatccgattgaagttgcttctgataactgtgtctgctggaagaagaaaatccaacctggaaagggtggagccagggataagcacctggcccaggagcccagggcacagaaagaatcacggacactaatgctcactcacacatgcacgcacgcacatgaacacacaaacatgcacgtatacacactctctcacacacgcatgcatacacacacatacacatgcacgcatactca

SEQ ID NO: 136260 - DNA, 344 bp, Homo sapiens
ttttggggtagatgatagtattatctctattttgtgggtaagaaactgaagtgcatgtagaaaggttacagaacttgttagtgtcacacacgtagtgagtctgactccagagactccagtctgattattattgctttattattttgagctcattaaaagagggtgacaaatactgtaccttttgagaacttacaaatgaccgtggtatgtgtgcagaagatgtcctagacaaggaagacaaggagcaggtaggagggcgtgtggaacaattcatgaaattcctcaagacagtggtaaaaacatttttctggtttcttgtttccttgtcacgagagtccacatga

SEQ ID NO: 136261 - DNA, 272 bp, Homo sapiens
tgctcgacatccttccagttaaacccgccacttcatcaaggaaagaaagacattttcccggctagcactgatctgtgggcccttctttttcaaaatgggagatggcagaattttatacagaaacagtcgctagttccaaccagaaagcccagagacacaggggagccgctggtggccacacaggtgaagcatgaaaggctaagaaatggaaatgcagtgctgcacatggccgggagcccgggtccggctgtgggctgcagttccgtgatccc

SEQ ID NO: 136262 - DNA, 749 bp, Homo sapiens
gcagccccagccgtctggtggctccttcctggggccctgcgggctgagggattagccatgaccctggcaccagcagctggatcggctaggcctagggcccacccctctgtccttagagcagaccctgtgcagagcccgtgctggccggggctgagagggttttggcagctgcccccctgcactccctaccccagcccctaccagatcctcctgtcagggacctttttccccagaggagtcggggaccaggagcacaaaggcctgttgtttgcggagtatcacatggctccgtgtgtaggggcgcggctgggtgctgtgcagacccagttccatcccgggctcactcactgtccagcagtcactgaacctctcagcgcctcatcgtcctcatctgtgaaaggttgtatgctcacctcagatgtgcattgtgagggagacactaggtaactggtgtacgtgctcagaacagggcccggcttgtcacaactgcttgacaagaggcagccgttgtcatcagacaggctttgacccaaggcctcctgactcctgcgcccgagtcatctgcttccttcctcctcccgggtctttgtggaggatcctttaggatgtcagagggttgagcagcacacaacctcagcggcccccttccctggaccacagtgcgacaagtggtgtcacgctctcagaagttgtgcagtgcacagccagctcgatctcacatggcaggcccggtgaagggaggatctcca

SEQ ID NO: 136263 - DNA, 425 bp, Homo sapiens
cccctcattgtgctacaatcacaggagtaagtaacactcccaaggccatgtggctggtgactcggggggcccaggtccaggatcctgccccatctgcaggccagtggttccttgtctcctatttgcttcttggagcagcctcctcataagccaacagctccttcacctgagcccagtcactttgcgctcctccccagaaccaaagagcaagaccatctgccccaggtacagtcctggccatgccacactctctgtggcatcatgaccaaggtgagtggcagatactgaaatcatccagggccactgcaggccccattcccagtggactgttcatcaagggaccctgtctcaggccatctcagccaaccttgttgcccagcacaggtctggcacattggagatgatctgtgttggatggggaaggc

SEQ ID NO: 136264 - DNA, 429 bp, Homo sapiens
gcctggccaacatcgtgaaaccttgtctctactaaaaatagaaaaatcactcagacaaggtggtgcacacctgtaatcccagccaatcgtcttgtctcggcctcctgagtagctgggactacaggtgcccaccaccacacctggctaatttttgtatttttttgtagaaatggatttcaccatgttgcccaggctgttcttgacatcctgagctcaagcaatctgcccaccttagcctcccaaagtgctgggattacaggcgtgagccaccatgctgagcccacaaatatttgttttttaaaaacagcttcactgagatgtaattgacatagtacaattttataagtctgacaaatacatacacacataaatcatcaccacatcaatgtggtgaacatacccgtcattcccagcagttgccagaagtgc

SEQ ID NO: 136265 - DNA, 263 bp, Homo sapiens
acgatagtctcctcactgcttgctatggtctgaatgtcccccaaagtcatgtgttgaaacttaaatctccactgtggtagtagtgagagatggggtcttctggaaatcaagtcatgacagttccaccccgtgcccccgaatggactactgccttctaaaagggctagaggaaaccagcacaggcccctttatgtgcatctgccatgtgagaacagtttttgctgcctctggaggatgcagccacaaggcgccttttttttttt

SEQ ID NO: 136266 - DNA, 698 bp, Homo sapiens
cacacacccatttcaaaacactgcctctcatcttctaagcccaggggtcaggaaactcttcccataaagggccagaccgtaaatattttaggcttttgggaccagatggtctgtgtaccagctattcagctatgccatttcagtgcagaagcaaccttaagtactgtgtaaatgggcaatgctgtgttctaatagaactattttaggccaggcatggttgctcacacttgtaattacagcactttgggaggccagggcaggaggagcacttgaagccgggaattcaagactagactgggcaacattagcaagacaccgtctccacaaaaactttttaaattagccgggtgtggtggcacacctgtagtcatagctactcaggaggctaaggcaggaggattgcttgagcccaggagattaaggctgcagtgagctatgattatgtcacttcactccagtctgggtgacagagggagaccctttctcaaaaaacaaaatagtttattttaaaaagcaggtggtgggccatatttggcccatacaccgtagtttgccggccccttttctaagccatccagagtgttgagccagtgttgaaatgggaaagagaaactgtctagagtaccttctcctaggacagaccttcacaaatgtatttaatcctacttttttttctgattgtttctcatttctagctg

SEQ ID NO: 136267 - DNA, 852 bp, Homo sapiens
cagttcttttgtgcaggctttttgctctagagatcctgaacgttggccagcaatttcccctcacagtttaagtggggccttctattttttgaatgtttgctaggacaacctccttgtgactatccatcaaaacttccagttttgaggaagatctgactgctgaatgaattgttcatgtttgtagaactgcatgttcgtagaactgtgcatgttcttccttaaatcagttctgtaagttacatattctaagaaatctttaaactgaagtttcaagaaacatgacttttttataatactcttgttaatggttccaacatggctgttccccactcattcctgagtggctctttgtgccagcatctttctcacccccacccccctcagctttcttaatcagtcatagcagatgtgtgcttttattccggcaaaccactatcactgccagtgtccaacttagaaaaatgacagtctataaaaaccagtgatgtgaatagtttcaatgggtttgtctttttgaagaactgactttggctttgattctttctacagcgattttcttttgctaatttagctatggatgctttttgcctctcagtgtgtgtatgtgtgagcataaattagtgtcctgtaatttaagctaatttccctattccactatttagtgaaaaattctctccactgggaggaaaaaacaaaagctgctttccaggaagccctcggggcagtcccacaggagcagagctgcacgaggccaggtgctggccccactgcgcggctgttctcagtctcactgggcttccaggccgggttcagcatggttctgaggaatctcagttctcatctcgccccgtg

SEQ ID NO: 136268 - DNA, 1966 bp, Homo sapiens
cttcttctcacagtcgggccctttccaaacattcagagctccaagatttatggcacatgtgtttcaccttgaatccagaagagcccttggcagtgttggtgtgttgtgggctaggaaacttcaggagcaacagagcccagtgacgagtcctcgatcactggcgccttttttttttttaacctgagatgtaattaaaattcattcacttgaaaattcagtcgacgtgtgaactaattaaggatctaagcaccggcttccaagggcctgcctgtcacttcatgtgatgtcgccggccctcccgctgtgagatgcaaacgtctcgcctgctctgtgccctgctacgcttcacacaggggtccacgtgcagctcacgggagctaataccgccaccttccacccgctggcaaaatacagcagcatcctcttaaaagaaatcctgctaccatttcctctggggagaggggaaaaggtagaggaaagggaaagagaaaggaagaagccaccgcccccctgcccacccccacaccagctcctgcatgaggcgtccccaagtagacaggagcccagcagcctcctgtcaggaagggccagacatcccagccatgacccgagcaaaggcccgctggacttgggacagccatggctgcctgagggctgcagtcgggaagccctcaaatgccaggagtccattccacttggccatgaccctcgcggggtccccaggtctttattctgggtgagcagaaggcagagctgactatggacaccccttccttgggcaagacccctcatctctctgggtttcctcataagaggaagtaagatgggtgtgaggaagacaagtttgtcccgcctcaccagggtcacaggaccagctccccaccccccattcactcaccagacaccaaaagcatctgctgtttgccaggcagtcagctgagctccgaagaaaaggaggtagacccacaaggttcctgtcctcaagaggcctccactccaccagaaagatgtgcacatacacaagaactcaccctcagcacccccatggtaaacactgtcaaagctaaagatggaggccaggacactgttcaaacaggaaatgcagggaaagcctctctgacttttgcacagagagcaactgagatcaggtgtgtggaagggctttgcacagcatgcgcacctactccgaatgaaggctgacggtgagtggaggcagcacagaaacagaggcacggggactgcgttctgggcaccctgtggcccacggcacccaccagagaggctctgttgtcaactcatcttagagatggggaaactgaggcttggatgctgcgttgcccaaagtcatgcctcaggggcagagggggggccagagctaagtgacagagcccctgtgcataaagaccctcagagaacccgctgtgaaggctggcggcaaggactacgccggccagagcctccccagtcccccggggccgctcactccaatggtgccgcatcaccaccctgagctgtggcgggtgagtgaggggctcctctcctcgtgtcacagatcagagatgggatgagtcttactcaacacaaggagtgtggctggctctgggcccagatctctcctgagccctcaccaggaaccccctaaatgctgaaaatggcactggcttcccagggaacagaagcggcagtgtctctccacacagagacagagatgcgccccgggctcaggctacagtgagttatgatggcgccactgccccccagcctggccaacagagtgagaccctgtcggcctcccaaaaaaaggaggcaggtggccgggcacagtggctcacacctgtaattccagcactttgggaggccgaagtgggttgattacttgagctcaggagtttgagaccagcctggccaacatggcaaaacctcatctctacgtaacctcgccgattaaaacgcagggctgactagc

SEQ ID NO: 136269 - DNA, 167 bp, Homo sapiens
gccagaaatctctcaaccaaaatgtatcaatatttttcacttttttctttaattatggtagggtattcacattttagtcaaagtgtaaaacttttgtgaatcaaagcaaaaataccttcggatgaacttacttttaaataatttaaagttatctttactttttatac

SEQ ID NO: 136270 - DNA, 759 bp, Homo sapiens
gggttggagagcccccagagactggctggggtaactggttcgtagctgtctaccccggaataaatgccaccttcttttccgcggtgtctgcgggaccctctgttgggggttctaattcgttttggcctgggctccttacatttctgtccggccaggcgcttttggacagcttttcgcagcggtgtctaagcttgtgttcggtgtccttggaagggaggtcccagagctttacaataggctggatttggtttgacatcttttggtggactgtcaaaggggaaaggaaatttttggattacttcaagatcccccaccgcccccgcccaactgacgtttgcgaattgcggctttggaaattggagtgttgactagagtgtggagagagagttgctgatttcattgctttgagtactagtaaaaccatttaagtatcagccggaagggagacagctattgacatttacatcggttctgtttggacctttggggtacataaaatgtcgggttctctgaattttttatcgaatttagaatgtctgctacatttatttaacttctgcaaatgcttaaaatgaaaacattttggaaatgcgaggatttttatcaagtggattgttctcttcatatattaaatgtttacttcatatctttaatccgaaacattaaaatagcattgaagaggcatgattttcaagattaagtgagctatggaaaaggaatacgcttttaaagaacgatctgggaaatgctgttactatt

SEQ ID NO: 136271 - DNA, 354 bp, Homo sapiens
gccagggaagcccttctatggggccaagggtcattttccccttctagctggaccttttgaggtttggcagcttgattttagccataacattttatccacaaatttagaggatcttcacacaggactggagagagctgctgtggagagctttaacccaagacaccagcccagacctgtatacaaaagaatgcctatatttagtgtatgatagccattacaatgattgtcctagagatactggcaattgctgtgttatgcagaaccaggcaccagccttgtctgatttaatatccttttagtagttaaaatgaatttcacaaccttgtttctgtttatcctctgtccctgtgcctt

SEQ ID NO: 136272 - DNA, 294 bp, Homo sapiens
tcatgctgctcctattaatagtggatatcaagttttggcactattaaacatggcctttgcaaactcatagagacagaaagtataacgatggttgccaggaatggggaggggtggaatatgaggagtaattggcagggtcagtttgggatgacgaaaatgttatggacctgtatactgggaatataacaatgtgaatatactaaatgtcacaaaactatctacttaaaaatggttaaaatggtaaaaatttctgttatgcacattttaacactatggtttttttattatacttta

SEQ ID NO: 136273 - DNA, 205 bp, Homo sapiens
aaacatgtcataaggcaagttcagattcaagaggtaggaaaatagaggagtgtaaaatactttggccatgacttccaattcaccacaactctgggatgactgattaaatataaaaggactgttaccagtggaaagccttatgttttcaagtgagtttagatttattaaccacccaataccatcaccctctaaaaccattgaaagt

SEQ ID NO: 136274 - DNA, 969 bp, Homo sapiens
tactgtgtgtctagagctgcactgggcactttgatgaggaggaggagggggagaatggtaaacacctgatattaattgagcacctatggtgtgccaggctccagtactcaatgttttaccgtcacgatttcaatctcttcttccaactattccaaggatagatattattattatcatcctcattttatagatgagaaaatcaaggctcagaaaaggtaaaacaaatacttgcctgcagctacatctccagaaaatggttggtgagatgccaatcattccagttatcccacattctcagggggggtctcagaatctccccaagatacaaccaactcccgagccagccccttcctctctagccctgtgctctcagctgcttaaacaggcttagcagcagggcccttctcattcttggctaattcccaaatgggcttggttgctggtccccctgtccctctttctgtcccaaggaggtgcccagccctggggtagggaacctcgggatgaccttggtgagggtggcagatgatcaacaaagactcctgggttgtactgagccctggcacgtgtgtgaaccttgcatgcacacagcatccaggcagtctcagatgacagtccctgaggaaacctaatcccaccaagatagggacacctgaggacgggggcaggaagggcaggggcctgacacctgtcaaatgaggatgatcccagaaggctgactgcaccattaacaagacttccaccaaagcaagacagacttaggatagatggcaaaataagcgtctataaggaggcaggactggacttttcctcctcactaggagatgacaaagctgtgcttagaggaagcccgctcagagttggcggcatggctgagtcccaaaagatgccacatgtgcccacgacaagtgaccaagttcatccttccgaggtctgttaataattatttatttaactgccacaagttcc

SEQ ID NO: 136275 - DNA, 611 bp, Homo sapiens
gagagatctctctccttttgatgctgggtgcctggatggtattaattgattttagtgatttcttaatccatacagaatcagttaggatggtttgctcccatcttatggatgatgagacagtagtacagagcagtgggatgatttgtttggaaccctggagaccattaattccaagatccaaatcctatggcctgtgctcattttggcagcacatatgctaaagttgcaatgatacagagaagattggtgtggcccctaggcaaggatgacatgcgaagtggtgaagtgttccttatttatttatttattaaaacagggtcttgctctgtcactcaggctggagtgcagtggcatgaccatggctctctgcagccttgacttcctgggcttaagcgatcctcccacctcagcctccctgttagctgggactataggcatgcaccaccatgcccagcaaattttttctattttttgtagagatgaggtcttactatgttgcctaggctagtctcaaattcctgggctcaagtgatcctcctaccttgcctctcaaaatgttgggattacagatataaggcactgtacccagctgtgttctatattaaaaaaaa

SEQ ID NO: 136276 - DNA, 183 bp, Homo sapiens
acaatgaactagcttagactagggggttgggaggctaccccttctcccagtgagaggggctgcacccaagcacaacttcccacagcacctacagctgtcttctccaggtgtgtattatcccacaggtccctaagtttccaggtgttgggcagctggcattcccagacaacttccttttttttt

SEQ ID NO: 136277 - DNA, 569 bp, Homo sapiens
ccacatacaggagaatgaaactggatactcatctttcaccttatacaaaaaatcaacttaaatctaagacttgaaactataaaaattctagaagataacattgaagaaacccttctagacattggcttaagcaagtatttcatgatcaagaacccgaaagcaaatgcaataaaaacaaagataaatagttgggacccaattaaactaaacagcttttgcaaggcaaaaggaacagtcagcagagtaaacagacaacccactgagtgggagaaaatcttcacaatctatacatctgacaaaggactaatgtccagaatctacaacgaactcagacaaatcagtaagaacaaaagcaaacaatcccatcaaaaagtgggttaagaacatgaatagacaattctcaaaagaagatatacaaatgaccaacaaacaaatggaaaaatgctcaacatcactgaagatcagggaagtgcaaatcagaaccacaaggcaataccatcttactcctacaagaatggctataataaaaaaattaaaaaacagtagatgttggtgtggatgaggtgatc

SEQ ID NO: 136278 - DNA, 471 bp, Homo sapiens
caggcccagtcctcgggtcatccaactttctaagttttgccagactgcctggtgtaaagtggtatctcagcattgctttcgttttcattgttctgggtattcatgagttcaagcatctctacctgagcttgatagttttcggatttcttctcctgtgtattgcctgttcatatcctttgctccaacattgtttatagagcactccctccctactttggcatttggggtcccctaaactggcccccattgctaaagcttacttctcatgactgacctttgcccatgctgcatgtggtccaggaacaattcttctgtctttgtttttgctgtcccctcttgcctggattacatcatcttctccaaacccccaatctaaacatgtcccgaatcctaaatattctttagaaccaagctcagatatcacctcctcctggaagggttcctttatttgctcagctggccttggccttt

SEQ ID NO: 136279 - DNA, 355 bp, Homo sapiens
accctcgactcctgtgtgggctaggatgagggtcctctgacaggggcaaggatttgggcctttggagaaccgatccttacgcaggaggccgcaaatgggctttgcaggggcaatcaggagactggacaagggcaaaagaagagcagccttttcccctgggagcccctcctgaaggtggggatggctgggtgggtgcggaagctgaccaggcagcctcactctgcaaagggaatgtgccacccggtcctcagtgtggggctgagcctgtcaaaggccctgcctcagtgaatggggcaagagagacaataagggaaaaaattaataaatttttggcaggcaccatggcaggcaccaa

SEQ ID NO: 136280 - DNA, 568 bp, Homo sapiens
gaggaggcacctgttgtccccaccttgcggtgggtgtggggctggtgggggtaagagggtggacatgagcaggccctcattgtcctggactagggaggcagcaaggactccaactggcaacccccagccccagccctgcacttgtggaacctacattctagtgggtggaagtaactcaaagtaagggcctgcaacactgtggagtacatggtaggtgctcaagaaatgctagcctaggatacctgggacccagcaccacctctagcatcttagcacaagaagggctcccccaggttacctgctctcatcctcaacattgcctgatgcaacgattgtttcttactgataggaaagttcttctgcacggccttgactgactccgaggtttgcaaacatccactggcttcagtgaaggaggggtttgaccactggccctaccttgctcctgacctggggcctgtggggcagctgtctgcacagcacggctgaggcctgtgccagtcccctcctctctggtgagcagccttgagaaatacagaaaggactgggcggaatccacagcagcagc

SEQ ID NO: 136281 - DNA, 246 bp, Homo sapiens
ggatgttcaatccgtttctctcccatgacatattcatgtgaaaattataataataaatcaataatatttaattatctcttcatttttgaaacaaaatcttctgggagtttctttgcattatttcataaacagctagataaatttcatattacatttctgattttgatgttcatagttctgaaagtatcttatctcttccccttttgtattagttttatcggttttgcttttttttttttttttttt

SEQ ID NO: 136282 - DNA, 496 bp, Homo sapiens
aaaataaacaaaatggtgtaatagacctgacactcagcctcaacaactactcatcatgtgctatttctgcttcatctatacttcagctcattccccatccctttatttttttatttttataagataagatgtatgtgcattgacatgtataatctttattgtacctttttgacaaatcagtacacccatataactttttatcctcttaagaatagaataccggctgggcatggtggctcacacctgtaatcctagcactttgggaggctgaggtgggcagatcacttgaggccaggagttcgagaccagcctggccaacatggtgaatccttatctccactaaatacacaaaaattagctgggcgtggtggcacacacctgtaatcccagctactctggaggctgaggcaggagaatcacttgaacctgggaggcagaggttgcagtgagctaagattgtgccattgcacgccagcctgggtgacagagctagtaa

SEQ ID NO: 136283 - DNA, 385 bp, Homo sapiens
catgcaggtggcaagagagagaatgaaaaccaagggaaatgagtttccccttatcaaaccatcataggttgtgagacttactcactactacaaaaatagtacagggaaaaccgcccccatgattcaattttctcccacagcatccctcccacgacacgtgggaattatgggagtacaattcaagatgagatttggatggagacacagccaaactatatcaggagagaaaatagctctagaaagaaaatctctaaaattaaagaaaaaaaagaaaagaaaagaaaaaccttggaataatttagaacatgggaaaacaatataagccctcagtgttgtgtaaggagaaaaacattcaaatttgtccctaataatgttgcaatgagtt

SEQ ID NO: 136284 - DNA, 311 bp, Homo sapiens
ggcaactgactaaactcctcttgctggctttctggagcacttgtattgcccacatttctctggttgagaatacagaaacagcaactagctcccgttccctggaaacctgccccccagcaaggaactgtgggcatctgcagactgctgtgaactgtagacctcatcttaagttcgtcttttgtagaagcccatttcccaccatgacggtcacaagacatggcacactgttgacaactcagggctctgatcccaactagggctactaacttgctgtatgaccatcagcaatacacctgaaaactgaagggggt

SEQ ID NO: 136285 - DNA, 644 bp, Homo sapiens
gctggaattacaggcatgagcccaccacacccggccagatgaatcagatttaacaccagatatgtgtctttaaaggagacccaactcataatatcagcatatcctgactggattaactggtggaaatcagaaggaaagcagactcctcagtctttacttaaagacagaaaacaagcaaattcctggttaggggaacaaatgatgactggtacggacacagagggctaacattcaacactggctgcctccaacagggcacaattggatagtagttgagaactaccttctgaagtaccatttcctgggttcaaatcttagctacagggttgcaggttacatggccttgggcacattccataacctctctgtacttcagcttgcttatctggggagaataatagtacctaccccaggattgctgggaagacagctaatctaatatacttggaatactttttcccatctgattttgaaggttttgtttgtttgttattactcccccctgaacaactgaattaagtgtctttgtgaaaactgaaagcaaatggaaaatttcttcatgaaaattgaatacccttcacctacttgaaaaaggttaattattcaagcacttgattttaataaagccagtgcgtttgcttgtg

SEQ ID NO: 136286 - DNA, 262 bp, Homo sapiens
accggctggaggtctgcgcgctcagtctctctggtgggaagatgagcggaagatgctgaaggagatgtaaaagctgcaaggcccctgtgaaggccaggatacttccccaagatgtcatcctcaaattccgggactaatgtcacctcttcagagaggccagcccttagctgcttccccctcgtccctgcactctctctcacagcatttttcaccccccaggaattggcttctctgtatccaccctggaatttgagttccacag

SEQ ID NO: 136287 - DNA, 535 bp, Homo sapiens
tccaaaaccacacactgtgctatttacgaaggtgacactctggtcccggcagtgggagacacagaagccccagtcaggaggcccctggagaagcagcctttaccacggctcttaagtagtctcagctctggctgccaggctagagggcaaggaggccagcgccagaggcttacccaaatggtctcataatggggcgggcaggcgtagcaggtgcccggcgactgacctactgcagaggccagacccaggatcttcctcccagacaacttgactccacaagcataaagacactgaaacacctccctggaacctgtgtttccttgcaaaagtcaacctggttccacttaggtgtagaccagatgtctgagtaaaactggttcccaagccacaagcgcgccccctggtggttggagaacaagcccttcctctcctcgccaacagtcaactctctccgccgcccctaaaatcatggcccgctaggctcagacctggccaccctgagaggctcaagatcaaccatctggtgcccacctct

SEQ ID NO: 136288 - DNA, 628 bp, Homo sapiens
tggtagcatttcacatcaatgagaagaactgttcataaaggaggtggggcaacggactctcccattaaggaaaagaatgggctgagcatggtgggatcacgcctgtaatcccagcactttgtggggctgaggcaggagaatttcttgagtacaggagttcaggataagcctgggcaacatggcaaaacactgtctctacaaaaaaaaaaaaaaaaaaaaaaaaaaaacctttgttcggcgcgcgcgccttggcgccctttcagaaaagcgttttcttaacacccccttctcgtttgggcgcgcgcgcgcgggcccccttttggtgtatgtgtgaccccttggcgccaataagcgctgtgtttcccttaagggagaggatccctcggggtcctatgagacctacatggcgctgtggtgtttccctcccacccaattataagagaaacaccgccccgggggggagcaacacccagagcgctgttttcgtgagaaccaaattttccgagatattggagagtctctcaagagaggggctcaatacagcggggagattcatactacacccaaggagatctccagagcggagacctccaattattcaaatttacgcccggtctgtggtgtggct

SEQ ID NO: 136289 - DNA, 858 bp, Homo sapiens
tctaattaaccaatttgctaaagaactgcactatttcttcagtggcatctctgcttggaagtcctattcttagtctcagcttcagtacaccctcaagctatcttatttgcttctaaaaatctcttctagtacttctgtttcagtctttgtatagttcctatctgttctttggatattaattatgtatagtcacgtatatatactgtgcagacttatttagaggctttttgtcatattttgcttaaacctgctactgtgcaatcttacattccagttctttcattagtatggtctttttttttcctttctcctctcttctacacttctattctacttttccttcttggtccctttgcgtagcatcttttgcctggccatctcagttttatcttttaagtcctttttctttgttcatcccctgcttcagtgagcttttgcttctctgaactttgataacaagtattactgaaccatttatttctgggtgtagaattcatccaaactgagcttttgagggaaccttattggttatctaattcattctcctggccagtacagctgtcattctctgaaacatccatgacagtatctacttgaatgtttaatggacatctcaaatgtaacgtcagagactgaattccagaccttcctccagttgtctgttcttctcatagtcttcagtgacaactccattcttctgcttgctcaaatggaaagtctcaggatcatctttgactactgtttttgttttgtatccacatccagtttgccagaaaatcctttttggctccaccttcctaatatgtcctgggataatagcagggtgaggaagtcaggtaattcctttccacagaaatc

SEQ ID NO: 136290 - DNA, 401 bp, Homo sapiens
gtgacgtgtgcccatagtgccagctactagggaggctgaggtgggagaatcacttgagcccagaggttgagacttcagtgagtcactgcactccagcctgggtgacgcagttagaccttgtctggaaggaaggaaggaaggaaggaaggaaggaaggaaggaaggaagtaggggaagatgtagtctttattttagtcaaccctcagacttcttttatcaaggaaaatgtagaaaatgaatattgggttacacaattgtctctgtcatggggcttgagtcaataaatcacgtaaatttattcattcaaagagatattagtttccagttttattatcatgaggctaacagaaagaagttatctataaagccccaagaaagaggatatattgagtgaagttatt

SEQ ID NO: 136291 - DNA, 323 bp, Homo sapiens
tgggcaaccctttctttgaaccaaagacctgaccagattggccacaaccacactcacgcgcatttccaaggcttcagtgccagcatcctcgcaaacagcttctgaatgccattcacccaatgtggtcctgggcagcgccctcttgcctatcgcctcccaggctccttgcagcctgatgcaaaaggaacagggctcctgccatcctggcgtccatgctttgggtgcttgctggtggatgccatcaggggagcctgaatggggcatttccagaaccttgctgacctcttaatgaggtttagggtggggaggccagggtgactaac

SEQ ID NO: 136292 - DNA, 383 bp, Homo sapiens
tccaggaattttcaaaaaacttatcttttaatcagccataatagtatgcaaaaacagagaaatgaaggttaacagtcataatttatatattaaaattaaaatacttctagagataaagacgggaaaggagaaagaaatatacaaacaaatgaaaggcagcctggtgaacatggtgaaagcctgcctctactaaaattacaaaaattagcctggtgtggtggcttacacctgtaacctcagctactcaggaggcttaggcatgagtatcactgaacctgggaggcagagtttgcagtgagcagagatcacgccactgcactccagcatgggcgacagaatgagactccatctcaaacaaagcaaaacaaaaacaaaatcaaaat

SEQ ID NO: 136293 - DNA, 406 bp, Homo sapiens
ttttctgggtttttatttttttttctttgccagcagggaagccaaagaaacttgattctgaagtgcaatattgaatagaaatatgtaaatcaagtattatataattgaatattgatcaaatgcctttaagcagggccctatgcttagtgaagttcgcttgttcattccaagtgaacatactcattaagcacctgttaagtgctgtgcaccgccttacccaggtgagctgaaacaggtgtggtcactacccgcatggatcttgcagttcagagggggaggactggcacgtcagttggctgcacaagtggatgtgaaacagcaacttgacgaggactcagtggtaaagatagggagtcagaagtgggaaggctccagcaggacagcacgacactcctgggggatccac

SEQ ID NO: 136294 - DNA, 459 bp, Homo sapiens
aagcatagggcagctgctgccatccacatgttcattttgcctggcagaagggttgaccagaaagcctttcctccaaatggtataaagcaagtgaaaagcaagttacaaatacatgcacttttgaaaattaccatgtgggcacagaaaagaaaaagattctccttgttcttattttaagagaaaaatactcttcacatttcctttctgtgagaaagataaataagaaacattaagtagggaaaataggtggtgagacaaaaattattattttttccttagccaatgacctttgagaaattgaaatttcctttgaaggaattaaaaaggaaaaataagtaaaaactaaagcagccttctggctttctttgttaccctacacattgagcacaactgacagggtggctgctgcaggacaattcataggccttcattgttgagtcgtggtctcaggtggtgcat

SEQ ID NO: 136295 - DNA, 558 bp, Homo sapiens
ccaagacagttgtgggtagaggaaggcagatttattagagaaagtaggaaaataatggcgccagagagacaacagacagcctgcaaaagagaagcggactgccaggagacaaagacttgttgaagattttacagcatagtgttcatgctgcgtgttgaagagggccttgtgcagtatagataatgccaagttgcaatgagctaatttgcaggtgtctggtgatagttgggcacaggaagatggggagttgattgcacagaagggccgtgtcctggaccatgaagaaaggcagacttacagcttatctgctttttctttttgctttcccttgctcccgccagcctggcttccttcccctaattaggactccacacgttagtgggtttacatatagattggagtggttgttcttaggaggctgcctaaagcatcaactatgtgcaaggtgctattaggacccataagtaatggacaggacatgcaccccgcccttaagcagcacagtctggtagccccatagatgcataagtattctaaagctaagtagggagttctgtg

SEQ ID NO: 136296 - DNA, 561 bp, Homo sapiens
ttgggacttggctattgggtatgatgggccttccaggaagggctaaactaggatatggcccagaggataaggaggaggggcatacatggtatccattgcccaaaataactctaggtaacctgaggaattggagtcaggggttcagctggggtcacgtgcccggttctggctaggggatggaggtgaacaagagaggttgccagcctggttctctgggcaattggagggaggaggacgggctagaagagttatttttaatattatttagagcatcaaaagaggatttcccagtaggaaaaaaagggatttgatgtagggaacactgatactttcagggctcagggagacacacagggtatgggaggaggaggccagaagtggtgataaaaccttcttatatggacagtccttctggattgaactacaagcattcatatttgggtaactctagacagatggctgcctatttttaagcctcagttttccttcttctgactaaatgtgaggactcacccgatgtacagccctgtactaagccacgggtcaaccgggtaccgagct

SEQ ID NO: 136297 - DNA, 352 bp, Homo sapiens
ttctagacaacttgtagcctagattatcctttaagagccacttacactactggaaaacaactccacccaggttcttatttgagttacagggacaagaagcctttggattgcaggtttaaaaaaaaattttttttttattgctgagacttctattatgaactaccacagttgacaaactgttagtttccatagcaattttagactgtccttaggtgaagggtttcccttccagttgctatttaagatgtgtggaatccaagaagtcacaaaaggtatttcatgtgtcataccttggcaatgcgtgctactaattatttttttgttcctgtcgttaaatatagagccttctcat

SEQ ID NO: 136298 - DNA, 298 bp, Homo sapiens
tggcaggggataaagaagaaaatttgggtagcaagtcaacaccttcctccgcccttgctggctttgatagcgcatacatcccaagaagctttctgaagataacaacgctgccctagcaatctagccagctaggaacaggatttgcttattctactatcaaatacttgtctgcctgaaaatttacctctcattgcttgttaacaagtgactttctagtagacatcaatattcaaaaaattctgtttaagcatatcagattttccaggatctgatcagccctggataaccagaccactgg

SEQ ID NO: 136299 - DNA, 843 bp, Homo sapiens
acagatttctggcttttcctttcattatgtttctgctgagaatcagatatttcttattcatagctgcataacacaagcatatcatcttttcagtttgagagctttcatgtccctggatgacctcgcctcagaaagaaatcattttaattatttaatgcctgtctgagaaatagagaactccaccacggtatggcagtgctggccgagcactgtctcagtcactccctagaacacctgcagaaagtgtgtgcctccccttcggtccccaagttctgcatttcctgaaccttcatgattgctggtgaatgagggacatcctgaatatcaaattccacaaacatccagagcctagtgtgacttgcctcacatgcttggaaattttacacttgaaccagttaaaattctagcatctggatttccagtgagacatggtagatgggtcactaaagttagcataaagaaggggaaacacccccaaactctaataaagccacaaggagagaacagaagaggcaaaacaacactgaaaaaaaaacaaaaaaaaacgaaaaaaccctttttggggccccctagggcccctgaaaaaggcttgaacaacagctcaggtggggcaccggggccccaggaaggaaaaggtagcacctgcgcacaaagggaccccaaaagaaggacacccgggagcaagaaaaaagggcgacaggagacccatcaccagaagaaaaaaaagcgcccggggggaaacacaagaggggcttgagaacacaccccacgagtggagactcaaggagggaacaacggggatacacacaacggggagtcaaaggagcccaggagcaaattgcc

SEQ ID NO: 136300 - DNA, 83 bp, Homo sapiens
gggaggatcatatgaacccaggactcagaggttgcaatgaacaaagatggcaacattgtgctgcatcctgggaagactgagca

SEQ ID NO: 136301 - DNA, 1284 bp, Homo sapiens
tcagacctagatctttccagttaatcacacaacaaacttagctcatcgcaataaaaagcagctcagagccgactggctcttttaggcactgactccgaacaggattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctttttgccttcgagctatcggggtaaagacctacaggaaaactactgtcgaaatcctcgaggggaagaagggggaccctggtgtttcacaagcaatccagaggtacgctacgaagtctgtgacattcctcagtgttcagaagttgaatgcatgacctgcaatggggagagttatcgaggtctcatggatcatacagaatcaggcaagatttgtcagcgctgggatcatcagacaccacaccggcacaaattcttgcctgaaagatatcccgacaagggctttgatgataattattgccgcaatcccgatggccagccgaggccatggtgctatactcttgaccctcacacccgctgggagtactgtgcaattaaaacatgcgagacataacatgggctctcaactgatggtgaacttcttctggtgagtgacagaggctgcagtgaagaataatgagtctaatagaagtttatcacagatgtctctaatctctatagctgatccctacctctctcgctgtctttgtacccagcctgcattctgtttcgatctgtcttttagcagtccatacaatcatttttctacatgctggcccttacccagcttttctgaatttacaataaaaactattttttaacgtga

SEQ ID NO: 136302 - DNA, 2020 bp, Homo sapiens
tcagacctagatctttccagttaatcacacaacaaacttagctcatcgcaataaaaagcagctcagagccgactggctcttttaggcactgactccgaacaggattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctttttgccttcgagctatcggggtaaagacctacaggaaaactactgtcgaaatcctcgaggggaagaagggggaccctggtgtttcacaagcaatccagaggtacgctacgaagtctgtgacattcctcagtgttcagaaggtaaataaacctgaatgccatgtgggccattctattccccctatgtgtagaactgtaactcacattaaaggttaacagcaacgaatcaatcataacaaatatgttgttcgtgcaaatgcaactacaaataattatttaaacatttttatacaatgtttttaaaactgttggattatcaccagattaatgcaaaataacagagcgagttatcagtttgaatttcaacactgcctgagacatccctctggggaaagtgaaagagagggtttacttacctactgtcttgagctcacatacctcaaaatctactactgtgtggcacctgaaaggagttgaatgaagcttagcctttcattagcaatgttaattctattcaaccagcacctgcttccacagaaattctgtccaaactatcatgaagtggtgtgacaagggtatatggacccagaagataatacaatataagaagggatcactggaagcttgaccccatgcacattttggtgaaaatgtgcctagaatcaaatgtgacacgtaggctggaactgagtaccattcagaataggatctgaagagatcaaagcaatggagaccaccaaactgtcttgaaggcatgtctatggaccttaagtccatgtctatgttttcagctcttctcacagcataaaagggcattgtccttacttttgcagtggaaaactgaatggctgacaagatggaagagtaaccatttcagcattgtatgtggtttcatttttcttagttatctggctactgaatagccggatttttcagttctgtcagaaactctaaatttccaaaaatctaagtgaaacatggatgaaactctgttagaaaattattaggattttggagtatttggggagggggactactggaatgctgtccaagttttatactaagatatcttacctgtttgttattaaccaaatatttttaaaaatatttcctccataaatattcatttaatattaggttgatatttatcacataaaaagtaaaggctactgttagctaattgtcacagagaaggatttgttttctgttgttagtgaatttgaaatccttgactttatgtgctacagccagttccatctctgtttgtaaattcttactttccattccatatcatattctgttccctataacctcttcattgttttcttttcttttaaaaataataaacttttctatgatcacgttttgaacaagtct

SEQ ID NO: 136303 - DNA, 482 bp, Homo sapiens
taagaaacaggacttcattctctgtaaatgccatattaaacatgaacactacatttaatatgttaattttgtgttgaatccagttgagagtacttaccattgtattttgtgttttcaggcctgctgtcctggatgattttgttagtacgattgatttacctaattatggatgcacaattcctgaaaagaccagttgcagtgtttatggctggggctacactggatgtaagctagttttcaaaagatgaggccatatttattttattttaaaaagaacacatttgtctttgtttcttacttttctcaccttattgtatgttttttgcatcaatctagtgatcaactatgatggcctattacgagtggcacatctctatataatgggaaatgagaaatgcagccagcatcatcgagggaaggtgactctgaatgagtctgaaatatgtgctggggctgaaaagattggatcaggaccatgtgag

SEQ ID NO: 136304 - DNA, 470 bp, Homo sapiens
gaaaatactagtagaagctttaggcaagaaatttcaatgttatttgaaatagtttacaagagttaattacttacaggtttgaacggaatttttttcttaaatactgcatatgttttgcatagttgcaataattttatctactttcttcaatagactacattagaaactgcatcattggtaaaggacgcagctacaagggaacagtatctatcactaagagtggcatcaaatgtcagccctggagttccatgataccacacgaacacaggtaagaacagtatgaagaaaagagatgaagcctctgtcttttttacatgttaacagtctcatattagtccttcagaataattctacaatcctaaaataacttagccaacttgctgaattgtattacggcaaggtttatatgaattcatgactgatatttagcaaatgattaattaatatgttaataaaatgtagccaaaaca

SEQ ID NO: 136305 - DNA, 5918 bp, Homo sapiens
  misc_feature (2916)..(2916): n is a, c, g, or t
  misc_feature (2940)..(2940): n is a, c, g, or t
  misc_feature (2946)..(2946): n is a, c, g, or t
  misc_feature (2957)..(2957): n is a, c, g, or t
  misc_feature (3003)..(3003): n is a, c, g, or t
  misc_feature (3047)..(3047): n is a, c, g, or t
  misc_feature (3058)..(3058): n is a, c, g, or t
  misc_feature (3060)..(3060): n is a, c, g, or t
  misc_feature (3076)..(3076): n is a, c, g, or t
  misc_feature (3097)..(3097): n is a, c, g, or t
  misc_feature (3104)..(3104): n is a, c, g, or t
  misc_feature (3110)..(3110): n is a, c, g, or t
  misc_feature (3112)..(3112): n is a, c, g, or t
  misc_feature (3128)..(3128): n is a, c, g, or t
  misc_feature (3130)..(3130): n is a, c, g, or t
  misc_feature (3169)..(3169): n is a, c, g, or t
  misc_feature (3180)..(3180): n is a, c, g, or t
  misc_feature (3221)..(3221): n is a, c, g, or t
  misc_feature (3284)..(3285): n is a, c, g, or t
  misc_feature (3290)..(3290): n is a, c, g, or t
  misc_feature (3309)..(3309): n is a, c, g, or t
  misc_feature (3325)..(3325): n is a, c, g, or t
  misc_feature (3340)..(3340): n is a, c, g, or t
  misc_feature (3347)..(3347): n is a, c, g, or t
  misc_feature (3350)..(3350): n is a, c, g, or t
  misc_feature (3366)..(3366): n is a, c, g, or t
  misc_feature (3370)..(3370): n is a, c, g, or t
  misc_feature (3384)..(3384): n is a, c, g, or t
  misc_feature (3391)..(3391): n is a, c, g, or t
  misc_feature (3408)..(3408): n is a, c, g, or t
  misc_feature (3457)..(3457): n is a, c, g, or t
  misc_feature (3460)..(3460): n is a, c, g, or t
  misc_feature (3518)..(3518): n is a, c, g, or t
  misc_feature (3565)..(3565): n is a, c, g, or t
  misc_feature (3583)..(3583): n is a, c, g, or t
  misc_feature (3594)..(3594): n is a, c, g, or t
  misc_feature (3615)..(3615): n is a, c, g, or t
  misc_feature (3632)..(3632): n is a, c, g, or t
  misc_feature (3649)..(3649): n is a, c, g, or t
  misc_feature (3687)..(3687): n is a, c, g, or t
  misc_feature (3717)..(3717): n is a, c, g, or t
  misc_feature (3725)..(3725): n is a, c, g, or t
  misc_feature (3740)..(3740): n is a, c, g, or t
  misc_feature (4471)..(4471): n is a, c, g, or t
  misc_feature (4497)..(4497): n is a, c, g, or t
  misc_feature (4499)..(4499): n is a, c, g, or t
  misc_feature (4559)..(4559): n is a, c, g, or t
  misc_feature (4567)..(4567): n is a, c, g, or t
  misc_feature (4575)..(4575): n is a, c, g, or t
  misc_feature (4594)..(4594): n is a, c, g, or t
  misc_feature (4630)..(4630): n is a, c, g, or t
  misc_feature (4648)..(4648): n is a, c, g, or t
  misc_feature (4662)..(4662): n is a, c, g, or t
  misc_feature (4695)..(4695): n is a, c, g, or t
  misc_feature (4698)..(4698): n is a, c, g, or t
tcagacctagatctttccagttaatcacacaacaaacttagctcatcgcaataaaaagcagctcagagccgactggctcttttaggcactgactccgaacaggattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctttttgccttcgagctatcggggtaaagacctacaggaaaactactgtcgaaatcctcgaggggaagaagggggaccctggtgtttcacaagcaatccagaggtacgctacgaagtctgtgacattcctcagtgttcagaagttgaatgcatgacctgcaatggggagagttatcgaggtctcatggatcatacagaatcaggcaagatttgtcagcgctgggatcatcagacaccacaccggcacaaattcttgcctgaaagatatcccgacaagggctttgatgataattattgccgcaatcccgatggccagccgaggccatggtgctatactcttgaccctcacacccgctgggagtactgtgcaattaaaacatgcgctgacaatactatgaatgacactgatgttcctttggaaacaactgaatgcatccaaggtcaaggagaaggctacaggggcactgtcaataccatttggaatggaattccatgtcagcgttgggattctcagtatcctcacgagcatgacatgactcctgaaaatttcaagtgcaaggacctacgagaaaattactgccgaaatccagatgggtctgaatcaccctggtgttttaccactgatccaaacatccgagttggctactgctcccaaattccaaactgtgatatgtcacatggacaagattgttatcgtgggaatggcaaaaattatatgggcaacttatcccaaacaagatctggactaacatgttcaatgtgggacaagaacatggaagacttacatcgtcatatcttctgggaaccagatgcaagtaagctgaatgagaattactgccgaaatccagatgatgatgctcatggaccctggtgctacacgggaaatccactcattccttgggattattgccctatttctcgttgtgaaggtgataccacacctacaatagtcaatttagaccatcccgtaatatcttgtgccaaaacgaaacaattgcgagttgtaaatgggattccaacacgaacaaacataggatggatggttagtttgagatacagaaataaacatatctgcggaggatcattgataaaggagagttgggttcttactgcacgacagtgtttcccttctcgagacttgaaagattatgaagcttggcttggaattcatgatgtccacggaagaggagatgagaaatgcaaacaggttctcaatgtttcccagctggtatatggccctgaaggatcagatctggttttaatgaagcttgccaggcctgctgtcctggatgattttgttagtacgattgatttacctaattatggatgcacaattcctgaaaagaccagttgcagtgtttatggctggggctacactggattgatcaactatgatggcctattacgagtggcacatctctatataatgggaaatgagaaatgcagccagcatcatcgagggaaggtgactctgaatgagtctgaaatatgtgctggggctgaaaagattggatcaggaccatgtgagggggattatggtggcccacttgtttgtgagcaacataaaatgagaatggttcttggtgtcattgttcctggtcgtggatgtgccattccaaatcgtcctggtatttttgtccgagtagcatattatgcaaaatggatacacaaaattattttaacatataaggtaccacagtcatagctgaagtaagtgtgtctgaagcacccaccaatacaactgtcttttacatgaagatttcagagaatgtggaatttaaaatgtcacttacaacaatcctaagacaactactggagagtcatgtttgttgaaattctcattaatgtttatgggtgttttctgttgttttgtttgtcagtgttattttgtcaatgttgaagtgaattaaggtacatgcaagtgtaataacatatctcctgaagatacttgaatggattaaaaaaacacacaggtatatttgctggatgataaagatttcatgggaaaaaaaatcaattaatctgtctaagctgctttctgatgttggtttcttaataatgagtaaaccacaaattaaatgttattttaacctcaccaaaacaatttataccttgtgtccctaaattgtagccctatattaaattatattacatttcatatgctatatgttatagttcattcatttctcttcaccatgtatcctgcaatactggtacacgaacacactttttacaaaaccacatacccatgtacacatgcctaggtacacatgtncatgcactacagtttaaattatgntgtacntaatgtaaccnctaaatattttagaagtatgtacctatagttttacctcaaaaaaanagaaatctctaaagaccagtagaaatattaaaaaatgatgcaanatcaaaatgantngctaattctccatacntaatctgcagatgatcttctntggttgncatttnangtgtggccatcacccngngttaaataacacctaatctaggtgtttacatgtattcantatcctagttntttcatgtagtttctaattcttaaaggaaagagggtaatanttctatttgtgtaatttgtttcctccaaacttaaggccacttatttacacaagatatttgtanntctantttcctaaagcatttcttnagtgctcagatcagtntctaattgaagaagnttaaaantgntttggtcattaaaaangtanttaaataggttaantctaagncttgctgctgtgattgncttctagctcactgcctttaaattttaaaaaatttaagaggaaaatttncangtctccaaagttttataaatacccttcatcaagtcatgcattaaagtatatattaganaaaaaaaaatacttttctcaacctggaagattttagcctaataaagnttttttgaagtaaaaganaacttgtaaanggaaagaaactagtttgtctnaactctgtattcatttnttttttttttgaagtanagtggaatctgttgaatcagatattttatcaagatatntttattttttcttatttcattttacaaagntcactccnaatgccatatgtaanagacatttaaattttgtgttctgtataacagccaaattatcatatttatcattgtatttgtcatgcttagctaaagatcatgtatttgttgagaaatagaataacaaaaagtaataggataggctttgaatttttgcagaaatcttcctgtacaaaacacctttaaaaataattttttgaatggtgtgaatccagtagtcccatttctctgacttagttttcttgagtgatttttatcaaggccaagtccccaaacaattccctaccagctctttagagtactgttcaatctggactaaaatggttttaagtttatggagagcttagtccacagaatatagggcggcgagtccagaaatgcttatacaatttttttttcataataagatatgtgctggcatcaagaaacttaaagtggaagcaaaaagacatccaactagttgctggtctctatcatcttatctgatggtatttctattttccttatataatacaccattttagtaagaactcctagaaatttcaagagcatattgccaaaatataaagtatatttcatagtttcttctggctgaaccagtgaaattttattattgcatattaatgatatttgtaaaacttttataaaaattgtcataattttaaatactcacattttaaaaatacttctttaatgactcttcctctaaatttcctggaaatacagataaagattagctagatacaagatncagctaagtatttagacattttgagncnagtatttttcattttattaaaggctaaaaacaataccaccaataaatcatcaaacaaacngtacaaantaattctntctttgggaggctcctttngtgatagagggacatgggtggaattgacaatgaaanttagatgaacaaggtccntgttattttaggtngtagaacagggtagagtcatgtcattatttgcnggnggaagacactatttaccaggtgttctttgctgaataaatcattaaacatttttaaaaatccaacaatccactttattttgtgtcattgacaaaaggatcttttaaatcagaaggtttcaatgcaatttttggtttggctgtttgaataatggttatgtactgttataattgtagacattttctcacgtctaccaggaattgaagtgtaaaactaaaatatttttcataatgcctctgccgtgcagaaggaatgataatccttttgtatacttctttaattttattgtaaaatgtgtaatgacttttacctatatgctgtgggcaggtcctcagtaaaatctattgagtcaatttctagtattaacaggcttttgcttgctatctaagtgtttcaaattatgggaagtgtgagacactggaaggcaagaaaattaacaataatggcatgtgatagcaaaattgtatttcacttattcctgtgaatatttcttgttggtaccaatggtactgtacaaagtgaatgttatagccacaacattctcttgaaaagaacactgtcaagaagtgggaaattgctgtcaggcatttcattgttgtttttaaacttttttaaaagaaatactggttttgcaatatagagatcatgtggtaaagaattttaataagatcttatactaaaaagccttaaatcaatttattgagattcaaaaaatactattataattaattacatcccatacatataggcaaactcatttaaaaaataaaactaattttggtaaaagtacatggcctttgtttttaaaatacataattttaaaataaatcacttgtcatgataaagtccaaaaagaagttatcattcaacattcaactaaggttggagctaagaatttactaatacaaaaaaagttaaaattttttggaccatatatatcttgacagtgtaacttttaagtaggttcatttccatttgcacagaaagtttctgtctttaggaaactgaaaatgaaatactgtggatgctatgactgtttgtcttgtatgtaaataggaaaataataagctgcctattgagtggtatagctgtatgcttacccaaaaaagggaacactgtggttatgacttgtattataaactttctgtagttaataaagttgttatttttataaccatgattatattattattattaataaaatattttatcaaaatgctta

SEQ ID NO: 136306 - DNA, 996 bp, Homo sapiens
  misc_feature (22)..(22): n is a, c, g, or t
  misc_feature (71)..(71): n is a, c, g, or t
  misc_feature (97)..(97): n is a, c, g, or t
  misc_feature (181)..(181): n is a, c, g, or t
  misc_feature (202)..(202): n is a, c, g, or t
  misc_feature (215)..(215): n is a, c, g, or t
  misc_feature (234)..(234): n is a, c, g, or t
ggcaccgcgcgcgcgcgcgccncccgccacgcctgcggcagaggatcacgtcaacgcaagctcctatcaanagtcagcctgagaaaaccagaagganactgcagacaaggctatagagactagataagactcatcactgcagctttgtttgataagcagaacatgccctgtccctcatgcntgcagtgagtgaaaaaaggantttggccatgaantttgacctctatgaagacnaaagactacattagaaactgcatcattggtaaaggacgcagctacaagggaacagtatctatcactaagagtggcatcaaatgtcagccctggagttccatgataccacacgaacacagctttttgccttcgagctatcggggtaaagacctacaggaaaactactgtcgaaatcctcgaggggaagaagggggaccctggtgtttcacaagcaatccagaggtacgctacgaagtctgtgacattcctcagtgttcagaagttgaatgcatgacctgcaatggggagagttatcgaggtctcatggatcatacagaatcaggcaagatttgtcagcgctgggatcatcagacaccacaccggcacaaattcttgcctgaaagatatcccgacaagggctttgatgataattattgccgcaatcccgatggccagccgaggccatggtgctatactcttgaccctcacacccgctgggagtactgtgcaattaaaacatgcgagacataacatgggctctcaactgatggtgaacttcttctggtgagtgacagaggctgcagtgaagaataatgagtctaatagaagtttatcacagatgtctctaatctctatagctgatccctacctctctcgctgtctttgtacccagcctgcattctgtttcgatctgtcttttagcagtccatacaatcatttttctacatgctggcccttacccagcttttctgaatttacaataaaaactattttttaacgtga

SEQ ID NO: 136307 - DNA, 625 bp, Homo sapiens
aatgcattcaacatgtgggagccatattctactcagatcgttactaggttatctaccggctcagccatggaaaggggattagacacaggtgaggatagaagtcagctgtgggagtcccactggggagaccaagaggggtgaaatggaaagaaacagcgggccaggggggttggacttcctcatgggctgaagaaggccatggaggggaacctctcagaaaccacccagaactacgcggtgaatggccagcctgcactgctagatacacagtgccatgccaacactgccatggaactgctttcatcattcagaaagaggaggctgctttttccccctcttctaatatttttaagtgactatgtttgcctgctggtagtccctaagtatgatgggataaatatcccatggaaaggaactgaggaacatgggcctaaaactcgtgaggtggtgtgagggggaggagaggagaaagaaggggcaaaatgccaagcaaagtaaaagctgttatggcacttcagggccaccaatctcgtctctaacttcatctcctggtctcctccctccctctgtccagccacgctggcctcctcgctatgcgttgaacacctcacctgtgtcccagtgc

SEQ ID NO: 136308 - DNA, 574 bp, Homo sapiens
gggtcagtggcaaagtggtgtcatgaataggaacttcaaggaagtgaacgaggaagatctgctggagcacaggaagtgaaatagacaagatgaatggggaccccaggacaaatatgctggcagtggatataagcagatggataaaccatgtgggtgccctcaaggtgcgtgcaaccatggaatggaagactggaggaacccatggtggccaaccatgggcccggtccctctggtatgggccatgagccagctgagcctgagtgcaaaaatggacagaaggcgaactggagtcatgatgacatcaacccctataacctgggggacactcgagaaaaccatgcaggaagctgagaaactactggagcgtcaaggccagaaaaaacccctgattccatgttcttggccatgttagctataatgccctgtgtggtaggttttcccttgcagagtcaaaaacatattgggcataggttcccaatcctccagcagtacaacctgtactttggagtgacactcctcctgagatctatcgtgatcagggagcatgggctccaggacccctatgtccggctcc

SEQ ID NO: 136309 - DNA, 292 bp, Homo sapiens
agcaagctgggcctgaaatcccagctacttgggaggctgagatggaaggatcgtttgaggccaggagttcgaggttacaatgagctgtgatcataaccctgcactccagcctcttcttcttcccccttttcctccccatttatctctccttctctttaaaaataacctttattgggccaggtgtggtggctcacgcctgtaatcccagcactttgggaggcctaggtggtggatcacttgaggtcaggagttcaagaccagcctggtcaagataaaaaccccatctctacta

SEQ ID NO: 136310 - DNA, 628 bp, Homo sapiens
caaataaggaaacgagccaggtgcagtgactcactgcaaagtgcagtaatcccagcactttgggaggccgaggcaggcagatcatttcagtccaggagttcaggaccagcctagccaacatggtgaaattccatctgagtgtggtggcacacgcctgtagtcccagctacttgggagattgaggtgagagaatcgcatgagcctgggaagcagaggctgcagtggaccgagactgcgccactgcactccatcctgggcaacagagcaagaccctgtctcaaaatcataatgaaaacaataaagcaaaaacaaaaagccaatgactaaagggaggcattaattcagaagtggcaattgagtcctctgtctctagccatggatcagaatgcagaaagcagacaactgcttctgaaattttctgtgagttctaagttctgatctctgatatcaagattgtgctaagctataacttaattctcataatttagtattttatgtatttatacatagatttccagggtggcttggctggagatgacagtatgaaaaatacagcactaaattctctgagaagacatcatctctgttttgagtgacgatatcctaagacttggatactgatagaaaa

SEQ ID NO: 136311 - DNA, 701 bp, Homo sapiens
ttaaactttaaaatgaagagctgaacatactgatacattgattctttggagaggatctcagaactcattgtacttaacaatttacaggctaaaacctttgaagaagaatttattatatcctacaaacctgggaggcagaggttgcagtgagccaagattgggccatcgcactccagcctgggcaataagaatgaaactctgtctcaaaaaaaacaaaagttggccagggctgggcgtggtggctcacacctgtaatcccagcactttgggaggctaaagcaggtggatcacctgaggtcagaagtacgagaccatcgtggctaatatggtgaaaccccatctctactcaaaatacgaaaaaagaaaaaaaaaattagccaagcacggtggtgcacgcctgttatcccagctgcttaggaagctgaggcaggagaattgcctgatcccagaggcagaggttgcagtgaactgggattgtgccactgcactccagcctaggcgacagagcaagattctgtctcaaaaataaatacataaataaagttttagagcaggaatgaaaggaagtaaagtacacttggaagagctgtgttggcaactggagagatccgagtgcctcatctgacccttgacttgggattaatacattggcatgagatgtgagcagtgactcaaagttgctcagaaaaaaatcttccccc

SEQ ID NO: 136312 - DNA, 616 bp, Homo sapiens
cgtatgcctaagctggagtgcagtggcgcaatcttggctcactgcagcctcggccttccaggtttgtagggggaatgagatgaggcagtggagccatgtgacagggactgagggtagattactggagctccctgcgtagaatgaatgttcaatcaaaacctgctggagggagagctggagccataggggagtgggtaaagtgggcagggctgattccacaattccctgcatgctcccccaactccacacacatccccaacctcaaacagggcacaagaccaaagggctgaggagccaggctatagcttaaagaggctgggggagaaaagcttggctgagacaacccatagggagctagaggtttttaatatatcctattctgaataagagacgaattcattcagatcagtggtttcaaaccgtgctctgggcaactcaattgctaagggttccacaaacaggataaagtttcttatatacaaaaaaaatgaaggtttcaaattacaccataaaacccctcattgcttatgtctacttggcaggtaaaattccatttcaaaagttaaatgtacttaaaaaattacctaagactgggtaaattaaaaaaattaaatgt

SEQ ID NO: 136313 - DNA, 360 bp, Homo sapiens
catctgcccaactttgcccccaggacttcacatacaattgaggtcttagctccaatatcacctccttagaaaagtcttccctggtagtgcggtggctcatgcctgtaatcccagcactttgggaggccgaggcgggtagatcacgaggtcaggagattgagaccagcctggccaacatggtgaaatcccatctgtactgaaaaatacaaaaattagctgggtgtggtggcgcgtgcctgtagtcccagctacttgggaggctgaggcaggagaatcgcctgaacccaggaggtggaggttgtagtgagccgagatcgcaccactgcactccagcctggtgacagagggagaatcagtcta

SEQ ID NO: 136314 - DNA, 297 bp, Homo sapiens
catctgcccaactttgcccccaggacttcacatacaattgaggtcttagctccaatatcacctccttagaaaagttcttccctggtcactcaatctaaagttgttttctgtgtcttctcatatcttccctctcacttagtcattcttgttcattgccttattttcctcaagtacttatcactcttaagctttaatttctttatttattgtcttattacagattagaggagaaaaatacaggtggtaccttgtttgttgtctatcttcctccttagaaagtaagcttataaagagcag

SEQ ID NO: 136315 - DNA, 1249 bp, Homo sapiens
caggcagccacaggcctgtcagaccaggacccttaccctctagacatggcctcggtcccctgcaaaccccagccccgtagccctgcgaggttacagacagcctaaacgccaccaccacagggcctgtgccgtgcccctgacccgggcacagaaggccactggcccggaggccatggagacggtgcccccagcagtggacctggtgctgggtgcttctgcctgctgcctggcctgtgtcttcaccaaccccctggaggtggtgaagacgcggctgcagctgcagggggagctgcaggcccggggcacctacccacggccctaccatggcttcatagcctctgtcgctgctgtggcccgagcagacgggctgtggggcctgcagaaggggctggctgccggccttctgtaccaaggcctcatgaatggcgttcgtttctactgctacagcctggcgtgccaggctggcctcacgcagcaaccaggtggcaccgtggttgcgggagccgtggcgggggcactgggagccttcgtggggagccctgcttacctgatcaaaacgcagctgcaagctcagacagtggccgcagtggccgtgggacaccagcacaatcaccagactgtcctgggtgccttggagaccatctggcggcagcaagggctcttggggctgtggcagggcgttggtggggctgtgccccgagtcatggtgggctcagctgcccagctggccaccttcgcctctgccaaggcctgggtacagaagcaacagtggctccctgaggacagctggctggtggccctggctgggggcatgatcagcagcatagccgtggttgtcgtcatgactcccttcgatgtggtcagcacgcggctatacaatcagccggtggacacagctggcaggggccagctctatgggggcctcaccgactgcatggtgaagatctggcggcaggagggccccctggcactctacaagggcctgggccccgcctacctgcgcctgggcccccacaccatcctcagcatgctcttctgggacgagcttcggaaactggctgggcgggcccagcacaagggcacctagacgacggccctcacccccacgtcctgacacggccggcacttggccggaagtgagagcctgctccaggacaactggctgtcccggggcgggccatgggcccaggccctgccagaggtcccgggagagtgtggacagctctggtccatccagccccttggccca

SEQ ID NO: 136316 - DNA, 734 bp, Homo sapiens
ccggaccgcttatctgtgggggtggtgaggggtcttccctctctgggtggggagggagtcagacgcccagtgccccaacttccatgcacacacactctcacacactcacactcacacatgcacagccagagacacgcagacacaggccaggtatgcaaacacattaactgggcttgtttgctgagcccccgggtcccaggcacaggctaagcactttcacatctggattttattccatccttataatcacattcatcttcctgatgaggaagctgaggctcagacagatcaactgacttgcatgagttcccccagctggtaaggggaggagccagaactggaattcaggcctgaccccacagccttcccatggcgccgcagcctcacagggccagctctatgggggcctcaccgactgcatggtgaagatctggcggcaggagggccccctggcactctacaagggcctgggccccgcctacctgcgcctgggcccccacaccatcctcagcatgctcttctgggacgagcttcggaaactggctgggcgggcccagcacaagggcacctagacgacggccctcacccccacgtcctgacacggccggcacttggccggaagtgagagcctgctccaggacaactggctgtcccggggcgggccatgggcccaggccctgccagaggtcccgggagagtgtggacagctctggtccatccagccccttggccca

SEQ ID NO: 136317 - DNA, 281 bp, Homo sapiens
ccaatcacagctcactgcagccttgacttcctgggctcagatgattctcccaactcagcctcgcaagtagctgggactaaaggtgcaatgccaccatgcctggctagttttgttttactttttttgtagagatgaggcctcagtatgttccccaggctggtctcaaacccctgggctcaaatgatctgcccgccttggcctcaaatgatctgcccgccttggcctcccaaagtgctgggattacagaagtgagctaccatacctggcctaaattatgatac

SEQ ID NO: 136318 - DNA, 511 bp, Homo sapiens
tcctgattttccacaggcttcccttcccagatgattactcctttctttcaatagcgaagtcttataatttacaacctattcattggcaaatacctaatggtgtttaacatgtataattagaaagcacatcatatatatttcagccttactgaaaagacatctggcctctcactgatgttaggagctcttggggaaaagggcccatgttagactttgtgtccttctaaagttctagtcctgtttctggcacatggtaggtattcagtaaaaatcctctcacatatatccaactctgtctgtctgtctgtctatctatctatctatctatccatctatctcaaacaaataagaggtctatccttaaattctcaccaggaatcatggaaaaaaaacctacctcttgtatacaagtagtatttgtttgaaaggactttatgtcatgatgtcacataccctcacttctatgtagaatgacatcctatgtttcaataaattttcccctgtggaagta

SEQ ID NO: 136319 - DNA, 897 bp, Homo sapiens
tggatcaggccaacaggggtacttcacctatacctcagaatatgatacattaagcacctgggaatggttaacagaagccttgactcattgcaggccaacagctaatgagacagctatgctagactccccttgcagattctagagggaggataaatgggaatgcagagaggacccagggtggcggaccctgctcagccacctcctgaaaatctccaggagggccaagaagtctttttcttccctaagcctaaatgtatttgcaagggggaatacaaactggaagtagcaagcacccttgatgccttcatagatatacgattatcagaggtgagagagaaaaatcctgcaagagttcatatgcctactacatcagtgcagtttcaaatggaaaagaagagttgtatccagaactgcccactacagagaaacagacacacacttggtggatccctctggattttgggggaaaatatatttaggtggaacttctggttctgccaagatggggtaggccccattcttcccaggtcttcccccctccacctgaaacactctggacaaaatacaacaaataagcacaggcaagctttgaaagggagaaccaaggcagacagcctagggacagtgggacttgaggaacaacgcagtgctggcacgttccctgggtaccttattgccctctatatcttaaataggatgctgtagaagcctccaatccagaatcagtaacaggcacagatgcaattggctccaagtaaagcccatgcccccaagccaaaggccagagacaggaaaatctacagagacagaaagtagataagcctagggctaggtatgatggggacagagggacaggggcaagagctaaatgttcagggtttccgtatgggtgagaaa

SEQ ID NO: 136320 - DNA, 182 bp, Homo sapiens
gcattctgaaatgtacaactttttatgtacaaaaatgtctgttttagcattatgaggaaatgaatgcctatacagtggtctccccttatctatgttcttgtgttccacagtttagttacctgcagtctgaaaatattaagtggaaaattccaaaaataaactacttataggttttaaactgc

SEQ ID NO: 136321 - DNA, 436 bp, Homo sapiens
gataaatatttgagaggatggatatgctaacaatgctgatttgatcatttcacaaggtatgcatgtattgaaacatcgcatcgtacccacaatatgtacaatcatatgtcaattaaaaataaaaataaacaaaaaagcacacagagaataatttatgtggaagcactttgtagaatgcagcagaatttatgaggtagtgattattatgttaagtgcaagaactgaagaataaataaggtttcaagatcccctacaatccttatagagaagctgagttttgctttcttgaccaatgtctgtgccaacatatatgtctggaagaaagaactgggcaatttgaagctttctacaaaagttggcaggacttggggtgagcagaaaattcatagaaaaactggccaactgcagttacttttgattcacaaagccatggatg

SEQ ID NO: 136322 - DNA, 383 bp, Homo sapiens
tgccctgatcctggtttctaactaccattcctcactaaaaggaaacagggctcattagggaaacagctgattctagtgctgggaaggggaaagttcaaaatgaggctggtgcaatttattgtgcaagacagtgctcaaaaatgatgggacatgttaaaaaaaaaaagacgtaagagtcagtttgaaaagcctgggacaacttgagcattacaaatgatagtgacacaatattttgggcatgagataaaaatccgaggccacattgatatcaacaaataaataaagagggaagatgaaaaatttctgtcttacagtggaatgcaactaatacagaataaatgatggaattagtagatcatgtttgacaactatcatggtaattt

SEQ ID NO: 136323 - DNA, 344 bp, Homo sapiens
ctggcattgaactccttggctcaatgatcctcccgccttggcctcccaaagtgttgggattacaggcatgcaccactgtccccggccagctttattctttttaacaactgaacagtattcctttgaaagctctcattattcaagctgtcactttttggcagggttgaccttcccctccattttggcttggctaactcctacttgccctctgagattcagctcacatgagctcacctcctgacctgctcctccgggttacaggggatgcctcttcgttgtgctcccatacacctcatgcttccctctcccttggtcttatcattctgtattgtcagcatctgtct

SEQ ID NO: 136324 - DNA, 161 bp, Homo sapiens
aggtcgatcagaggatcccagtgctactccacaaacagcattgtcttttgagacccactcagaagtccctcagtaaaagtgcatcgagtgtgcacaagtgaatttaagtgtggttgcacctgtgtgaggatcacagaatcctgtgggtgttgacgggagca

SEQ ID NO: 136325 - DNA, 209 bp, Homo sapiens
tgagacagggtctcactatgttgcccaggctggtctcgaactcctgggctcaagcaatccgcccgcctcggcctcccaaagtgctaggattataggtgtgagccaccatgcccagctgaacattatcttcttgcacattcctcatgcttatgtttctgaagttgagactccctcccctccctgctattttgtgcttccttaatactttg

SEQ ID NO: 136326 - DNA, 410 bp, Homo sapiens
ctaactaaggggcctcggcctctccaatcttaaaccttctctctctgtgaagtggggactccatcctgaccacaacttgtctccagataagaagtaggtgggaagcagggtttggaaatcggcaaagctcctccatgaccctgaaaagagttggccttggtacaggttgcttggcccttcagaatatgaagcattttgtagatttgtggtacacttgtgcctcaaatgtctattggggcccactctttcaggccatggagtgagcacagaggaccagcataactcagccgcggcctctgaggactgaaagatgaacttgctgaggtgggtcgggttgctggcataccacctacccaccgtttgttttagacagaaaatggggcggatgaagagaagctgacttccctggg

SEQ ID NO: 136327 - DNA, 197 bp, Homo sapiens
tggaagctctgagaacatgagtggggcttgtcaactaccggtttcccaaagagagtgatctagctaaattctttgtttagcaaacctctgaaatcaatatcttttggtctttcttctttgtctagtgaagttctcctgaaaaaacttcttacagtttcctacctggagagtaaaggtctggctgccagctttctagg

SEQ ID NO: 136328 - DNA, 190 bp, Homo sapiens
ctgccttggccttccaaagtgctgggattacaggcgtgagccactgtgcctggccaaaatttgtttcttatacattcagcagatattttctgtgaacatgtaatttgggatcactgacctttttatttatttatttatttatttttttttgtgatggagtctcgctctatcccaccatgcctggctaatt

SEQ ID NO: 136329 - DNA, 259 bp, Homo sapiens
attgctcatatagcttacaggagactcatgaaaaatgtttctatttattccatagggttttcaaatttgtttccttttggttcaagcgggtgggtcaagaagatgtttgtgccctagaataatgggctgtgaacatatttttttgagaatcattgttctaaagtaggggtttacaatctggggacccaagccacggtcaacccacaagccacggtcaacccacaagccacggtcaacccacaagccacggtcaacccac

SEQ ID NO: 136330 - DNA, 248 bp, Homo sapiens
tcacacacaagaaaatttaactctaaaatttaactttaaatttaactttaaaaggttaatcaaagggctgcaaattagtaagagaccaattctaaaacccaagttttctgaatcctaatctagtcatccattatcaactatatcacattgcccccccatatttgtgaaataaaccagcccattttatagaattactaagtgacattttatttgtattggcttttgaggattgcacatgagcagatttt

SEQ ID NO: 136331 - DNA, 199 bp, Homo sapiens
tctctaactcctgacctcaggtgatccacctgcctcagcctcccaaagtgctggaattacaggcatgagccattgtgcccggccccacctgtagtttttgactgctctgtgatgcttctgcttccctggagggtctaagatgtgggcgatgagatcataggttgccctctgacccctgtgttgctttggaccatggggt

SEQ ID NO: 136332 - DNA, 647 bp, Homo sapiens
atactatccccttttttgttccttcaaagtaaatacaccacagagctggagatgtcccagacacagggggaagctgtttggatttttcccactgcctgtaatgaagcaagatagggaggaagaacttgggaacttgcgtggcaaatggtcaagtaaagaaaaagaaaagctttttctttacttgaccatttgtcacatgtgctttcaaatcctgaactgagtcacatctgaaataaatcacttccttgtcatttccatgaaaggggcagtacaagaaattccttgcacatccctggtgagccccttgttactctcagattcagctattgccttcaggaaaaaaagaaaaaaaaaaaaaaattttgggcggctgtgggcccctcgaaaaaagtttttttaacaccatcgtatgggcagcgcggggccaacgtgaggttaaaggtgaacactgggtccataggcttgttccccttacgaacatcggtggtcatgcacacgtgctgggttctcgtccaacaatttaaaacagcccgggggcgccacccgaacgtttcgtatcacgatctcccgaagggagttcggagcatcatacggggatcttttcaacagtgttccaaggaagtcgaattcaaaattcagcccgcggg

SEQ ID NO: 136333 - DNA, 753 bp, Homo sapiens
ggacaaagtcatgctctgtcacccaggctggagtgcagtgaagtgcaatcatggttcattgcagcctcaacctcgcaggctcaagctatcctcccacctcagccttttgaatagctgagactccaggtatgtgccaccatgcccagctaattttttttatttttcatagagatgagggtctcactataagttacctaggctggttttgaactcctgggcccaagtgatccttctgcctcagcctcccaaagcactgggattataggtgtgagccaccatgtctggctgaatttatatagataatgagattgctacagaaagaggtacttctcagaacttgcttaaggcaggctgacaatcacaaaaaatttgttggtgctggttttagacgaggttgcttttggctagatggatcggtattagtttgaaaggactgccataataaaacaccgcagactgggtggctttatgcaacagaaatttactttctcagagtctgggaagctagaagtccaagatcaaggtgttggcaggtttggtttcttcggaggcctctcaccttggcttgtagatggcttttcctctgtgtgtgaacatccctggtatttctctgtgcccacatttcctcttccttataaggataccagtcaaattggattagggcccagcctaatgccctccttttaactgaatcacatctttatttatttactttttgagacagagtctctcgctgttgcccaggctggagtg

SEQ ID NO: 136334 - DNA, 342 bp, Homo sapiens
gactgataggtaagccaaggtataaagtgttaatctgtcacacacagcatcaccaagtgaacaaggcagagtcagcgagcacagtggcccagtgcctgggctgtttcttagtctaaactaatctgctagagacaaaccagaaatgtggagtttgggcttcgacacgaaacagacccatgttcaaatacagctctaccacttgccagctaagaaaccttggcagttacttatcctctgtgtgcctcaactgtgttttgtgtaaaatggagaaaacaagacataccttgcagggttgttgtgaatgagacaataaatactaaagctcctagcatatgggaagag

SEQ ID NO: 136335 - DNA, 322 bp, Homo sapiens
atacagtaacaaatgtgtattgtttaaaaataatggaggtaagtttttaatgctatttattgtgaaactgcaagcccctcatccctttttgaagtagtacatacatatttttaaaggacccaaacacatacctttagaaatcagcaaaaccaaactgctatgaagtatgaacagaagcaaaagtcaatttctaccctaaggacagggcacaaattacactaaaaatcaatattcttcctttgaaagccatgagtcctttctaatcacattttaacttcaccctcaccccacacatacacaagaaaaagcagagatgtgggtg

SEQ ID NO: 136336 - DNA, 557 bp, Homo sapiens
tctgtattcaataatgctgagaaatcaatgaggtcagggaaggctgggcttagcaacatggaacttcagggacatggaagaaacagagatcagactggagtatgctgaggagtgagtaggaggtgacaaatggaaataaagagtaaaaccaattcctttgagaagctttgttgcaaggatgtgggggatagttaggaatagaaaaaaagctggcaataatgtgcaatcaagaggaaattttttaaaagtggtctctcatttccttgttaacaactgactcaggtaaaatttaagattaaaggtttttgttgttgtttgcttgtttttaagtctgacagagagaagatgcgtaaacgtggaaaaggcctggaagagaatgagcccaaagagtcaggaaatggagggttcactgatggagcaagtccctggaaacctggaaggggatgggatctgggacacatgtagagaaattagcctctggtgagagggtaaggacccaagtcaagtcagtgattgtgtatttataaggacttagtatctataaagcttacttctac

SEQ ID NO: 136337 - DNA, 324 bp, Homo sapiens
caggagcccaccaccacgcccagctaatttttgtatttttagtagagacagggtttcaccatgttgtccagactggtctcgaactgctgacctcaggtgatccactcgcctcggcctcccaaagtgttggaattacaggcgtgagccaccgcgcccggcctgggccacataatctaaatactttggatactagatagtttacagagaagtttcaacaatttgagatttgagattaaaaataggtggtagttatacttggaccaaagaatgttaaaagattgactagctctcttttaagaatgagggggttatgtaatgaaaatt

SEQ ID NO: 136338 - DNA, 546 bp, Homo sapiens
gtgagtatattaagaatgtatttattaggtaagtctcttttttacttcttgtgctattcagggtctcccagacaatgagtagtaagacagttgagagagtaaagaaaaaataagagcagagagttccagagtcatttgtggtgtgtgaatatagacacgttgctagctgtgtactctacccctcccactaccatcccaccccatcaagggcccaggaaaatgctgcatgtttacagtgtcatccaggcacaaactacctttttctgtagtagtcaaatttcaaaagacatttgtaggtcctactttatttagttagaaacattcttctatactagaagcccttaaatttggatcaaagagtaagttttatacaaaataataagtaatcactccgaaattatatgcgatacattgtgtttatatttttttttcctgtggagaccatcagttggtttttattaattgttcagcgatagtgatgacagaaaaagttgtctaaaatggttttacaaatttagaatagatgtgattaaaatgaagattttg

SEQ ID NO: 136339 - DNA, 356 bp, Homo sapiens
agcagggatcagcttatgcacctcattctcatcttcattatttgaactgtctgcagctttagaagagctttcgaatgtcatcaagatcttaaagctttctccatccttcccttgcaatgtgcccctttatattggttctttctcatttttactacttcttcattgccttatggtgctgggcacagtataaaactcactaaacgacattctatcaaggaggagatggtcaccaaagatccgaagtattcagtgaaatatttcccatttggaatgtaagatcctgggcagagataagtggaattgtatttccaaggacatactaaggtaccataggccttgattcttatcttagacaa

SEQ ID NO: 136340 - DNA, 399 bp, Homo sapiens
cacgggaagttcgtgccatgtgcagttggggaggagcctggcctcttcagttcttgtgtgtagcctggaatcagtctgggggtgggggtgctgttggcaggaactcttcttgctttgctgagagattttttttttcttcttttcctttttcacccaataaattctgttcccctcacccttcaatgcgtctgcgttcctagcttttcctgcttgtgtgacaagaacctggttttagggtttaaggaacaaagttctgcatcaataagattcaaaagaaatcattctattgaaatatgattctaggcacaggctagttgggggtctctgagccccagatcccacagctgtgctgagatgcctgcccacaagctcaaggagcatgtctaggagtccacggag

SEQ ID NO: 136341 - DNA, 303 bp, Homo sapiens
cttaactcattccagcatttactcaaatatccaaagcccacagtctcttcttagacaaggctgcagtctcttctgccctgagactctgaaatacacagcaaattaactacttccaaggtacaatgattgtacaggcattggtgaagcattcccagccaaaaagaagaaatttgccagaaagaagcacaaaacacagatgggacttataaaccccctgcaagtcaaaagcccagcaggccagtcatccatcctacacaaccaaatcatctttttggaatctatgtccacatccagagcacaggg

SEQ ID NO: 136342 - DNA, 489 bp, Homo sapiens
  misc_feature (6)..(6): n is a, c, g, or t
ccccanaatggatcccaaatggaatccccaaatgaatcctacccagaggataacaatctccaaatgtgattatgaaacctgtttctggtaatggagctcagaggactaggtggaacgaactacaaaaccctgtcagagtggtgtgaggatagagaaaaacagaaattttccactcaaaatgagcaaacttaattctaaaacagaagaaaaaagtctaatgctaagaaagtcagccaacaaaattaacagttagagcagggattctttccaaatgaaaatctttttacagagcaattaagacaaagacatttaaataagtacgctaaaaacattcaaagagataaatgaagatacagcttttaaaagaatgataaaacaatgccaggaagaaatgaaacaaatctaatagattataaaaaagaataaattagactggtcattgacatttttaaaaaaccaataaataagaaaaactgtagactggataca

SEQ ID NO: 136343 - DNA, 318 bp, Homo sapiens
agacggtgtctgctggggaggagcggcagctcgggggacagcaaagtggaacccatggggggtgggagtggacatggaggaaagcgtgggtcgcgtgacaccccaggagtgaaaggcctcccctcatcggggtcccgagcgccggatctcggcgtgcccgcgtgttcccccgctgcccccgcgctgtcctatcacagcccgagcaggatccagaagtgaaactgcccgggtcacagcccagcgccgctgctgcaccccgccccgcccttccgggcactgccgctgcgcaggatctcccggcgctcgggcgcctgcggg

SEQ ID NO: 136344 - DNA, 419 bp, Homo sapiens
cactatgttgcccaggtcggtctcgaattcctgggcccaagtgattctctcaccttggcctcaaactgttgggattacaggcgtgagccaccatgcccagctgagactaccttctggatctgatgaagtattagaaaggagcgggtggcttctcctttgtctctggtttggcaatcggagctttcagggcacagtgtttgtctccagatgttgatggaagtgggcactccttggtggcctccaacaggaaaagcgtgttctttcattgtttcctatacacacagacaaccgtttttccaggaaggcagccccatctttagtcattgactgcgggcctatcatcagtcatgacgaagaccgagtgaggtgtgtgcaggcccagaactagcacatcacagccccagagtgtgctccaaacc

SEQ ID NO: 136345 - DNA, 269 bp, Homo sapiens
aaacattctgagggccagatttgaccaaaagtacttagtttgccaacctcagatttaggactgtgtcagtaagccctataggtatctattctctcaggactatgtgattacagtcaacaataaaataacttatatccataatagtgacttttaaacactaagaaaatggataaattatggttctctatgccctatttaagaaggcttgcaagtattacatcttagattttcatcaaaaaaataaaaataaggttttggtgtttataatg

SEQ ID NO: 136346 - DNA, 624 bp, Homo sapiens
gtcccagctactcgggaggctgaggcaggagaatcgcttgaacccgggagggggaggttgcagtgagctgagatcgcgccactgtactccagcctggcaacaaagcgagactccatctcaaaacaaacaaacaaaaaaaaccgtggaattccatgccacttacctcctcctctttgccccttttttaaaaatctttttatagagacgggttgtagggggtggcgtctcactatattgccagggctggtctagaactcctgggcttaagcgatcctcctgcccccacctttgtgctgagattacaggctgtgagccaccgtgccccgccctcccagcaccttccttgatgctgacccctgctcagcccctcaattaaggtgctgcactgcacctcattcgcagggggcctcttcgccggaactcgctttcaggtgggtctacaattagttgggaaacaacgggttgcaaggctgacctggtctgggacatgagaaggggtgaactacaagggtttcaaggttggaggacgttaggtcgggcctccgggggtgtgggattgaggctgtgttcttccacaaattgcatcccaattttgcacaacttagcaagaaaacccccctcagc

SEQ ID NO: 136347 - DNA, 600 bp, Homo sapiens
gtcccagctactcgggaggctgaggcaggagaatcgcttgaacccgggagggggaggttgcagtgagctgagatcgcgccactgtactccagcctggcaacaaagcgagactccatctcaaaacaaacaaacaaaaaaaaccgtggaattccatgccacttacctcctcctctttgccccttttttaaaaatctttttatagagacgggttgtagggggtggcgtctcactatattgccagggctggtctagaactcctgggcttaagcgatcctcctgcccccacctttgtgctgagattacaggctgtgagccaccgtgccccgccctcccagcaccttccttgatgctgacccctgctcagcccctcaattaaggtgctgcactgcacctcattcgcagggggcctcttcgccggaactcgctttcaggtgggtctacaattagttgggaaacaacgggttgcaaggctgacctggtctgggacatgagaaggggtgaactacaagggtttcaaggttggaggacgttaggtcgggcctccgggggtgtgggattgaggctgtgttcttccgagtcgcccttaagtcgggccaggca

SEQ ID NO: 136348 - DNA, 384 bp, Homo sapiens
aaaaaggtcaaagtagactcactatttaatcatattttccaggacaccgacatgcctcccatagatctaaagccccagctttatgccatgttgctgtatggacagcagtagtccccaaattaatctcacacatttcctcctgtagcctgaacatggaattcccaacctccccatgtctgaccatcaaagcgttaaccaccttgaaagcccaagctcagatgccacctgccctaggaagattttttgaatctcctaaactggaatgtcagaactgtgtgagtcctgtttgcctcagctccacacagctacagggacaaaacactcacaaagtaaatcggagcaggagacattttggcctgccttgttccaaggcatcttcccagg

SEQ ID NO: 136349 - DNA, 433 bp, Homo sapiens
ctgctgtccctgaagtttgcctcacatttctgcaccaacagacttgttttactggtctgcatttgagtgctctgtgcacttctgtgtaccatttattcatttagactgcacatgctctgagggagtggcccctccttccatttggtcttacagccctgtgactgtgcacttacagttcccggttctctacagagaacagtccattacggatcactgatttgctcagaagcaggcccttgagattcatctctctaaagggatttctctaacgtaatgatatgtgtaagccaggaacttcggagcccagacagtgcacctcaagagcctggtcagcactggtcagaagaccccccataaaacccgaaatcttgacatttccaaaacctgtctgcatatgtgcctttacttctttttttcttttttcttttttttt

SEQ ID NO: 136350 - DNA, 203 bp, Homo sapiens
gagacacattagatgactctttctttctgttcatcactaacactaagctagaggggaagaacaatttaatttgtttctgatgattttgtggtatggaatgtaaactggaaacctctgctttaggatgaaaggaccagctaggaatacagcaaggatgatgcagtaatgcaagtgaaaagagctggcatataaatactcatcca

SEQ ID NO: 136351 - DNA, 307 bp, Homo sapiens
acaaaatactgagattacaggagagagccactgcaccccaccaaggctttctgttaatcatgagtttaatcacttaacaacagactttacagcatcaaaaaaaacccaaaaaacttcaaggccaaataaagccatcaacggtatcagttaattgtaaccagagaaaaacaatcaaatgcctaagagatgtcctcaaagctattctgaaatgtgatgataatatcaatacctcttaaaatagtgatgccaacttcccccatacacaagttctgcaaatgagatggacaggagcatgacgcagtctctg

SEQ ID NO: 136352 - DNA, 329 bp, Homo sapiens
agtggtgtgtattgttcttttagcattgctcaagctacttagcttgctggaggcaaaggggatggcccttttacaagaaggtagatttatggatgcatcatgttgcatgcataaacacagtaatggcatgttttaaagtagtaagccctaagtataatgtatagcttaaaaatcttgttaaaatcatatatgggggattatagttttatacttaagtatagttttgtacttacagttttaacctatatagttgaaaactgaagctagatgccagaacctatggcaatcaccaataagatgtggaaaaaggaagaagacattccaaattg

SEQ ID NO: 136353 - DNA, 306 bp, Homo sapiens
aacctggtttatgcatcatgcattagtttgtggaactgaaaggttaatgctggaaaaaaagatcagagatctctttggttctttgccccgacttagttaagattgtgtaacttgtgcaaatataaccatttcctgtccgctgaacaaagcaattagtggactgggtacagtttctgagacaatttaagggaagaaatcaatctggccatgtctcactgtagttcattttaaagaaagaaacaaaagagacaggaaaatatagaatatcactattttgttgaatagaagtcattcttgctttatata

SEQ ID NO: 136354 - DNA, 412 bp, Homo sapiens
catggggttaggcagtggtaacaaagaaataagccctattctcatggagcttactttgggagtggtgatactcaacagactgtaatttgaagtagaagcaattaactttgtcgataggttcttggagatacaactttaaacaaaatgagtatattgcagcctcttttttcatcaatgttataatgaaaccatgttgaaagcagtggcattatttgaggacctgctgtctgtcgtttcacttaaagttagttttaaagaatgtattgaccacattaagtgaggatctactgtaatctagggatggcccctggagaaggaaggtagcatttaggttgaagtttgtggggatggggataggtaggatttggaaagagagaggggcagagagtgcgcaggggagcacttaggatgg

SEQ ID NO: 136355 - DNA, 1499 bp, Homo sapiens
tacattttattggctaattaggtttctacctgcagagacacacatacaaaaaaaaccgtagtagcaacatcttactgggttttcttaaatccaacaggtggcttcttcttggatatctgaatggtggtgagatcaacctctgggccagccaagtatggaactcaatccaaaacaacggacttcttttgtttcgtgtcagttcagcttcctacaaacaaaattaaagcagcattggtttagtaattggaaatgcatatcaaagaaaagaagcttaactcaaaacagattttcctaaccatcttcaatgtacatgtgtaggagaaatgcattctttatttgtagcagtgcaaatgtcagtgattacaaacatgtgtgtgactgtttgccagcaatttgttcttgcccttggatgatcagaccctaacggaatctaggcagactgtggaacttccattggcttccactggctttggtgtgaaatatagagatatgagtagtggtgacaagaggggacacgggaaaggcccgtgggaataggcctttgaggggaagcacgctgatctcttgttctgcagcgcatgcttgggatggtatgcgcatgccttctctcactaagactaggactgcttacagaatgcgaatataagtatccttatttgggagaaaagtacattttcaagggctggtaaaatgacgtggaggaagggaggatccagggagccttctgaagagtattgtcaggatgtctcttctctttcagccacctggatatgtttcacattttgtttcccaaacaaggactagattggatcccagaagggaatggtttccttagtatacattccgaattcctttgtaagggaaaaatccacttcatctggtctaagaatacataagaacaaatgaaaatgttgtggctggagatgttcctgagttaatatcaggatgtttgcctgctggtttctgttttaccaaacaaaacatagctgccaattcatccatctgtaaaagtgctccttgtggaccccctcaagagaagtactggttattttatttgcagaaaacgttttattgggagttgtttactttctgtgactgaagtggggaacatgagggtccctttaccgagccctcatattccatgtgtactctgtattttattgaggctgtttcccagtcagaacagcgtctctctttgtttgtcattccaaatctttcagtgtctttagggctctgagggccctggagagcctcacccaacctctcatccttccatggctgtccccacctctgtgcacttatgagtcaatgttgccgcacttcattacatgctgttcatattacagcattataagattttttcttttaaaagcctatcttcttcaatcgggtagtaagaccattgtgggttgaggcatgtttcatacttcccacataatcactccagacttaaaacagaaccggaaatacatgaaataaaaaattatttttctgttctc

SEQ ID NO: 136356 - DNA, 1483 bp, Homo sapiens
tacattttattggctaattaggtttctacctgcagagacacacatacaaaaaaaaccgtagtagcaacatcttactgggttttcttaacttcttggatatctgaatggtggtgagatcaacctctgggccagccaagtatggaactcaatccaaaacaacggacttcttttgtttcgtgtcagttcagcttcctacaaacaaaattaaagcagcattggtttagtaattggaaatgcatatcaaagaaaagaagcttaactcaaaacagattttcctaaccatcttcaatgtacatgtgtaggagaaatgcattctttatttgtagcagtgcaaatgtcagtgattacaaacatgtgtgtgactgtttgccagcaatttgttcttgcccttggatgatcagaccctaacggaatctaggcagactgtggaacttccattggcttccactggctttggtgtgaaatatagagatatgagtagtggtgacaagaggggacacgggaaaggcccgtgggaataggcctttgaggggaagcacgctgatctcttgttctgcagcgcatgcttgggatggtatgcgcatgccttctctcactaagactaggactgcttacagaatgcgaatataagtatccttatttgggagaaaagtacattttcaagggctggtaaaatgacgtggaggaagggaggatccagggagccttctgaagagtattgtcaggatgtctcttctctttcagccacctggatatgtttcacattttgtttcccaaacaaggactagattggatcccagaagggaatggtttccttagtatacattccgaattcctttgtaagggaaaaatccacttcatctggtctaagaatacataagaacaaatgaaaatgttgtggctggagatgttcctgagttaatatcaggatgtttgcctgctggtttctgttttaccaaacaaaacatagctgccaattcatccatctgtaaaagtgctccttgtggaccccctcaagagaagtactggttattttatttgcagaaaacgttttattgggagttgtttactttctgtgactgaagtggggaacatgagggtccctttaccgagccctcatattccatgtgtactctgtattttattgaggctgtttcccagtcagaacagcgtctctctttgtttgtcattccaaatctttcagtgtctttagggctctgagggccctggagagcctcacccaacctctcatccttccatggctgtccccacctctgtgcacttatgagtcaatgttgccgcacttcattacatgctgttcatattacagcattataagattttttcttttaaaagcctatcttcttcaatcgggtagtaagaccattgtgggttgaggcatgtttcatacttcccacataatcactccagacttaaaacagaaccggaaatacatgaaataaaaaattatttttctgttctc

SEQ ID NO: 136357 - DNA, 751 bp, Homo sapiens
taatttattatatatttcgaaatagctagtgggggttaggggaaaaaaatagctagaggaattttaatgtccccaacacaaagaaaagataaatgtttgaggcaatggatatcccagttgtcctgatttgatcattacacattttgtatgcatgtatcaaaatatcacatgttccccataaaaatgtatcactatgatacatcaattaaaaatacaaaaataagtaaataaatgagatgaaggtcgaaattactccttgatccatgggctgcagaatgaatgttgtgttagcaggcatgaaagcaacattaatcttcttgtacatctccatcagagctcttgggtgaccaggtgcattgtcaatgagcagtaatattttaaaaggaatctctttttcagagcagtaggtctcaacagtgggcttaaaatattcaagaaactatgccgtaaaacagatgtgctgtcatctagtcttttttgtttcacttatagaacacagtagatttagcataattctcaagggccctgggattttcaggatggtaaatgagtattggcttgaacttaaaggcacaagctgcattagctgctaccaagaaagtcagtctgtcctttgaagctttgaagccaggcattgacctctctctagctataaaagccctaggtggcatcttctgaaataagactgtttcatctacatggaaaatctgttgcttattgtagccccttcatcaatgatcttagcttatcc

SEQ ID NO: 136358 - DNA, 322 bp, Homo sapiens
aaaggtgtatcttagggtgggggaagcatgaggaagagcattctaggcagagggaacagtgtgaacagcatgcttccaggttccggggagcgtggctccctccagagcagggggaaggcctgggaggctgaggccagggaggagggggcccgtcgaggcatgaaggttcagcaaggcctgatggtcaatggaggaaccgtgcctttaattctgagctcacccgggtgtggggttctgctctgtttccttccatgccctgatttctctgtggccaagtacacttggccgtcattccatatgaccaaggagaggccaagaatgt

SEQ ID NO: 136359 - DNA, 556 bp, Homo sapiens
acctggttcatcctttgtggatgggaagtatgagtcagacttgagcaatcgacagctacactttgatgtcccatgccattctccacccattccagcactccctgaccaaaagaacgttccaaagtgggcttcgttatgccaactctggttcccttcagcatctatgatattaaactgtgacgtagagagaaaacattctttctgaatttaggtggaaacaatttagttatacaaacacacaggtccacaagcatgtctgcccccgctctgccatacagatgcacatatctccagaagaaaagcactaattgtgcataagcgcacagccttagtcagagagcttcagctgggatatgcacagagcactgctaatagacaaaataattttgtgtggtatgacaaacattctaattttaatagtatatttattttagtttggaaataatataacaggatatttatggtgaacatacagaaggatcattggtggagggatcattggtgggtgattgagagagagctcacagaaaatccacagatactgagatcttggaga

SEQ ID NO: 136360 - DNA, 397 bp, Homo sapiens
tggaattaaaattgatatgagatgaaaattatttttagtgctaatataaaagtaatttggcttttttgttcctgtttcctgagatgctactagagatattccttagtaacattttttattttttttgcttgaaaagaataatgtcagatatagtttatatttctaaagaaataagaataatctatttattctaacaattgccaattccatttgtcagtatatctctacgcttttagtgagagatggaacacagaaaccttataataaatcttaatcctgtcctacaacaccaggttgactgagtatatgtcctcattaaacatgtttccatagtcagttataaatattaatagcatttaacatagaaaatttagcagtttttatttctctgtaaaac

SEQ ID NO: 136361 - DNA, 563 bp, Homo sapiens
atgcttaaatgttggctctcaatgaatataaatactaggctagatttgggctccatttaacgtatacgcccagtgacttaacattggagccgctgccatttccccacgaatctcgcagatagaatggcttctgttttcattcccacttggcaatgattccctgcccatttcatatggtttgtatgaaatgggggagaagttctagtttagactatggagctcaaattaaggttcatctcttagctacctatttgtgaaaagttttaggtttgtagtgttgtagttgtgatattttactgttatatatgtaactttttaaagattataggcagtactcccttgattaatttttagagggcaaagaattcttgaattgtaaccaactcagaaataatccaggcatatagaagtatgcaaacactatttgttgaataaaaggaaagaaagctaatttctctgcagtgaacattaaataatctgttggctggatgacgactctcttctttacaatcaaggaaacagaagtgcagtacaggtgcatggctgaagactttgtattgtat

SEQ ID NO: 136362 - DNA, 1036 bp, Homo sapiens
actccatctcaaaaaaaaaaaaaatgtatagaagtaaattattaaatttttatttatatattttagtttacattatacattttcctaataaaaattattttgacaggctgggcatggtggctcatgcctgtaatcccagcactttgggaggccaaggcaggcggatcacctcaggtcaggagttcgagaccagcctggccaacatggtgaaaccccatctctactaaaaatacaaaattagcctggcgtggtggcgcatgcctgtagtctcagctgcttgggagactgaggcaagagaatcgcttgaacccaggaggcggaggttgcagtgagccgagatcacgccactgcactgcagcctgggcaacaagagcaaaactccatctcaaaaaaaaaattattttgacttcttaatctttagattataatctgatagttttagtatttgaagagttggacttgttagagataaagtcttgcagaactaccagttcctttgtggtttttcatgtaaatactaacttaggcccttctagtcattgatttatcatttgatgtttcaatatgtgtctatttgtaatagtattaaattttaaatgagtgatttcagctgaagtagagtgttgctgccagcccagtattttgatctaatttccccaagaatttcatgaaattagaaatccttaccagcttacaaaaaaaatgttacatagaaaaattttcagtaaattcaaagaagtaagatcattttggggatctttaaattcctggtcaattcctgactttttttttactgtatggactgtcttgggccactctttatggtcctagattaccttcatctagtttgactgacttagttttggaaatcttcctcaacttcaaacctgtaaatttaaagaataaaaactgattttgctctcaggtaaaagaaaatgtaatcaggactgtgaccctgatatccttcaagtctgtaatgtattcaaaagccagataaataaacttgaatgatgtttaatcatctgaatttcctgaa

SEQ ID NO: 136363 - DNA, 216 bp, Homo sapiens
tggaaacttgtctgagaactagtagcagagcagaataatctgctttcccagcaagacagcttctttctcctttgtgaaggtatagaagggacaggtttggtgtgttctctgatgtacaaatccaagaccttcaggtgaggagaccgacactgacgtgctgcctgttatggtaatgacacactcagggcaccatctccaaatgatacccaggccgat

SEQ ID NO: 136364 - DNA, 345 bp, Homo sapiens
taaatagataaaaagaatcactgtagtaaaatagcagaacctgaagaataaaaatacatttttcaatatgactgttaacaaagagaggtaatattgacaattttacattaatgttacttagaaaaggaatattttctaagttaagagaaaaagtaactacaatatgcaattatttgttccactaagctgacaataagtagaaaaataacaatacctttttaagtacataaaacaattttattatcaaatggatttttctaaaacaactcctaaagaattcagtttgcctagaagagaaatacaaatagaagtagtgaagttgataccagaagcaagatttggaaa

SEQ ID NO: 136365 - DNA, 392 bp, Homo sapiens
agctgggactacaggtacatgccatcatgcccagctaatttttgtattttcagtagaaatgggatttcaccatgttgcccaggatggtcttaaactcctgagctcaagtaatccaccctctttggcctcccaaagtgctgggattataggtgtgagccaccacgcccggccagactaatatattaatcccacttctgtaacaaccacaactgcctccattaccttctacagaacaaaattgagagccattgacatgtgttttaggatattgaagaataggtatccattctatggtttccagtcttatttgccattgctctattacatgtgctttatgctctagtctagctggactactttaatgttgccagaacactcatcatgctttaccc

SEQ ID NO: 136366 - DNA, 370 bp, Homo sapiens
agctgggactacaggtacatgccatcatgcccagctaatttttgtattttcagtagaaatgggatttcaccatgttgcccaggatggtcttaaactcctgagctcaagtaatccaccctctttggcctcccaaagtgctgggattataggtgtgagccaccacgcccggccagactaatatattaatcccacttctgtaacaaccacaactgcctccattaccttctacagaacaaaattgagagccattgacatgtgttttaggatattgaagaataggtatccattctatggtttccagtcttatttgccattgctctattacatgtgcggtaagagctcgccactcatggccgtggttgtgagcgat

SEQ ID NO: 136367 - DNA, 355 bp, Homo sapiens
tctctgcattccaactttcacattttcagttcccaggagagagaatctgattggcctggttggggtcctgtgcccacttctggctgtcacctgtggctttcttccctcagttgtagaccacactctggatacctgggacccctgaaatctcctgcccagacaaccccaagcttctcaggactttttgtgggctgcttccctgttctgcctgtgcagtgcaggccttgtcacaatgtctgaatgcttaggccagagacgtgggggtttggtgagaaaggatgagctgggtagctacactcaagtgcagagccaccagtattgtgggacagagccaggcatgggaagagaagtgggc

SEQ ID NO: 136368 - DNA, 367 bp, Homo sapiens
aaaatcagagactcagagacgtgtacaccaatgttcatagcagcattttcacagtatccaaaaggtagaagcaatccaagcgtccatccacagacaaatggataaacaaactgtgatatctacatacaatggaatattattcacgtataaaaaggaatgaagttgatacgtgctacaacatgaataaaccttgaaaacatactaagtgaaagaagccagacataaagggacaaatattacttgattccacttataataaagtatctagagaataggcaaatgcatagaagaaaaagtaggttagactttactaggggctgggagaagcaagaaatgggaagtgattgcttaatgggtacagagttcc

SEQ ID NO: 136369 - DNA, 594 bp, Homo sapiens
agtaccacatttaatgtcaagtcacagagcagacagggtcagcccctcagccctggctctagctgatggactcagtgaccacacccacagccacgaggcatgaaagggcaatgactgtgagtcgggcaatctgagtcctcctccctgcccagccacctgcttgcttggtgaccttgagcaaccttctgggcctcagattcttcactgtgaaacaaggtggctggacgcacagcacctgcagctctgactggctccagcctcaccagcatagacatgaggtcctggtcaggctctctgctctgtgccttaggacccctgcccgcatcgggaccccaactgcctgttggtgcctccatgtccctgcaaggctgcatgccacatgaggggagcacctgtgtctttatctctgtgtccttagtgccgagtccgccagcatgcagcgctccagtgctattcagttgtaaggaatgaatgaatgtgttccagttgaatcagtaggatcagtagaacaaatacttggtgaagaagttccaacactagaccggtgctgtctgatagaaacagaacaggactcacgcctgtaatcccaggact

SEQ ID NO: 136370 - DNA, 360 bp, Homo sapiens
attttgaggtatacagtagattattatctgtactcatcatgatgtagtcatcagacttgtatctcctaacagtatttgcttttgttaattaaaaattttaaatagaaaccatttagaagaaatttattttagttttctagttaagtcaatttgtagaatattctgtttccaggtcttttcattaaagacatttatttggattggtaatttatcattggttaagttaggctatgctgatcattatcacaaagtatacatcgtatgtgatgctttacaatttccctttagaagaagctaaatattcttagttaagtaaataaatatctaacttccagcttttttcttgcttaatatcagttt

SEQ ID NO: 136371 - DNA, 441 bp, Homo sapiens
ccctgagcccccaagtagtgccaaatcatagggcatccgagagagaatcagatcagcccatctcatcagattctcctgaatatccacatccattcaaaatagattaactggacagcatgggaatgacttaccctcttgaaacctcaatttcattgtctgtaaaatggggataataataggaccaaacacggggctcttctagatttgaatgccttatgtacttgaaacatttagcacaatgcccagcatggagaaagtcatccagttattcatttcacaaatacgctaagtacaattttaactggggaagcggatgatggtataggaagacctagtgagggtccattagcccttctgggggtgggtttccaggcaggtttttgagaggttaaactgtgaataaaggacaaatggggactagtcacagaaaaggcagctctg

SEQ ID NO: 136372 - DNA, 243 bp, Homo sapiens
cttctttgaatgtctggtagaattctgctgtgaatccagatgcaagtccttagtcaggtaggtagtttgcaaatattgtctcctagcctgtagcatgtcttttcatcttcttaacagtgtctttgaaagggcaaaaatttttaattttgatcaagttcaactttttgatttttgtcctttatggattatgttttagtgtcaagtctaagaactttttgccaagctctaattttcaaagatttt

SEQ ID NO: 136373 - DNA, 316 bp, Homo sapiens
ggtgggcacaataacacctggctaatttctgtatttttggtagagacagggtttcacccatgttggccaggctggtctgaaactcctgacctcaagtgatctacccgcttcagcctcccaaagtgctagcattacaggcttcagccaccgcacctggccagtaccacagtcttttaaattaccataataagaatttgctttttaccatggggatgggaccaagccattcataaggaatccactgccattacccaaacacctcccactaggccctatctccaacattaagggtcacatgttaacatgagacttggag

SEQ ID NO: 136374 - DNA, 438 bp, Homo sapiens
agcatctaggaccacaggtgtgcagcactaggcccagctaatttttaaattttttttgtagagatggggtctccttatgttgtccaggctagtcttgtattcctgtcttggcctcccaatgtgctgggattacaggtgtgagccactctgcctggccccataagaggtctcttaatttattcagcagacattgtgtattactgtgtgccagatgttgggcatacagtagtcaataaatagtcaagaatgactgccctcgtggagcttaagtactaatggagaaagatagatgatcaaaataaatagaattttaagcagtagtaagtgctatggtggaagaaaagcagggatgggagatagggaatatggttgaagtgaagtttcaaaaagagcatagtcagcaaatgtcttattgagaaagtatctgaatagacacca

SEQ ID NO: 136375 - DNA, 232 bp, Homo sapiens
cagtctttttcattgtaggcattctgttgggtgtatgatgacgtctcgttgtggttttaatttgcctgtggtgctccaatatgacattttccttggtccctaagtcccctttgatctcagaggcattatctctgtacttagggaatgtgtgggaatagctagtcaaaatcttatggggctataaaactttctgcagcttttttttcccccttttaagttctgtatggcagga

SEQ ID NO: 136376 - DNA, 421 bp, Homo sapiens
gagtgccttatcaaagggctggggcatgaggacatggcaaccaggccctgtcttggaagcagggaagggcccttgtcggacgccaagcctgcaggtgccttgatcttggactctccagcctccagaactgtgagaagtgaacatatcatttcataaattaccatgcctggtgctgttacagcaacacacacagactaacacagtcgccctgaggctggggctgcagtgatgcagccacacgcccaggacaactggagccaccagaagctagaagaggcagggagcgtcccaccaagcctccagaggaagctgactcatgagatgcctggacgctgggcttctggtctccaggatgatgggggaatgcgtccctgttgtgttaaccccggactgtgtcaattgtcagaagcctctggacaca

SEQ ID NO: 136377 - DNA, 668 bp, Homo sapiens
gccatgagatgtcattacactcctagcagaatagttaaaataaaaaatacaggatgtggaaaaactggatctcctatacattgctgatgaaaatgtaaaatggatcggtcagcctggaaaattttatcagtttcttaaaaattaaacatcacttatcataggaaccagcaactgcactcttggacatttcaacagatagaaaaagtccatttgaagcactgatcactaaaagcttagtgtttgccagagtttaggaatagtgagagttaggtggggatggtaaaggcggatgtttaaaatggtatcatgagggataactttgtggtgatgaactggttttgtgtctttactgtgttggttatagaactctacatgtgatggattgacagagaaatacacacctccttaaacaaacatgctccaccaatgccaattcgccagggagctttgatatttttctgtaattttgtaaggtataaccatttgggcaaactagataaagagtagaggggtaatctcagtacactctactgcaacttcctgtgaatctataattatttttaaatgtttaaaaattttaagttttaatgttctgtgaaataaaagtcattaggaaaaactgcacactgtagtttagctttaagaatcaaacatatattattatatta

SEQ ID NO: 136378 - DNA, 285 bp, Homo sapiens
tgctctaaaaatattctgaatcactactccacataaaggaaaaaaacttttaatgcaattctcaagggtcatcttaaatgaatagaaatatgtttctttacagttaaattttctaaagatcaatttccaaataaaagttatgataatataggtaaagagaaatttttttctagttaactctgcactttgaaactattaaatgctgattacatttaacacattataattgaaaattctgactatctcaaattatatttttatttattgtgcatttagaagttacag

SEQ ID NO: 136379 - DNA, 205 bp, Homo sapiens
  misc_feature (40)..(40): n is a, c, g, or t
cctactttccacagggcacagggggcagcttgagtctccnggctagggtcgttgacgcaacaaaggaaaaaagaatttacaggaccattcagaatgtattagtggaagtcaggagtgaggttaagggtatatattctggagttgggagtcaccaggatccgggatggaagtaatagtaaatgagggctgtgagagacagtaaaga

SEQ ID NO: 136380 - DNA, 599 bp, Homo sapiens
ttcactccaaagtgcagagactttaatagggccccttgccttggcaggtcctgtattcaaataattgttccctagcccaacaaggctgttgaaagccttctcagccttttagacattcatccacctcttccaaattggcagacaactccaggaaaaagtagtttgaaatgctgggctcacctctccagattttttgttcttctcccaggctgtagcctcatcattcttcactacctcctcaacattacaatggcttaagattttaaaaaatacatttgaccagctttcctatcttactcactgagtgggttggttggagatacttaatgtgccattatagggagtggaggtcttagtagacattttcttttcttttttgagacagggtctctctctgtcacccaggctggagtgcaatggtgcgattatagctcactgcagcctcaacctcccgggctcaagcgatctgcccaccatggcctcccaaagtgctgggattacaggcaagagccactgctttcggccttacagaatcgtatcgtataggggcattcagaagtctgacataaaaattaacttgagacttttatgttcattct

SEQ ID NO: 136381 - DNA, 356 bp, Homo sapiens
cattatttaccctatctaaaattgtcttatttactcatttatttactgttgccataggagagtgtagagctatatgatttaatatttgactttctctggcttttaagagttattctaacttaccattaaaataactaggagggtcaggcgcagtggctcatgtctttaatcccagcactttgggaggctaaggtgagaggactgcttgagcccaggagtttgagactagcctgggcagcatagttagccctcatctctataaaataaaaataaaatagcaggagagaggtaatactccttctacaatcctaagatgggtctccctgaaaaaggtagtgaagatagtaattgatatg

SEQ ID NO: 136382 - DNA, 697 bp, Homo sapiens
cacttaaagtctcaatttccaagaactaattaacaatattaattgaggacttactgtatttatttgttaggtttgtgaactatttgcagtaggttcattatgtgcaaaaggcataggaacatttcccagttgtctttctgtattactaatgctgtgtaatcaccacaacattttacatcaccacaacatgtctatgtgttactgtgcattctccaaattggtgtagttcctcttgcttgttgcttatcaattccttgaattatttcatgattttttatattggcctaatgaccttatatgaagatatgttcagtaatgttagtaagttgttaacatttactatttctctttttcattctcagctacttctcagttttacttttataaattgaggaagtacataattgtcaagctctgaaaattgtgtttagctaaaattttaaaagttatgtgagagtaatagtttactaagtaaagtagaaacaaaaatgacaaattcaaaactattcagaaggttgaaataataaattacatttatgttactagacagtaatgttattgtcttaatctgatcattgaattttgcacctaaattaatgaaaaatatgcaaacctttattttcagtattgtttttgaattctcctcacacaaagcagctcatcattaataagcatcctcctgatacattttgtatat

SEQ ID NO: 136383 - DNA, 337 bp, Homo sapiens
ttaagaggccatgcagaggccaggcatggtgacgtcacgacctgttatcccaacacttttggaggcccaggcagttggatcccttgagctcaggagttcgagaccagcctgagcaacatggcaaaactccacctctacaaaaaattttaaaattaccaaagtgctgggatttttgaaagccgtcagaagcatccctgagggggtggatacaaaaggagcaagagcagagactcagtgactagaaggggaaagacggcacctttccaaggtggaaatgtttgaaattgcagcaggaaattagtcaggagacctgaacttgctatcttcagttcttcag

SEQ ID NO: 136384 - DNA, 486 bp, Homo sapiens
gaggagagggcaatgtgaagaaagacatagagattgaagtgatgtaaccacaagccaagaaatgccggcagcaactagaagctggaagaggcaaggaaaggattctcctggagagccttctcaggaggatacggtcctctttaatatcttggtgggcttttggtctcccaaactgtgagataataaatttcttttctttcaagccacctagtttgtggtaatttgttataacgcctacaggaaactaatatacatattatcttttcataatttaaacataattatctccattctaagagcagcagaggagcaggcagataacagacaataggtgacaaactccaagcaattatacccataaccacaaaccactgtaaccagcatttttttaaaagggaaagccaggcacagtggtgtgcacctgtagtcccagctactcagaagactgagaagggaggatcatttgagcccacaagtttgagtcca

SEQ ID NO: 136385 - DNA, 311 bp, Homo sapiens
cttaaggggaccttggttaaaagaatctcaggaacacagttaaaaaaaataaggagaaggcataaatttattaccagaaaggttaaatgatgtcacacttaatcactgttatagcaaaagatgcagcaagctgggttcaatatagccatctttcaaggcttgaaaatctttctttgagatggtctagactcgctcatggtctagactacatcgtgaagtccagtggttaggtcagttagcacaatcaggacaatagtctaacctgagttaatccaaggagtggcaactaattaggttgtattaaaagcctg

SEQ ID NO: 136386 - DNA, 1266 bp, Homo sapiens
aaattctgtagtgtgctaaaatgctcaagttggcacataaacccattccaagattttatagttcttgtagataacacagggatgtagataagttgaaacaaaaccagtgtcctctaagtctctatcatatacttattcctaaactgataattcttacttctggatttaaaatcaaaaataacacacttgtacagatacaatctaagggctttatcacacacgtgttaacgaatgtatctcagcttggttcttcttgtgtgctcattatggatctctctgtcttaggaattgcctcaggcattttttttttttacacattaactaaagggctattcgaaatcttgactcaggggttcttaacctacatttcatgcaaaaaatatatatatttcaatgtattttttattttagtcctatttgtattattttatgcatttaaaaacacaatcctgagagggatggaccagactgccacagcagctcatagcacaaaaaaaggttaagaagtcctagttgactttgtatatatataaagaaatctattacaataaaaatataacataatctattcatctatttatatgcaaacataaaaatgtaaatattgaaacaagattgcttcaatatgcttattgttttcaaaccaacaaactctcttaaggttcaatatgtaataaaaaacataacacaaataattattctatatgaatattatggttcataaattataatgtataatctatacattataatgtaatatataaactaaaatttatggcacaaaagataaatatggctttgaaattaaagatattccactcaacagacaatatttcatatttgatattacaatcatttattttatgtcctattataataaaaggtgaggactccttgtaaaaaaggaaatgttccacagagtcaatctaatatatcagatattggagattctatcttggtttctcttcctttacttagcctataaaactagttaaaaatggaatttcttttagcaattcagtttagtacaggagtgacattaactaatgacaataaattaaacaaagcctacattagttcaatttaagcctattcaacagaaatatagaaatatagtagctaaaaaaatactctggggaaggtaccacaaacattatctaccagggaacatagcataaattagtctgaaatttcctgagagtgactttgtcttagaacttaggtggtagtcatgaagagataatgtttttaggcagttaaaatact

SEQ ID NO: 136387 - DNA, 728 bp, Homo sapiens
aaattctgtagtgtgctaaaatgctcaagttggcacataaacccattccaagattttatagttcttgtagataacacagggatgtagataagttgaaacaaaaccagtgtcctctaagtctctatcatatacttattcctaaactgataattcttacttctggatttaaaatcaaaaataacacacttgtacagatacaatctaagggctttatcacacacgtgttaacgaatgtatctcagcttggttcttcttgtgtgctcattatggatctctctgtcttaggaattgcctcaggcattttttttttttacacattaactaaagggctattcgaaatcttgactcaggggttcttaacctacatttcatgcaaaaaatatatatatttcaatgtattttttattttagtcctatttgtattattttatgcatttaaaaacacaatcctgagagggatggaccagactgccacagcagctcatagcacaaaaaaaggttaagaagtcctagttgactttgtatatatataaagaaatctattacaataaaaatataacataatctattcatctatttatatgcaaaccttaaatggtgaatttgggaccaagatggttcggttatgggtttcaaccaggaaatccctaaggttcacctgtctaccttccccattatatccatggattttgggcacaatctatgttaactatcttaaggtatttttg

SEQ ID NO: 136388 - DNA, 862 bp, Homo sapiens
gtagagattgtcagagtctgccttgctagtctagaggtaggaccatggatttaagaacgttgcctccaagtttttgaattgtgaatttttgatcatatttgaacaaaaccccacctacagtctgcatggtcattgttctcacaagggtttgtgtgatgcactgacaagaacagaggctttggaggtgactcctgggtttgaatcaccatttgccactagctaattctaaccttaggtaagtcagtgtctctgggtctcaacctcttcctctgtgaggggtaggaaatagcacataacttgtagcattgttataagggctcgtgataatgtttttaaaacacctggctcaagcactcaggaaaatgttttattatgaagaccaagtgtctctgaaaagtgtttccttagtgtctggagagactacagcagcaaggcttttctgatcctactctgactctcaagataatggtgcttgaagtgaaatcacagaagagatgactggggcaggaaaagcaagatggaaaagataaagttgtggaagggactgaaagtccatgaagtgctgggctggggacagaaagggtttaatagggcagggtcttgaggaacaggaacagagaccttggttctgggttgccatctgattcccagaagagtaaaggaaatggggcaggaggatgtctgtggaggacacagtgtggctgagtggagagaacacaagcttctggccagtgaacctaagtgagaatgtcagtggactttgcacaggctgggtgcctttgggggtgttcatctcgctatgcttcggtcccctcatttaaaaaaattgatacataatattttacatatttatagggtacat

SEQ ID NO: 136389 - DNA, 501 bp, Homo sapiens
taacaaaacagaggctgagctggcagaagcaagataaatcaaatcattcttctccagacatctaataatccacttagtgacattttaaattggcttatactctctgactcttgcccaccaccaaaaccatatcttaaatatttttttgatcacattattttacatgtttacctttttaaaaggttgtggactttgacagaagccttttaaaataccataaaaatgtatcatcattctgcgttgttgttgaaaaatgatagaaggctaaaaatccacacacacaataagtaacagctctttatatgcatctttatacatatatatcattttatttctattaactgggatatacccatataaaaatttttgctaataagatgcatgcatatatttcctattcaagtgacaattccaccctgaataaatggaggggagtgccgttcttcaccatctgccatcttccagctgctcacctgaatcacagatatcctaggagatata

SEQ ID NO: 136390 - DNA, 347 bp, Homo sapiens
gggagaattgctgatctcttctgctgctaggaagcttcctccaaccagcttgactctggattccagatactcccattcactttttttgatagagtcctttttttgtttgtaggggaacaccacagtaaggtgtcttcaattacttagggcctatgtgatacaaatatttcatttgtccacactgcctcacagcatattcaaaagcagtgctcatttctacaggcacattcagtttctaagtgacccactatgccatgttcacttatggagatttctctttcatactccatagtccaattcctattgtctggtactatatctcattcccactccgcatttcatagaag

SEQ ID NO: 136391 - DNA, 381 bp, Homo sapiens
gagggacaattttttttggtttttcgggttttgtttttgttttgttttgttttttgagatggagtcttgctctgtcacccaggctggagtgcagtggtgtgatcgctgctcactgcagcctccacctcccgggttcaagcaattctcctgcctcagcctctcgagtagctgcgattacaggctcccgccatcatgcccagctaatttttgtatttttagtagggttttgccatgttggccaagctggtcctgaactcctgacctcaagtgatccgcccacctccgcctcccagagtgttgggattacaggcgtgagccactgcacccagccaagggacaattgtttttaatgtaagagacattagtatatttgtaactgga

SEQ ID NO: 136392 - DNA, 500 bp, Homo sapiens
aactgtccctttgaggttgtaaaaaagagagtaataacaattagcaggtcaaccaacaaataggaccttggtatctcacatttcagaggattcttccttaggtctccctactttctttcctgtcttagggatctgggataaacaattagcttggtaaatcagtgatattcttagctccagtcatagcagtgatactttgtgcaaggcagacaatgctcagatccctttggctaatggacttgactctcacagtatcacaagtagtagaagaacgaaagcaaatgaagggaaaaaagaaacatgggacacagcagaagaagactctggaactgatagtgaatatgatgagagtggcaagagtaggggagaaatgcagtacatgtatttcaaagctgaaccttatgctgcagatgaaggttctggggaaggacataaatggttgatggtgcatgttgataaaagaattactctggcagctttcaaacaacatttagagccct

SEQ ID NO: 136393 - DNA, 462 bp, Homo sapiens
taatatctggagcagctctcctattttgttaagtcttctttcaacatctcctccttccactttgaatccatctgtcttgctggtttttgttttttgagacagggtctcattcttgtcatgcaggctggagtcgagtggtgttggaacaggaattaaaagaaattaaaaaatgttaagcagaaactcagttgtatgtaagaaaacccaattccccctgaaaaagagaaagagctggagttctttaaaaattaactgcctgtttttctgtggctagtgagccttgtctctcctcctttcccaagcattgtgaagaccctgtttctctatctgtgcagctgaaagttcactagacagataaactcaagctgtaaaacatgtttttccttggaaagtaagaaatgatttaatgcatgtctcaattaattaaataactgtctttgtttctcgcttctgtaatatgct

SEQ ID NO: 136394 - DNA, 181 bp, Homo sapiens
cttgtcctacccatgtgtgcagataatcacaactgatatttcacaaaaataaaaataaaaaacagaaaaaaacgtaattatatttatacgcatttaacaccagcacaatatggcatacatcacttctcaatacatttgatgtagataaaagtaatctcagcactgtgggaggccaaggcag

SEQ ID NO: 136395 - DNA, 402 bp, Homo sapiens
gggaggctgaggcaggagaatcgcttgaatccagatggcagaggttgcggtgagccgacgtcgcgccagtgcactccagcctgcgccacagagcgagaccccagcaggacgtgatgaaggtcaatggggttttgtccaacttgcctcagttggagcaacgtaccagtgcgcccctgccgtgtggccgtggggcttatccctgggagtggaatttgggggaaggagccggggccagggcccagctacagcggaggcggctgagcgccttccagagggttgggaatgtcccgctcgcaatcccgccgggagcgtgtggggcccgcgcttgctgcgtactcttaattctgcccaagtagccctaagatacagtctcttgcctccatacgcttatttagttgggta

SEQ ID NO: 136396 - DNA, 397 bp, Homo sapiens
ccctagaatgtttataataggattggtggagtagaagaaaagaatagttggggtggggagcagcctgtaatcccagcactttgtgatactgaggtgggaggatcgcttgagcctgggagtttgagaccagcctgggcaacggcaagaccccatctctacaaaaatttaaaaactagctgagtgtggtggcatgtgagtgtggtcccagctatttgggaggcttaggtgggaagatctctcgagccccagaggtggaagccgcagtgagacttagtcgcatcactgcactccaacctgcatgacagagtaagactttgtctcaaaaatacaaagataattggattttatgaaaatcacagtatcataattttatcatcttaaaataaggatatgctat

SEQ ID NO: 136397 - DNA, 259 bp, Homo sapiens
catgcatggtagtaagggctactgttgctccagttaaggaatcggacaagactttacttgagctggatcttgaggacagtctaaggtgtcaagaagggcagggtggctgggaaggcatccttggaggagggaactgccaaagcattatggggtataagagtgggagttttcagccaaggccccaggagatgccagatctcacattccaaaggatgggccagaccgcaggcaacattcaccaaagaggtgtccggaaact

SEQ ID NO: 136398 - DNA, 298 bp, Homo sapiens
aaacaaaagcatatgttggctttaatcttccttgtttgttcacatcaggaaactgagcctttgttcaaattgcttggccaaagtcagctatgttgggactagacctgggtctctctgactttaggcttattcctaattcactgccccacacttctcctggaggagaaaccctgtcccgaactgaacagagagtggcacgacctgccacttagagaggtgggcaaagtcttcccaagaacaaaggtatgaaggctgaagtatgcttttggagaaaaaacaaaggaattaagtgcaaacg

SEQ ID NO: 136399 - DNA, 505 bp, Homo sapiens
tttcctcttttcagtctagtttttatccaattacagaaaacctcttcctttccttttgttaaaaatagtaaagctctaatcacagcttttaagtttagtgtacaaaacacacacaccccaaatcttccactcaagtttttaagccagccacataaggagttcagctgtaatgtaaactgtgagttgctggttaacagaatgcaagatcgtcaacgacaaggatttgggattttgtctgttttgttcagatactggcatgaaatgggggcctttgcacacagaaggcactcagtgaacataagaattggctggagggttacagactaaatactattagactgttctgaattctttacttctcagtgggttggtagctcagagtaaataaaagcagaaagcctcccaaagctcaacaaaatctcctatataatcttaacatttggagtgctttgaattaattatgttcccccacccccacttttgttttttttgagacggagtctca

SEQ ID NO: 136400 - DNA, 186 bp, Homo sapiens
gattaccttcagaaacagagagcccactgtgttagttttttattgttgctataatacattaacacatatttcatggctgaaagcaacacaaatacattatcttacagttttgtagttgagaggtctgtaaagggtctcagtgggctaaaatcaaggtgttggcagaactacatttctttctgaagg

SEQ ID NO: 136401 - DNA, 214 bp, Homo sapiens
tttccaatcaaggctcaggtttctttagggttgtcaaacgtctcggacgagaaaaagctgcccaaggttgccgagattgaaaagccactgttgggagttcttacttattctctaggcctctctctgttaggaggtgttttcattgaggccagtcgagttttaccccacgccatgactcgtggaagacttaaatttgtaaattcctacggcatca

SEQ ID NO: 136402 - DNA, 360 bp, Homo sapiens
gtatgccatgagcttttttaaggacacattttaacatagattaaatctttgaggaattagcttgaattatttataggtaactgccaaaacatgctaatatccatgtgtgtgaaatataaatatgtttatcaatagctgagagtaattgtttgtatcatgatgttaggaatgatatagctatatttcatgcagtttttaaagcccagttgatgtagtttgtgtatttccctggctaacattgttggcacacagtaaatttctaacaatgatgattactctgcctccgtacagtattcactttaactagaaaaaaatttactactatgctaatgtggtacaatttttgaagtatgttaagat

SEQ ID NO: 136403 - DNA, 403 bp, Homo sapiens
cggattagagggggctttggaggactcggaattttattctaagaatcacagggagccattggagttttaaagcaggaaagtaatgtggtctgatttattttttaaaaatgtaactttgtccaggcgcggtggctcacacctgtaatcccagcactttgagaggctgaggcgggcggatcacctgaggtcaggagttcgagaccagcctggccaacacggtgaaaccccatctctactaaaaacacaaaaattagctgggcatggtagtgtgcgcctgtaatcccagctactggggaggctgaggcaggagaattgcttgagcccaggaggcagaggttgcagtgagccgagatcgtgccactgcattccagcctgggtgacagagtgagaccccgtctcaaaa

SEQ ID NO: 136404 - DNA, 223 bp, Homo sapiens
agcccaagttgttgatagagttttgttccttcttgtaggatggaagctctcagcttctaaagactactcttcatgagaggcatcttacaacagagctgtctattttaccaaggccagcaggagaaggcctcttgtgcttggattctgctttcaaggccttgccctattagggcaggctcacctaggatcatttttttgtttggtttttgttctgagacaaggt

SEQ ID NO: 136405 - DNA, 431 bp, Homo sapiens
tcacctttctatatctaaacccttccactgcaactcaggtctatttccacatagtctatccttgaagctcatggagaattggcaggtcagcattcgcttaacaaaagcctttattactgttaacaaagaatcttcagctacaagacagaatctttggttctcaatccaaatctgtttctcttgtaatctaaaacaactgggatttcctagcttcaggaagaaaggagcagtacctgctgggtcatcaaagattcttagagccacagagtttcatccccagcccaatggctcttccctactcctcctttctcttggttccaaaggaaaacccatcattgcctggtcaagggagaggagtaaagcgcatcaacataaagtgctagaggacatatggacagacaggaaaagaaggaaagggatgaagacaccag

SEQ ID NO: 136406 - DNA, 272 bp, Homo sapiens
ttacatgtgactatgaatagaaaggtttccatggatcttggaatcacggtggaggaaggtgatggtactttccttgagggtaggtgacaggtgaggtgggctgttggcagaggaacgacttggctgtaacaggaattgaagagagaccaactctttcttttttagttgcttgaagttgaaagatgtagaatgagtggcttctggaaaaaaaaagaggggacatctttaagggtaaaaggcaagtctctccattcatccagatgatggtagtg

SEQ ID NO: 136407 - DNA, 168 bp, Homo sapiens
tatatacacaaaggtatgatataggattttagggaccataattaaatattttttcagataatttttttgagattataaactacctacaactaaattcttaactaattctgaataataaactaaaaaaattaaagctatatatacatatatatacacacacccacatac

SEQ ID NO: 136408 - DNA, 304 bp, Homo sapiens
ctggaccccagaggtcatgacaaggggtcagaacctagagcaggctgcagatgtcagaggaggtgacatcacataggtgggaggggttccccaggacccccagaagtgccactgaggagcttggggaccacaggggccacctctctttccttcactccctggctgtgtccttccagagccactggcatgatacattccaagtccattctttctagaactggttgcaagaccagcttaacagcctatttccatgcttttatgcaacactcaggtatatacatgcacacgcacctgcgcaccctcc

SEQ ID NO: 136409 - DNA, 280 bp, Homo sapiens
caccaacgctctgccaatcagagccttccaggctgccctgggagacccagctggaaggaagcccactgggccacctcttatcagcagggacaggtggggacatggctccagctccacttccatcccccccctctctggctcacaatcctgcctgggtgaggtgcaccaccccatctgcacattggcagccatggacatggccacaacagcctgtggtccacggtcctcctctgactgctggcatggacacgcaacctacccaggtagaacgggaggggta

SEQ ID NO: 136410 - DNA, 201 bp, Homo sapiens
gcttttttggggcatggaggacgagatctcttctgatgttttaaagaaaaccttgggttttacatggctagtacaaagctggagaaggggtactcggaggaggaaagacgggtgggagagaagagagactgcccagaagcgcctctcatcacattcaaccaacaaaacaagtattttttagaaaaggtttcagcagcattg

SEQ ID NO: 136411 - DNA, 266 bp, Homo sapiens
ggctttctaaaaacatttacactgggatgttgcatacctgaatattattatgtcagtaggtacttcaaaaatagagataagaagactgaattctgggatgttgctgctggacactcttgaatttatatcttagtttggaaatctcaaaatagttcctttttaaaatttcacaattattctacttttccattaaacaaaaatctagttttccttgatgagcaaattctgccaatagtcttatttttgtttaatgtccttatactttt

SEQ ID NO: 136412 - DNA, 247 bp, Homo sapiens
tgctgggattacaggcatgaaccaccacaccggccaattttttgtggttttcgtagagacaggatttcattacgttggccaaattggtctcaaactcctgtcctcgtgatccacccgcctcggctctccaaagtgctgggggattacaggcgtgagccaatgcgccaggccaataatcactgctggcattcttgagtgcccatatgtgccacacactgtttttgcaaaaattataactgaagaaatt

SEQ ID NO: 136413 - DNA, 363 bp, Homo sapiens
ggcagctgggaaccgagtgagggctgtggtctgcaggcctaggcacagctcctccatgtggcttgggccttctcacagcatggcatctggatcaaaaaggcaggaagtggaagctgacagcctcttagccctgagcttagaagcgggcacagcaccatatgcctcactctatgggtcagagaagtcatagagctcacctagattccaggggatgggacagagaccccacctctcaaggtgagctctctaactgggaaatccgtgaccatgactttgaagtgaggttggatccaggagtccaagcaaggtcctgaactttccctccccgtctctggcctctgcagggctctgttgggctccagc

SEQ ID NO: 136414 - DNA, 378 bp, Homo sapiens
gcccctttatccagattttatacaaatgtaatctttatataccagagaatagcaatagactgtgaaaatgactctgagtttcatggagaagctagtgagcactataaggatatatttctagctagaaactaatagcatacaaccttgaaaaaaaaaaggcgagagagggtacatccaagagagaaaaattagaatgaagagaaatgtattgcatgataaagaatgtcacactagaaaggaaagacagaattttaacatcaccttttgctagcccatggttactctgttgttagtttatccccatcttgagtgcttgtgattctaatgtcctttttcaaacttctaagtggcctgagttgtccactgaaactgtacaaa

SEQ ID NO: 136415 - DNA, 124 bp, Homo sapiens
gttctcaccctgggcatgattcacaaaatagagtaagaccacagataaaagtcacatagaatcacaggcaatgaagaaaacttctaaaaacaaatatcccccagtgtccagtatcatccatccc

SEQ ID NO: 136416 - DNA, 129 bp, Homo sapiens
aataattaaaagggctgcttcagctatccctgtggccaggctggcccattccctctccctggggtggcttcttccttgcatttcctctgctcagaatagtcaagattttgccatttttaaacaaccagt

SEQ ID NO: 136417 - DNA, 411 bp, Homo sapiens
tgccggtcacactagagaaccccccgttatagcaccatggtattttaagtttttaacttttagccattttgttggttttgtagtggtatcacacggttttattttgcattcttatgactaacaaggttgagcacttttcacaggtgtttattggtcatttggaaaccttcttttgagggatggctacttgagccttgctcatttttctattgtgttgcctgtcttccttattgatgtgatgagttctttattcaggacaggagtgctttgtctaatctgtttgcaattttttttctcagattgaggtttgccttttcattcttataatggggtcttctgatgtacagtgttcctgattttaatgtaaattccaaatttacacatataaatttacaaaagtataaatttacc

SEQ ID NO: 136418 - DNA, 398 bp, Homo sapiens
agggtctaaagcaagtgactaacgtgaatattgtgtacagtaaaaaatgacccttgaattatgttgagcatagagatactaaagagacagtatctttgtgtcaccactaaacagtgggacaccatttcactgttcactgcagggcaggtgcttattgagaaaaaggcaacatttgaattgctaatagtttctctctcttttatttcttaacttggcacatacatatttagcaagttaaatgggttctatgcaatgaaatgaaattaatttcacttaaaaagtaaaataccgaccaataaaaattactgtctaatgaactgtacacagatgcatagggattcagtcaattaaagacctaagtaaggtggagtgaagaagaaaaagctcactgtctgaag

SEQ ID NO: 136419 - DNA, 366 bp, Homo sapiens
ttgttctaatgaagagacagggcccattaccagatacttagtgtaaggaatgatgtagtaataatataaacaaatatcaaggggtacataggacctggtctgtctccacacgtatcctatattgttgcataatattgggcaaatcatttcatttcataatatcggcaaatcatttcatttcatttcttgcaaatcatttcatttcttttgattttttcatccctgttgcactgaatgctggctggaagaaaatgcaaaacgtctcaaattttgtgtttagctgagcgagaaacttatctcccttctgaactgtaaggcgtgggtgtagaatgaagtcatcaaaaccagtacccacaacactcgtcg

SEQ ID NO: 136420 - DNA, 313 bp, Homo sapiens
ctttgctttaccttgagtatgcaaatgcatgtttgcttgggtacttaagaacacacctacatgtgcacatgcaggctctactacagccccaggtgggacacatcaggccctgatgcctgattgagagtaaaagtgaagatgtaagacttcaacttgggcctgagaatctccacaaactgaggcttatccagtgctttggagggaagctaagaattctgttgaaaatgtccacaattctggtgtgactaagatcatggaacacaatgcctcctactccacacatccacgtgtggctctaaggctccccctttat

SEQ ID NO: 136421 - DNA, 254 bp, Homo sapiens
agctggacttctggacacctatcctcttgctgagaggaaagttccacctctcttgcaaaacagaaagaaaaggctcagccctcctttctgatccctgagctattgtgaagtaaaatgtaaactgcttttaagtcatccaaagacagcatgcggaaggtaaagcttttagaaatcaataagatgcatatgatatgaatataacttgcagtaatagatactatttttaactgacaactgtgtgccaggtcactatg

SEQ ID NO: 136422 - DNA, 266 bp, Homo sapiens
ccaatagtagacggatgattgaaccaattatgctatgtcgttataacaggttatacatattttaaatcattactttagttgtacaatataaacttttccatatgtcaccagatgttatagtaaaacattaaggaaaaatagttaatactaatgaagggaaatcttaatctaatatttaatactttatcacttaataggattttgaggaacacctttcttatttctttgttcctttttatttagaatcacagagattttgtgtaacc

SEQ ID NO: 136423 - DNA, 182 bp, Homo sapiens
taggctagattgctgagcccacccccagcaaagcatctagagagaacacatgacggaccggccccaagttcaggagtgacaccacagcaaccccagagcagcaaatctcaccatcagccactggagagagaacacatggtctgtgctcggtgctcaagaaggatctcctactcgctgccatg

SEQ ID NO: 136424 - DNA, 415 bp, Homo sapiens
aaggaggggaggatacaagaggaatgataaatggcaaggaaaaccactcactcttaatgctttttgtcatactcatgtcctcttgtcccgtcaaacataccttttctgcaatgaattcaactcatgttatgtgacattgtcattttacaagggaagactagccagagaatttctgatggatgccaaagacatggagtggtactttacattttgtaggtgattgataggtttagtgtcttgtatctagaaagtggacacatagagtagagcagcttattcgagactcttctccctccgtccatagccaaggaaattataggaagcattctagtttgttgaatggttcataaatatgtgacagttttttttgttggttggttggcttttgttgtttgatactaatggaccaagaaga

SEQ ID NO: 136425 - DNA, 431 bp, Homo sapiens
ggaacgcatcacccacatgtattcccaggtgcttttctgggtttcacatcatcacacataagaatccttttcctgtaagatccatcttcgcatgtctccctaacatggccttgccccaagctcagtaaccatgaccaccccacagaggcagaaaaatctggtctgcctcctatgtcctatctgtccctggttagccactcattctacatggaaatggcatatctcaaaccagctggaaacactcaaaagccgccaccatatcacacacataataatgtattaatagtaaccatcatcttccaactactcacaccaagtgagtatttatggtgtggatagtcaccttggggtgctaaaggaagaaacggacttctttgcagcccagtttccaattctttttttttttttttgagacagagtctcactatgtc

SEQ ID NO: 136426 - DNA, 199 bp, Homo sapiens
catgccactgtattctagcctaggcaaagagtgagaccctgtctcaaaaataaaataaaaataagacttgaataaaaggacaggaagacacaacatgataaaatgtcaaaacttccttacatttcatggatttccattaaaattttaataaaaatgtttgaactttctagcattgttaggagaaaataaacaccaaaaa

SEQ ID NO: 136427 - DNA, 330 bp, Homo sapiens
tcaggctcttctgcggtgatgttcccccagcagggcctgtgccggcacagacgcgtcctccggccctccccacgttggcagcacgttgactgtgtctgaagcttaatcccgatgtcacagattcttgtctttgcacctaacgttacgtgtctcatccagcccagggcacccgatcacgtcgctcactaaccgatccttcctcctcccgagtgttcctctagcagtctgctgtgggccttgctgtgaaaccttctgggcacctccacgagtgggagaacactgctgtgtcttcgtgcgtggacggtagccaggctgcacgcagagctccag

SEQ ID NO: 136428 - DNA, 201 bp, Homo sapiens
catactattctgggtgcttgggatgtaccagtgaataaagcaaaggccctgtccttaaggagtttacctttcagtgcatactgggcaaactagcatactatatatagtaaatacatatagtatgttgagtgtttattaatgcatggagaaaaataaagagggttagggcatgtggagagagaggacagagtaaggatgttg

SEQ ID NO: 136429 - DNA, 748 bp, Homo sapiens
atgttgagggaagcagatgtggtaactgccctcagggagattctcttctactggagagaccagtagaagggaatcaaataagcaagtaactcaaactaaaatacacttacataaacacattgggaaaagggtgttaaggaataaacggtgctgtgatagataaaaatgttactgggagacagtcctaggctgggaaaccatgaagagggaattggaagaataaggaaccagacacgcaaagagagctgcggcactgaaggtagctccgaggtgggcatgatccagaaactggtagcaggacagtgaggctggaggagtggacaccactggagaaggggaaggagggaaaggagatgccataggcgaggttggcaggggccctgtcatgccgcctttcataagccggggcaagtgctttggagtttgcacaaaagtaatgggaagcccttgataggctttaagcagagggtgacttaatctctgtgatttatgctttgaaaagttcattctaacagctgcagaaaaaatggtttagaggcacctaaagaggatgtggagaaactgttagacaactgctcacaggccagggccccgaacagtggcagtggcagtaggggtagaaagaagtggacgggattcagaactcactcatgtttaactcgacaatctgaaacgtggagaaatgacagttggagaacacgcctttcagtttatattccctactgtgcttcctccctttctctaatgc

SEQ ID NO: 136430 - DNA, 523 bp, Homo sapiens
cagggttgccacagtatgtaaaatgcaatatctgcacagcacaataaagccaagtgcagtaaaatggatatgcctgtacttctgtattctaaataaaatgcttatgctgtgatttttagaaaaatatgcaaactgcagacatttgctcttaattcctgttaaaatagatgaggatttactctgcttatagtcccctcccttcctttctctctccttccttccttcctccttccttctctccctccttccttgttacgttactacagtatataacaatatttattttttaaaatttagttttttaatcagattgtttatgtagatagtttaaaactgaaataattctataaatcttattatgaaaatctgcagttgcttctgtagccactcacccccaccactcccaaccattgcctgcatcctagagacaagcatttcacactgcaggctgtttcttttgatatttaaatcatatcactagataacaaatttttggatctacttcttgattttctgttttgtg

SEQ ID NO: 136431 - DNA, 906 bp, Homo sapiens
ctaaatctgcagatgacaaggtgaggtggagagaggatggctgacagactggggcggcctcctgatggccacgtgtgtggtgactgacttttgttaccgagacctaggggagggacgtggtggtcacggcaccaactttgagatgcctaagatctagttagtagtactagaatgcatgggattgggaactttaaatgagttgtaaaaaataagtgttattagagttccaaaaagaaagaaacgagttgggccgctgagatatttagaggaacataatatcaccacgttcaactgataaattaaattttaagaaagattgatatttgccaaaagatatgaagttagagtaaaagaggctcggtggcttgaccagggtgtggttttcactctttcattcactgacaagtagtgttggggggcccggccgcgccgaagcctgcttgagtcaccgagccagggcgctgcggctccccactgctggcggagtcttattgttgtgtctctcgctttgcctttcacagttctggcatggcagggcttaatgaatgtcaggctcagagggaagagaatggaacctgcgagcactttctgccactcacagagcggggtcacctcgccctgctcccccagctgcctacaggcctgccgtgcccttcccatctccgcagcctcagcctggcttcccttgaggaccaccaccgcccttagcccatctcccacacccatcttgctgagagtgcaggtgagcccggcccacccgaagccacgttgcctcccatcacccttcagtgctctggggccacaggggaaagcctgtgaccggcgtctgcctctgcctgccttggtctcttcatcgtcatatgccctggactccaattgcttagggtgtcccagacacactgtgct

SEQ ID NO: 136432 - DNA, 265 bp, Homo sapiens
cctcctttagagtctggggttggacatgtgacttcctttggccaccagaatgttgccaagaaaagcacaactctgaagtaagtcacctaaggccacgcagctaggagataaatgaatcaacattgaaacccaattttgttgcttagtatcccacattctcaaactatattatctgtccttattgtgaataaaaagtgttcttattaacactacattcttggctcagtgctaagctctgtggcccattgtccagcacttgaccagg

SEQ ID NO: 136433 - DNA, 367 bp, Homo sapiens
aataggtcttcagacaaatttgatccctctaaggcagtttgaccaaaccaccaagccaagaaacagtccctctcccttgctctcaggcagggacataataagggctaaggaagtgacctcctttcaggaagtaggtggacatatgacctaaaattcaacccttctcttcttggaaggaacttatcatctaaaggagaaaagctttaaaatgtgctcccttttcagtgcagaaggaaagaaggagtgggagaaagaatttactgtcctgcagtagtatttagaatatagaggaaaaatattttctaaaaatggacaacctgagtgaagagtttgtagctttaaagatacctttccctggaagttttag

SEQ ID NO: 136434 - DNA, 438 bp, Homo sapiens
ttttcttggagcctctcctaggagtcgtgttttgtgaaaaacacttaggcagtgcttctctgctttttgctactgctgtcctaggtgattgctagtgaaaggatttctataggataaattatatttacctgagtatcaatttggtattaaaactgaataggaaattgtttttgcaaactttgacttagacatacagatctattttgaggtattgtgactttctaagcagtttcctctttagggtctttttaaaaaacttagagaaattcttttcagtgggactgctgaatcaatgtttatatgtattttgaattttgataggctattagctatacattttaatgcgtaggaaagtagtcaataagaaaagtaattggttataaaaaaatttgtttcattagtattcttctgttctctatattgagacatgtaacatga

SEQ ID NO: 136435 - DNA, 1834 bp, Homo sapiens
caacatatggcagcaaggaaatgcaaagcaaacatctacaaatatttgaatccacctgtccctcacctaccaacttccccctctactactcataaagtggtaggactcctaatgccccgcttccttccacctgagaaccaaccagcaccctgatatttcaaagccagacctaaagaaccatggttgccaataacctcaatgccaaaccaaacaatcctaatcacatttttacttttcaaatccagtctcagagcagagctgtagattaagggacaaaaagtcattgtggaatcttttcaaatagctcttgtaaaagcatcagttgggaaagagtttatgagttcctctttgtcctctcctctggagaaaagacagaacatgcaagaacactagatacaccaagctatgggtgttgaaatagactagctggtgacctggatttgcaaataccctagggacatgaaaacattttttctttttctttttcttttttgtaacctccacccagaatttcaggaaaggtggggccacatgcccaggatatatggtattctactgcttgctttcttatcaccagaatactagtcaatctgatttcttagttccatgtcttttcttccaaggaggtagggcatggggttgggggacactttccgccttccttgcatctcactgtccactcttaaatttttattaagaaacctctgaaagattcaaaattcagttcagtttcaataatcccaaagaagttgggataatttgttttcacttgcttcaaacttgccacggctgcaggaggagtctcaggacctcagaggaatggggcagatgtgtgaagtctgggagtctgcctcccacccagatgccaggagctgcatactcagctctgcctcacttccctgatggtctgctttcatccaggttaccatgacagagagggtctatcctctaaagaaagctgagttacaggctggcccctggggttgttcctgtagcctctctttgaccacattcctgaagatgtttagctgaatgcctcctcaaacctttgcttcttccataacccaatcctacacatatgtgataaagctttcttcaacaatactgggtcatttggacactaccagtccagatgagaactcacagaccaaatgaaaactttcaaaagcaagcagggaaagtaactcctatatgctttaagatgatgtattggtgtagattcaggtccaatttgaaaaaatgtctctggttctttctaattgtatccactctggatttgtttatgccagttctacattcatcaagccttgagaaacaggtggaaagaagaaaaatataaaattaagaagaagctgatggatcattggagattcaaaacaagccttctaccggtggcaccacactgaaaggcagagacaaggcaggagcggccatgggagaggaagcagcattggcttctcacgttctggcctccagcctcccaccagagcttctgccattcacccacttaacttgaggagaaactaaggcaccaaggcctgtcactgcaccgaaaaccagaagcagaaggactttctttctttgctcaaccagttctgcctggatctgacttttgcgtcaccagtagtcacaagcctgatttgtcatctccagcattctgtttatttttttaaggtcaatctttgcctgaaacatgacttcattgcacctgcagcacttcattgtccaaatgtccttggcaaacctcacagtctttggacagtgttgcattttctccaaaggggaaatcctctctccttcctcaagcttaataaggctcttgcagtgcatccaa

SEQ ID NO: 136436 - DNA, 1812 bp, Homo sapiens
caacatatggcagcaaggaaatgcaaagcaaacatctacaaatatttgaatccacctgtccctcacctaccaacttccccctctactactcataaagtggtaggactcctaatgccccgcttccttccacctgagaaccaaccagcaccctgatatttcaaagccagacctaaagaaccatggttgccaataacctcaatgccaaaccaaacaatcctaatcacatttttacttttcaaatccagtctcagagcagagctgtagattaagggacaaaaagtcattgtggaatcttttcaattgggaaagagtttatgagttcctctttgtcctctcctctggagaaaagacagaacatgcaagaacactagatacaccaagctatgggtgttgaaatagactagctggtgacctggatttgcaaataccctagggacatgaaaacattttttctttttctttttcttttttgtaacctccacccagaatttcaggaaaggtggggccacatgcccaggatatatggtattctactgcttgctttcttatcaccagaatactagtcaatctgatttcttagttccatgtcttttcttccaaggaggtagggcatggggttgggggacactttccgccttccttgcatctcactgtccactcttaaatttttattaagaaacctctgaaagattcaaaattcagttcagtttcaataatcccaaagaagttgggataatttgttttcacttgcttcaaacttgccacggctgcaggaggagtctcaggacctcagaggaatggggcagatgtgtgaagtctgggagtctgcctcccacccagatgccaggagctgcatactcagctctgcctcacttccctgatggtctgctttcatccaggttaccatgacagagagggtctatcctctaaagaaagctgagttacaggctggcccctggggttgttcctgtagcctctctttgaccacattcctgaagatgtttagctgaatgcctcctcaaacctttgcttcttccataacccaatcctacacatatgtgataaagctttcttcaacaatactgggtcatttggacactaccagtccagatgagaactcacagaccaaatgaaaactttcaaaagcaagcagggaaagtaactcctatatgctttaagatgatgtattggtgtagattcaggtccaatttgaaaaaatgtctctggttctttctaattgtatccactctggatttgtttatgccagttctacattcatcaagccttgagaaacaggtggaaagaagaaaaatataaaattaagaagaagctgatggatcattggagattcaaaacaagccttctaccggtggcaccacactgaaaggcagagacaaggcaggagcggccatgggagaggaagcagcattggcttctcacgttctggcctccagcctcccaccagagcttctgccattcacccacttaacttgaggagaaactaaggcaccaaggcctgtcactgcaccgaaaaccagaagcagaaggactttctttctttgctcaaccagttctgcctggatctgacttttgcgtcaccagtagtcacaagcctgatttgtcatctccagcattctgtttatttttttaaggtcaatctttgcctgaaacatgacttcattgcacctgcagcacttcattgtccaaatgtccttggcaaacctcacagtctttggacagtgttgcattttctccaaaggggaaatcctctctccttcctcaagcttaataaggctcttgcagtgcatccaa

SEQ ID NO: 136437 - DNA, 754 bp, Homo sapiens
cagaaaagatcatgccgagtgagaggctgaactctttttgtccataaaaacagagaccaggtacctgggtggtgccagcacgcccacttcatcaaggaagttgaaatggaaaaagattatgtgttgtcaattcaggtgaaagtcaagaaacatcagtggaaacaaaaatcttccttttattgaaaccattctacactatggaacatttttataaatagtaccagcggcattgcatagctttattttgaagcaagaaagagacttcaaagatcagcttattcaaccctctataaaaggatttatagattccttttatttaatagggtgattttctcatgagttttcaccatgtttaaaagacactgtgccccactctcatcccaaggtctatggtcaacttgactcaatgctcataactttcctcgctgattcctgcttatcctgctcctccaagcacaactgcatttcccaaaggtagatccagtaagcaatactctcaaagcacccaccctatgcacaccagtttccctcaagggactcaaaaggaatcgaggtagacccttctcagaggctgtttaactacagacacatcaggatatgtactaatacccaaaaccaaaaccaccagcaatgactgcaatagattcactgtctagacccaaggtccaggcagtttcccttttttgcatttccccaacatataaagataatttccaacatatcagatgcacattcaccagggttatttctggaa

SEQ ID NO: 136438 - DNA, 122 bp, Homo sapiens
tacaaacaagtctcaggatgatcaaactgacctgcaagtaacttaactgcctgcccaaacttaaataagacaacaaaatccagttaaagctcatgatgtctaaaattcaataggaaattact

SEQ ID NO: 136439 - DNA, 723 bp, Homo sapiens
ccgcctccagggttcaagcaattctcgtgcctcagcctcatgagtagctgggattacgggcacccgccaccatgcctggttgattttttgtatttcagtagagatggggtttcaccatgttgcccagggtggtgttgaactcctgatctcaggctatccacctgtcttggcctcccaaaatgctaggattacaagcatgagcccccgcgcctggccagaacaaggaatattatcaggactaaaaaaagagattctgtaataattaaaaggtcatttcatccagaagacagaatgatcctaaatgtgtatgtgcctggtaacagtttcaaaatacgcaaagccaaagctgacacacaggtagagatttcattttcctttctcagtggtttacagaaaaatgataggtaagaatgtagatttggccaacatgattaatcaactttgcctaatttaaatttgtagacacttcacccaataatagcaggatacatattcctttcaagtgtgcatgatgcatttacaaaaatagactataacctggaccataaatatttatttattgtctcaatacacattagatgattgtaattaatattatcactaaccaaacataattaaattatgtatcactaacacagtggcctgaagctcttcaaatatttgaaataaaaaacatactatttttttaaattcatgagtcaaagaagaaatcagaaaagattg

SEQ ID NO: 136440 - DNA, 345 bp, Homo sapiens
tatcattgggtctaaattattaaagtgatataaactaccagttattggaattaaacaccctcccctttctctaaaactgttagcttcaatgagtacccacgtctcagaagctatgaccataactacactgaaaccataaattagtgagattggaattcccccacaaaggagggggaagattcaataccttttctcatagctgtagcaggcaatactctcttggtttctcagaaccactaagtacggcagtctcctctgcccaatgtaaagtcagctgccaggctatctgtaaccaaaccgtagaacctagtttccctttctgaaaaggtaaataatccttctggc

SEQ ID NO: 136441 - DNA, 731 bp, Homo sapiens
ttgaatttatttttattttaattaacaactttttattgaaatacaactcacataccataaaattttttttttttgagacacagtcttgctttgtcacccaggctacagtgcagtggcacaatctcggctcactgtaacctccccttcttaagttcaagcaattctcctaccttagcctcccaagtagccgggactacaggtgggcaccaccacgcctggctaacatttgtatttttagtagagaggaggtttcaccgtgttggcagggctggtctcaaactcctgacctcaagttagctgcccgccttggcctccctaagtgctgggactacaggcgtgagccaccatgtcctgccaaaattcactttttttttcttttctttcttttttttttgagacagtctcactctgtcacccagcctggagtgcagtggtgcaatctcagctcactgcaacctccacttctcgggttcaagtgattttcctgcctcagcctccccagtagctaggattacaggcatgcaccaccacgccaggattatttttatatttttagtagagacggggtttgactctgttggtcaggccggcctcaaactcctgacctccacccacctcggcctcccaaagtgctgggattacaggcgtgaaccaccatgcccagccaaaattcacttcttaaaagtacataatttacaaagttgtgcaaccatctcatcggtttttttttt

SEQ ID NO: 136442 - DNA, 1101 bp, Homo sapiens
agacacactttaccttataaaataaggcaaatggaaaaaaatcaccatagagatgatgatttttctttagaagcaaataattccaaatatgaatgtgcttacataggtaataacttttgttgtcataagctcatctacattattccaacatctaggactttaaccagtttttatgttcagctgattctaatgaatctattcctggcatagtcctttactccattataggcacagctctgaaccaattctaggattcaattcagaacagttacatatttagtgtattatgtaaaaagctttataggattgggttcaatattgacaatattcctatttctaagaatattagacattatttctgtaatttctattccttttgatattgttttaacaaggcagtactcctcttacaatattgtgataaattcagatttttataagacttgttcttttttcctcccaattttaaaattatttcttgaaaactattatttttcatagctatttgcctctagaagcaattgttcataatggaggcatattttcctttgtagaaattcacagctgtgaagagaaagtttcccagtgagttaataagttggcatttgtcagaattctctcgggtcaaagactgagttttttgttcttagtgctaatagaaccaaatcacctgcatttgagtatttaacacgttggaaagccaacccaacttaaggtcttcttttttgtaatgagtaatttgaaagtgaaagcttcttgaagcatgcagtcaaaataaaacgcatgggcgtttatttagtaaagctaaatcgtgtagctttactcagtctgttgaactggcaaatgttaactcccctttattgttatactttcttattaatcatcctattcataaaaatcccatgactggggaaaatgaacccgttagggaaactcactgctatcagtctaatccaagccactatcaataactttcttactggtatccctgcttccacctcgtctagctattatgtgtaccatgaagataactgaagccaacctgcctgggtttaaatcctagctctgcaatagctgtattgccagttccttaaaaaaaaa

SEQ ID NO: 136443 - DNA, 219 bp, Homo sapiens
acaaacaaatgatggtgaattaagcaacaagcctatctttcccaccggacacacaggggattttataatcctctaattctccaaaaaacttttgaactctgagggaagaaaagcgccatgttttataagggctatcctggttccatccataataaaaaagactgagatcattttctctctcagcatgctagattatcccgactgtaatcagaatagata

SEQ ID NO: 136444 - DNA, 166 bp, Homo sapiens
tataccataaatatatacaatgttttcaaattaaaccttaattaagctgagggaaaaatgtacacctgccacctgtcacctccaacacacacttcctattgacctgaaccttctaatttttctccatctttactcatcgccccccaagcatgccacatagtttatt

SEQ ID NO: 136445 - DNA, 303 bp, Homo sapiens
gaatcgagctcggtaccatccagaaggactaaaagacctgtgactagtgagctctaggctgtagaaatttaaaaactacaatgtgattaactcgagcctttagttttcatcccctagttttagaagtttcaatagcacctgttcttgaatgacatcagcattctccaagtcacctttgactcttccctcttagtgatccccacaacagttagttgcctggacctgttgatttatatcctaaacatctgttggctctgtctctcaattcccattgctacaaacttcactactaccgtattaatt

SEQ ID NO: 136446 - DNA, 265 bp, Homo sapiens
cccctcagggtggaagattaagatgaagacgtgatatagcatgattcaacctgtgcccagactgacctccctacatgtcacttctgccatgtcccctccttgctccagagctggcagggactccccagggctgccaccacatgtccaggcgcctctggctacccctggcagctgtcactcctccagccctgccccacactcctgccagcctctgcacctgcctgcatgtcctccgcccttccccggcacccaccctgagatggag

SEQ ID NO: 136447 - DNA, 205 bp, Homo sapiens
atgtaatcagtaatctggaaaataaagaaaaattaaaatgcttatcaaatctaccaccagaatgtaattagtgttaacatttgggtatattttcgtttagttttgttttttttttttaaaggcagtctcactctgttgcccaggctggagtgcagtagtgcgatctcggctcactgcaacctctgcctcccgacttcaagcgatt

SEQ ID NO: 136448 - DNA, 301 bp, Homo sapiens
tcatcgagctcgccccctgttttgctcaggtctgtaggtcaactgtggctgcactaggctagctgggctcaactgtacttggcccagctgtactgtgagttaggttccagtctactccaggtgtctctcattccaggacccaagctgaagaagcagcatatccctagggcatgctcttctcagatggatggcacacgcaatagaaaccaagcacacaccatacaattactacaacgcctcagctaagattactgcttacttcatgtctgttcacaccccattggccaaggcaagtcacatg

SEQ ID NO: 136449 - DNA, 396 bp, Homo sapiens
gaaatagcaaaccctcaaattgaaaaaaaatatgaggtttgatgataagaattaaaaggggcgagtatttaggttttgaaataactctcacacattggttgaaggagcctaagttggtacagccattttgaaggtattatcaattaaattaaacatacttatactgcttagcccagtaattttaatttttgatatctatcctatataccctatacaaaaatcagttgagatggattatgaacctaaatgtgaaaggttaagcaataaaacttttagaagaaaaaatagacatctttttgacctggtgacttaaataggactttaaaaagcactaactattgtcttcccatgttttcaatgtattattatgtatcacatattttattagttgtttaa

SEQ ID NO: 136450 - DNA, 368 bp, Homo sapiens
taaagtgcaaagcatttaaacactgagggcacagagggaatggccttggaacagagaagctgtgatgaaggaagaggaaaggatgtttgctgggaggggtggatttggttaaatcctgcaccagcgatctcggctcactgcaacctccccctcccgggttcaagtgattctcctgcctcagcctcctgagtagctgggattacaggcatgcaccaccatgcctggctaacttttgtatttttagtagagatgggttttcaccatgttggccaggctggtctcaaagtcctgacttcaggtgatccgcccacctcaacctcccaaagtgctaggattacaggcatgaaacactgtgcccagcctaattc

SEQ ID NO: 136451 - DNA, 639 bp, Homo sapiens
gaacctgggaggcagaggttgcagtgagccgagatcatgccactgtactccagtctgggctacagagcgagacttcttctcagaaaaaaagaaagaaagatgacaatgtcaatgcagtttttaatgttcctctagttctccattaaaacacataaagagactaaaaatggcaaataggaaaaaccagattaacacttacaaccaaactaggtcatgaagtatccctacaaaccccaaactgtgaataagtgggaacaaaccactgacaactaaaagatctgtgcactaccagcatttttgctagaggaggcagtaaaaagcgataaggcatctgatatacctggataagtccaaagtaaccaacaggttggttgaaaacttagcaagcaaatttgactacagcagctcaaactgggagaagatggcatactctaattgtagatatgtttgagtggtccatggtaagaccagaaggagctatagcagtctggactctaatatctttccaaagagctaaccagtcaaagtgcgcccccagtacagaactatatactgaggaaaactgctggaaatagaatccaaattgagcagtacagagacaatagaaacaaaggaaaaagatgtccccgataaaattgg

SEQ ID NO: 136452 - DNA, 423 bp, Homo sapiens
ctgccacgcccggctaatttttttgtatttttattagagacggggtttcaccgtgttagccaggatggtctcgatctcctgacctcgtgatccgcccggctaatttttttgtatttttagtagagacggggtttcaccgtgttagccaggatggtctcgatctcctgacctcgtgatccgcccgcctgggcctcccaaagtgctgggattacaggcgtgagccaccgtgccccgcccacttttcttaatacagatgcaattatgatggggttacatcccaataagcctgtcataagtcagaaatgcatttaaggccaggcttatgtctgtaatcctagcattttgggaggccaaggtgggagaatcacttgagcccaggagttccagaccagcctgggcaaaatggggagaccctgtctctac

SEQ ID NO: 136453 - DNA, 120 bp, Homo sapiens
cagaggttttccatgagcctcttggaaaggctactgcctggacacccaggcttttctctacatcctctggagtccagacaagaggctccaaagcctctagtctcttgctctcttcacctg

SEQ ID NO: 136454 - DNA, 507 bp, Homo sapiens
ggctttcacttgggagctggggaaaaacattggattgcatatgaaatcacattactgggatattttttgcttcttcaatcatcgtgggctgaaataaaatgcttttctggtctcaggtttgttatggtgctaggtttaaaggccctataagaaggaaaggcacttacttactctgtttcccaatagttttgtcatgaaggaaagtgaggctgttagcttccatctatctactctatctctgctgccttcaaacactatacagtctggtctgccacattcagacccctcgattttccttggtacctttacccctcagttttggggctgttcactagttcctggtcatagcaccagaaggtacccaaagacaaccaactggggggcacatctgggtatgttttcatccctttgaaattcaaattcagctggtaaaatagaagaattaaaactgtgtataattaacatgagttttcaaagatatgcatatgaattttaattattaccctc

SEQ ID NO: 136455 - DNA, 464 bp, Homo sapiens
gatgcctgttttcagcaacaggcccacaagactcagaggcttttctgcttgaaacaactaaagcgaatttttacatggatcttatgtgtgtacatgcatgtatatgtatgtgtatgtgcatgtatgtgtgtttgtgtttggatggacatgtgcatgtgtgtatacatgtatgcatgtggggggttgtgtgtctgcacgtgcgtatgcgtgcatctctatcggtttacgggttcatatgggtgtgtctgtgtgtacacatgagtgtatgggtgtatctgtgtgtgtgggtgtgttcgttcctgtggatgtgtgtatgcatgtgtctgtgtgtatgggtttatgggttcgtatgggtgtgtttgtgtgtgtgtgtgtgagggggtttgtgtgggtgtgtttgttcctgtacgtgtgtatgcgtgtgtctgtgtgtataggtttgtatgggtgtgtatgtatgggta

SEQ ID NO: 136456 - DNA, 320 bp, Homo sapiens
catctccttaagtctattgggaagtgacctgtattacccctcacacctaggagggtcactcccccttcccgtcgcagttgctctttgagattgacctgaggcacattttctctttctagaagccgctgcgtaagtgacggacccatccacggggggagattcctgctgatagttgcccctcctcccactccccagtccacggtcactgcaaaatgaacctttccactccccttgcacggggtcctcgtctacctcctcccctcccaccagtaatgcagtcattaatcctctctgatctttccttcctctcccctccccct

SEQ ID NO: 136457 - DNA, 194 bp, Homo sapiens
aagaactagaatatatataattttattatattatctcctttttacattgtttttttttcctttggatctgatttttcaaaactttagtctaataatgtatcactctgtaaagtaacattccttgtaagatttttaaagtagaaaatcttttcacatgaagatatatatgtactatatacatatatgtatatatt

SEQ ID NO: 136458 - DNA, 229 bp, Homo sapiens
  misc_feature (201)..(201): n is a, c, g, or t
ggctccccgcttgcctcagctgcagcagcgggaagctcggtggcaagcccttgtagtcctgtgcgatggcgtctcgatatgacagggcgatcactgtcttctccccagacggacacctttttcaagttgaatatgcccaggaagcggtgaagaaaggatccaccgcggtcggaattcgaggacttacttctgatgctagantagtaataaacagagcccgtttggaagt

SEQ ID NO: 136459 - DNA, 448 bp, Homo sapiens
ctgttacccttctaagggactaggagagttacctgaaagttagtttatgcaattgaccttagagtcagatgctattaccaaatgggagaaataccaagaccggaacttactgagacattacagcaacctccaccctagggtacagaataactcagatgtccaaacattttcagaataaagttcacaaaggttcattttagctttctatcccccagagaacaaagatttactcagtcatctaaaacaaaaatgtacacatctggtagagtgtgtacactttttctacaatgataggcattattagtcttaaaaagaaaaattaaaagatcttcacaaacccagtggaatattccaccaggaagcagctttgaagctggaaaatttctctagtgttcttacaacagtgcaaagcaagagactgcaatcacaaccagtgttcgggattcat

SEQ ID NO: 136460 - DNA, 161 bp, Homo sapiens
catatttgtccactgagtgttgaaaatttcatgtgaggtccttgttacaatgactatatgatggagttgtgttgggcaggggggcaggtcactggatttcactgagcttacagaattggtcttctgactctttttcgtgccagcttactaataaacatttg

SEQ ID NO: 136461 - DNA, 534 bp, Homo sapiens
atttacaaatgagttcaaggttgcaggatacaagatcaaggtaccaaatcaaccatatttctatatattagcaatgaacaattcagatgtaaaatctagaaaaacaattttacaatagcatcagaaagaataagattcttattctttgcccaaaatgtattgaataacaaaaagtgcaggccagaggccggatacagtggctcatgcctgtaatctcagcactctgggaggccaaggcaggtggatcacctgaggttgggagttcgagaccagcctggccaacatggaaaaacctgtctctactaaaaatataaaaattagcaaggtgtggtggcgcatgcctgtaatcatcccagctactctggaggctgaggcaggagaactgcttgaacctgggaggtggatgttgcggtgagccaagatcgtgccactgcactccagcctgggcaacaggaaggagggaatggagggacgggagggacaggagggacaagaggagcgctcgaacctggaaggcagaagtcatgccactgt

SEQ ID NO: 136462 - DNA, 180 bp, Homo sapiens
cctcactttcacatatgtatctctattatagtacttatcaccaatctgccttatatgtttatcacccacagagactataaattcctgggaggtaaggaacatgtcttatccatgtttgtattttctacctgtagtgataaattacttaggaaataataaatgatagttaagtaaaatgaa

SEQ ID NO: 136463 - DNA, 406 bp, Homo sapiens
atgagatcctacaatatgtgtccttttgtgactggcttcttcaattagtgtaacattttcaatgttcatccatactataacatgtattagtacttccttattattgctgaatactccattattccagcgtaatagctgacattttatccatccattcatcagctaatgaacatctgcattgtttccactttttgacaattatgaataaataatagtgttaggaacactgtgtacattttttgtgtgcacattttcatttctctgggctatatttatacacacacacacatatacaatttttggtactgttccttgtggaacagggctaccctataggcagggtgtccagagtagccttgggtatatatctaggggtacaatccctgggtcacatggtaattctatg

SEQ ID NO: 136464 - DNA, 308 bp, Homo sapiens
atgcaatgtgtctggtctccaagcagaatatttgaatagtgggaacctggtatccagtttggtccccagctgacagataccagttggaaatgaaagaatggaaaaagccattgtggcagtagtctgcatcctgcaagagcagattctgaccggcatcacttccgcagtgaaaggtaacaaaatctgacagagaaaaattcagtctccttttctacttgtaattgtcacatcagcccaagtggaagtatgttatatgagagatacagcaaagaatgcaagcaaatatcactggccacagaaaggcccct

SEQ ID NO: 136465 - DNA, 343 bp, Homo sapiens
aaccacagggagatcagaccagacatatgctagaggctggatgaaaacgctgagggaggatgagaggagagaccccaaacctgcgcagcaaggggagctggaaagagaccctgtgcgcaaagtcggcagccaagaaggtctgtttcatttgcaaacttggactcaaaacgctcatgccagggatgcaggaatgtggcctggaaggaggatgctgggaaatcggaacatgaaggcttccttgtgtggaggtgtggggttcaaatgagtattacctgtgaaacacaagaaacctcaagcctcaaagggagatattaactttaaaacttcaagcagtgcttcagca

SEQ ID NO: 136466 - DNA, 249 bp, Homo sapiens
agactgcaacattgtgagccattctgcaacatatccatcttttaaaatattttctaatgttcaatcttagctatggatttttaaatgtgtcccacattttcactgtgacttaaaaaccactttttccatttgatttaacaaaacctctaatctcatttttcttaagtagactgcctataatcaaaacatggcttttttttttgagacactctcgctctgtcgcccaggctggagcacagtggcgcgacc

SEQ ID NO: 136467 - DNA, 397 bp, Homo sapiens
acagaaacaaggcaaatgtgcactatcttcactgctgttcaacattataatggaggtattaaccaatatagttagatacatcgatttaaggcataagaatgggtaaagaagaaagactatctctgcagattatatgataacgggttgagcatccctaatctgaaaggctccaaaattcaaaactttttaagcagtcacacgatgcacaaagtaaatgcttattgaagcacttcagattttggattaagggtgactgatgaaaggtacagtagtttcttgttggaataatgaaaatgttctaaaatttattgtgatggctacacaactgtatgaatatactaaaagccactgaacaagacactgaatgaatttaaatggatgaatgtatgctatataa

SEQ ID NO: 136468 - DNA, 494 bp, Homo sapiens
tctgtccagcaattgcctgtccaatatcagaggctcatcgcccttgttattgatctttagaaccaaagacaattatttcaaaacaattatgtaatcctcatttttttcctttaaaaatgtttgtcttcctttacctctctgaatatgcacacagcttaccatgacatgcatattcccattgtaatgttctattctctaaaacaaataatatcttccttttaaagagcccctcactgttatttaggttgacagtgataatttcactcttcgattccccacaaagaaaatgtttaatcacctccactctattcaaaccactgatcctctttaaccatcacccctgcaatttgtaccatcaagcagatggccttttcctctttatgaaaaaaagacacatcacacagtgactccttcaaacttcctgatgcctgatttacatacagagcacctctggactcatctaaaaccgcccctataaactttataaaattaat

SEQ ID NO: 136469 - DNA, 407 bp, Homo sapiens
ctagtatttaatactgaatgcttatcatactttctaggaactcaattaaaaaatggacagatagacagatggagctatgaatcaaccagccctgaatgtgcagtctattgcaggttataaaggacacaaggtatgtccccaggcctgtcagttaactgctcacaatctacttggagaggatatcctcccaggaagaagacagtgtcaaagacaatatacttctatttacaggtatacaggtattgcaatataggctctatttacagcgtacaaaccatcagcataaaccatgaaacaatctgtgagctggaaccatccacaaaggattcctgcacacggtgagaattttatcatacaaaatggaaaaaccttggctccaggaaagctcttaggaatcagttagtcaa

SEQ ID NO: 136470 - DNA, 807 bp, Homo sapiens
ggccatgttcttaacactatacacaaaattagattagtataagtgtttcaactagtgtctatcagtgtgaaattcacatcagcaggctcaagggagctggcaatggggttttcatgctgacagttatatctggaggactaaataagaagaggaaaaggaaacctgaatgattatgggaaagtcaaatagttgagaagtgggaaggaaaagaaataatagagagggttagactagaaaagctaagtaacagtgccccggtggagcaggattggaggtaagagcaccctaaagactatgtcacaacttcaagaactcagcactcaatactttgtttcatcccaacccacatctctcttctaagttccagactatcaccctcattggtttgcaagaaattccatgtggttgtcccacaggcaaaataaattcaatgtatctaacgtggaacttatactacccaattcctgttatttggttctcaacttttgttaatggtgccattatagactcgggattctgattcaagtgtccattattaccaagtcatatttaactttcctcttaaatctctcccttccttatgagttttcttccctttttttgttttatgtctttattcttgtattaaatagctactgtcaggtactaattctgctcagttctggggatataaagagaagtaagagaataaccttgttctcagagagttcgtatctagaaggagagtgtggtaggcagaagtctaagatggctcccaagattcccaatcccacatgatttcatttcctctccttgagtgtggttggg

SEQ ID NO: 136471 - DNA, 452 bp, Homo sapiens
tgaacagggattccagaaatcaaaaagcaaagatcttcaaagattatgttaaaagaggtgaaagtaaataactgccaaactagaactgtgtacctcacaaaagcatccttcaaaaatacagaatataggacatcagaaatatgagtgactagagatcctcggctctcattttcctcacacaagaaaggaccaagacgatgaataaacagttaagatttgactggagtgctgaagggagggtgctggagtacagtgggaaagtggaaattcacctgtggtgatcagaagccaggaagacaatgtggaggcacccagatcctacaatcctgcctctcccatccagatcaaatctacccagagtcaagagagacttcctgttgcagagaatagttaatcagaagaccctcaccagcccccattgtcactgtaaacacttacggttcctatagtgc

SEQ ID NO: 136472 - DNA, 696 bp, Homo sapiens
gtgcaggagcctggtgagttcaaaatgtagaaagaatgatcaccaaattgttagcattacttatccttggtggaattggtgatgttttcttctttgcacttaaaaaatttttggaatattttacaatgatcagcatgatttatataacaactaacctattctggtttaaatataaaataattatgctcattgtataaattcaagctacacagaatttttgaagtagcagatgaaaattttctctcctttactacagcttcagtgttctgtgtatgttccttcacacttttaagtggttttatatacatataactgcatatgtaattagttttgcttgtgtgctcatgcgtgtgtgtgtgtgtgtgtgtgtgtgtgtgtgattatgtgatcacgttacacgttttaggagatgtcattcacatggtgcctgaatggtgagtcttaatatcctcatgttataggaaaggatatttagagaggtctgataaccaggtgaacattaaagagaactacctaatttatttaccaaagttcatgttcttccaaccataacaagttgtttctcaatgataggaaacttggaacgcttaaaaccagatttataattagaaatactaaaagaaatcagcaacattgataaatggtaaaatgctgatggaaagaaaactttaaaaaatgagaaggttgcatgttaac

SEQ ID NO: 136473 - DNA, 265 bp, Homo sapiens
ggtggatttgagctagggaaggggtgaacctggaggcagtggcaggaatgaacttcacacgagcagcttggggcctggaagaaggcactcaggctgctggaggagtgtcctggttaaaagaccctttgaggggcccctgtccacgggtccctgtccacgtggcctgggctctcctggctatatttctcagaataatgcacatgtcttcttctctcgccctcttcccagagcctcccagcacaatgcacccccgcctggggccccg

SEQ ID NO: 136474 - DNA, 365 bp, Homo sapiens
catcttactctgccagatggtaaaacttaagatgacagcatctaggttctaggggcttattagtgccagtgcattggtgaacataagtcctcagttgtcatccattcaccctggcatctgccaaggcatccatcagtctgtctctggccttatatccatggcttgctgagtaattatctcccacttcagtccaagaggacccagctcaaatgaccactttagagcccctctctaaacacaaaaaaattattactccacctcagaaccatagagggctgtgaccacacctattaggaggtcacaggctgctttttaagaattttttccaatatttttggtttttgatatgttttgatattgttggg

SEQ ID NO: 136475 - DNA, 169 bp, Homo sapiens
taagccgtcaaggcattaatattttagggctccaaagttgatttgagggaattttaatcttattttctttgttttccaatgtgactaccctaaacctctcttttcatgttggaaaataaaaaatgacagatatgactaaaactgacaataaaaacatacacaattatac

SEQ ID NO: 136476 - DNA, 482 bp, Homo sapiens
tgattagcagggattatctgcaaggattacctctgtgaattctcccattattcgctggagtaaatattatgagcattttatggttaagcaacacagctggtaaatgatgaagtcagaattcaaactcagttattctgactccacagtctccaattacttataataatctcttctcctatcaggctttaacaaaaagcccacatatttatattctctcaatgactccctagaatggaaagttagtggaagcttttatatacaataaagaaagaataaaggcaagattaatatgtattatcatggtaggtagagtggagaaaagtatattatgtcttttttttttcttccctctcctactcccactgtattttccaggtttcaccacattctagaaaacatttattcagttgaataacccatcacctttgaagacatttaacttgctccaatagaccccaagctagagtctaccctgtggaaaa

SEQ ID NO: 136477 - DNA, 192 bp, Homo sapiens
ccggtctgcagtgcaggaagaggtgtggacagggctgcggaggaagccccggactccaaggagagaagacagcctgtgaggacccccttgcaccctgggccacgtcagggcacctcggggctccactgtgagcttctgtggctctcacctgccagcatccctgccctgtcctggcagctgcaccatgggccc

SEQ ID NO: 136478 - DNA, 409 bp, Homo sapiens
cagcgtcagcgtcagggttcaggtttgcagggctctgcagcagttactgacatcctttgctggtcgtatcttctcctccacttggagcctatgttagtttctgggtaaaatgcaccaccctttctcctggtaaaacagtaacatagaacgtaataggaaatgcctcctgcagcttggggaaatttagagaagaccgtttctgtaatattcaccccaattagaggatgtactgcccttggcatctgcagttcattttgcagttttgtgctgctcgccccactgctgaaaatggaaccctctcccttgtcctccccctaccttgaactcacctctcctcacactgtcttgtagcactcactcttcctcacacccaccctatgtcctctcatctggctctctagagaggccc

SEQ ID NO: 136479 - DNA, 418 bp, Homo sapiens
aaacaagagcaggacaaccatgagaacaaaaaaaaaagccacgtacttggcaccctgcctggccacggaaacactcgtgtgtgacccagggtcccctagccttggcgctgctaacactgtggtcattctctgtggtggggctgtcctgtgtgtcaggcaatgtttagcagtgtccctggcctctagaccctgtagcacccccagcttctgtgaccaaaaatacttccagacattgccaactgtccctggagggcagggtcaccaggtaaaatgcgggccttccatcgcatttgaatctcaggttaacaaatagtttttttagtagaggcatgtcccatgcaatgcttgggacatgcttctacttgacagtattccttatctgaaattcatatataactgggcatcctgtttttatgtt

SEQ ID NO: 136480 - DNA, 407 bp, Homo sapiens
gggaaagaaaacctctcagagaagagtaagtagcaatggagagctctctcgggaggaaacgtgtgggctttctagggtgaaacaagaactgctaatacttactctggtcaacagatgctgacatagttctggactcaaacagggcatattttaaacatgtattttttagttcttcaatgtcataatcctgatgtaaaatgggttcttcaagcattatggccataccctgggtatggtctttgatgtatgccgtttggatgtctatgccaagtgttttggtgttttgtatcatctgcattttttaagaagaaaaaaagtacagatgtctgaggtacgtgtttcttcccatgagccctgttggagtacctcttctgacactaagtaactgtgtgaccttgggaaaatta

SEQ ID NO: 136481 - DNA, 486 bp, Homo sapiens
agtccgttcgactgagccacaaactgaaagaaataagagcctaaatcaaacagtgctaccataaggagcactatcaaaatcttagttaatgggccgggcgcagtggctcacgcctgtaatcccagcactttgggaagttggaggattgattgagcctgggaggttgaggctgcagtgagccgtgatcttgctactgcaccctagcctggccaacagagcaagaccctgtctaaaacaaacaaacaaacgaacaaactaacaaaaaacccaaagaggataagtaacttggccgaggttgctcagtaagcaagtgatgaccctgacttagaacccacctctgttaactccagagcccacgtgcaggacatcccacattgctcctgctggttcacagataacatagtacatggaaaaaagtcttagtgctctaggggtctggaggaaatggcattcaagttaaactgtggagctcagtcgaacggactg

SEQ ID NO: 136482 - DNA, 673 bp, Homo sapiens
ttaaatcaggcttaatgtttcaaggggaaaaagtggtttaatggctcttgttctcaagtgaaaactgctatgctcagttttttagaaaaacgaatgttaaattgattctagattcaatgacttctgtttgggaggagtgaaaaaacaaatcagaaattgagaaaatcattgagaagtgaataacgaagcaggctgcaaatggtaagtttttttccagttattcattttaggagacagtggtttgcagagtcactggctatagttttaggatcattaaaagacagagaaagtcctggaggattgcgaaagaaaaaaacatgtataattcatttatttttaaaaggaacaaagggagatcttaacaattaaagattagtttacacagctccaaccctgaggtggaggttgttgatcaaatcctcaaaaaaaaaaaaaaaatctatggtatagacatctagaggcacacaggatcctggagaggaacagtgtggctttatgaaactcagtatgtatcagacaattttaatttccttccatgacaggatgacaggacttgtagcttggaggcaaacagtagaggccattaatctgtcttttactcaagttttcaattctatcatacatgtgatgcccagcagccagctaggaaaataagttgagcaccatgtttctc

SEQ ID NO: 136483 - DNA, 145 bp, Homo sapiens
cttcataggtgggtacattgccacatccagaaatacagggattccattcaccaaaaaaggaggaaatgaggaaaaaaggaggcaaccaggagtccatgctacagaatcctattctgtcactcccttgctgtgtgaccttgaggag

SEQ ID NO: 136484 - DNA, 311 bp, Homo sapiens
ttgtattttagtagagatgggttttcgccatgttggtcaggctggtcttgaactcctgacctcaggtgatctgcccacctcagcctcccaaagtgctgtgattacaggtgtgagccactgctcctggcttgaaacagataattctttatattcaacctgttgtcaaaatttttagaaacattttcccagttccttgtataagtatactttgtataacttctggcaaaccataattatgaactcacattactatagtactataatactgcagtaagggatcttgcgtttcagtaatgtcactcatccagttt

SEQ ID NO: 136485 - DNA, 431 bp, Homo sapiens
cttttcatatatctctacatcaagtctcacctatcacttcaaaggggtaaaaatactcttctgctcaaactgtattcagtctctcgtgtcaatggaaaatggtgtgttacagatagaaaattctaaagaagatctcacatttcaaaattaatacctaattttactcagtaattacattttatttcaaacatatgcccttacaattagtcttgaatttgaatctaagtttcataacttctgggtaagatgaccatttagtaaactgcctaccaattttagtttacttatctgttaagcaccatagtatttatgatctatataagattgtaatgaaaactacatttttgtaaaacaccatacatagtgctcagtatgttcttccctcctgccatttcttatatttcttgattaatacctttaaataactcgag

SEQ ID NO: 136486 - DNA, 306 bp, Homo sapiens
tgctgagattacaggcgtgagccaccatgtctggcctggtgagcattttttcataagtgctcattaagggttagctactaactgctgcttagtttcattaaggtataggtgacttttactctattaggaatatgggggtcctgggtataatatctccccctgactacaactctctttttactctcccaagtatgttaggtttcattttatacgctcatggaatcttcatcaaagcttttcaaactaaaggcttaggaatagctttccctacttgtgctatcctagcagcaatctacttgaatctga

SEQ ID NO: 136487 - DNA, 300 bp, Homo sapiens
aacatgccaatcatctcactcagtggcatcccctgagaaaagtgactgaagacaaagaagtctctttcatttaacttaaaagatttctgagagttcaaatttgattattttctctttcctctgaaaatgaaaggggttggttaaactaaagggattctatggtccctccactgctctagatcagcagaaccacagccaacattatgaaaatgacacctggaaaatctaagtgtttttgaaaagtatttcaagattcacagaaaattaaacacagcaagtgaagacattcttttttttttt

SEQ ID NO: 136488 - DNA, 590 bp, Homo sapiens
gaattgcaagaacgtctcactggttcacctgcctctttgtctcctgaaggacactagggttcggagagccaatggtccaatcaagtggccaggcctgtgtcctctcttccttacccctcagtgggcacactgccctctcttccttaaccttcagtgggcacactgccttctcttccttacccctcagtgggcacacagcctctgcctcgggatgctccttctgctttggcttcctttgctttggcttctgctgattctgtcctttttctccagcttctgctgcagtggtcaggtctgttgttctgctgcagtggtttggtctgctgtcctgctgcagtggtcaggtctgctgtcctgctgcagtggtcaggtctgctgttctgtgttctgctgcagtggtttggtctgctgtcctgctgcagtggttgggtctgctgtcctgctgcagtggttgggtctgctgttctgctgcagtggtcggatctgctgttctgtgtcctgctgcagtggtcaggtctgctgttctgtgttctgctgcagtggtcgggtctgctgttctgctgcagtggtcaggtctgctgttctgctct

SEQ ID NO: 136489 - DNA, 623 bp, Homo sapiens
ctaacacagttaaaccccgtctctactaaaaatacaaaaaattagctggaagtggtggcgggcacctgtagtcccagctactcaggaggctgaggcaggagaatggcctgaacccaggaggtggagcttgcagtgagccgagattgtgccactgcactccagccggggtgacagagcaagactctatctcaagaaagaaaatgaacaaaaacgaacacttcttaatttcaaaatttaatacaatactatagcaatcaaaatagtgtagtagtaacataaagacagacatacggaccaataaaagagaacacagaatcaagacaaaaactcttgtgtgatttttgacgagactgccaagaccattgagcaggagaaaggtcagtcttctgaacaaatgggattggaaaaacgagatatttacatgcaaaaaaccaaagttggttctttatcttggatcacatacaaaattaacttgaaatagatcagagactcaaacgtaagagttaaaactataaaattgtgagaacaagagaaaatgctgtgacatggtattcggccatgatttcttaaacttcaaaagaatgtgtcaacaaagtaagtaaataaactggacttcacaaaaa

SEQ ID NO: 136490 - DNA, 542 bp, Homo sapiens
gtaagggttcaatgagaaactttggtaaattaagaaaaaaaattaaaaccccaaagaaatatcaacaaagaatgataaaaggaaactcacaaaaaacatgagtaacaaaccccccaaaaaacatactcggtctaatattcaagcaaatgtaaatgtaaatattgagttatgttttgtctattgaattggcaaacattttaaaatacctaggatcctagggtgcagaaaaattctgatgtgcagctggtagaagcataaactgtactttaaaaaggtatttgaaaataatgtatcaaaaggctttaaaatgtacatatgcttcaccttaacaattccaacttctaggaattgaacctaaggcaataaataaaaaacaaacaaaaaacacgataatagtatccacttaaacattgttcatgaactaattagcaaaaatggggaaccgttaaacattaactaattcgcagaatactgattagtcatttaaaagtacatatagaagaatattgatgctgacgacgggatcctctgaacgaatcaca

SEQ ID NO: 136491 - DNA, 306 bp, Homo sapiens
atataaaggatgacaaacctgcagtattatgtaataatttatttgatactacctcggtgctgcaaatacacatctttagagaagaagcataatggtatcaatctcaagacctgtggggcagggccactgatcctttgcagactgtaaaggaggtaatttagagtcccacttcagtgcatcaaaatccatctgctgccgccctcttcttgtcagatgcaacttgttctgtgctctttcactgacacattgttttgcacgtttatgtctaagaccatctggattgtctggtctacccaatatcctcac

SEQ ID NO: 136492 - DNA, 815 bp, Homo sapiens
atccaaccgtaaacctgatccaatcctgtttaaactcttgcgtgtttcccattgtccttgctggaatcccgagtcctaaaggcagggctcaggcccctcttggtctggttcctgtttgtgtttctatccttctggtccttcctctcctcccagacctcagttgcctcctccacactcttcatattctaatcgtacaaatactttgtttttggctttctgattcctcaaggtgttctgtgtgtttttccttcttcctcctcactttctctggctattttctgcccagccctttggctcttggctggtacagctctccctcagtaaccttctttcccatcctagccaaggcagggctccaggttcacacttctgtagcaccctcactttctatagcatagaccccgtgacactgtgttgaagctgattttacattatatatagccctgctggtctatagctttgagaagatttggatcctcagggcttggtcagagtatgagccatagtaaactctcaatgaatgctagttgaatgagcaaataagtgtattcagaggtactggagtgccaagctttgtatatatgcacgcactcagatatacatatggatgctcctggactctacttacacatatatgtatatgtgtatatacatgtatataaatatatatgttaaatatgtatatatggtccatgtatatgtgtgtacatatatatgtatatacatatttaaaccacattattgaggtatgattgatatgtcaaaagctgcacatatttaatgtatacaacttgatgagtttggggctatgtata

SEQ ID NO: 136493 - DNA, 263 bp, Homo sapiens
caaaaaccttcctaaaaggaactgggggacatgttgaaaaattaggtagctttagaatgataactagaagctgcctgctttacctagtctgacgttttcagaggagaggatgttggcagatggttttctcctcaaagaaacgcccactgctttacccagcctactgcaaatgaatagaaatcagggatcataacaccctagacaatcctagaaagaatggaatagcatggcatatgggaaaggaccacaaacatagtcagccg

SEQ ID NO: 136494 - DNA, 630 bp, Homo sapiens
aattataatggaatgtttgaaataaacaacacttcactttaagaagtgcatttaaaaataagggcttctgaattaggctcacccagggacgtctattgatgtgcagaagcttctaaaaagattttaatattcatattgcttcttttaaaagactcttccaaaaggcaaagaaaagcttaagtaattaatcgataagaaaaattgtatctgctaactttttgccttagttattaaaccctcctgcccccacccaccgggaaaataaaactggataaaatatttataaaaaagtaggctctttgataaagtaagctttcttttttttccacagtggctaatactaagtccaggcagaggaaatgctttctttgccctattccttaaaaggtcctgcctagaacgcagtagtttttgttaaacaacaaaagctaaatttaaaaatgccttatattaaacttaattggtcaccaaaacatacctttctggcacttaactagctatcttgaaacccttttgtaaatgcagtttacatctatgaaggtaatctccttttgtgaggatgtctgcctttgtgcacctggaagagagggagcactgggtcactagaaacttatataatggaaaaaaata

SEQ ID NO: 136495 - DNA, 458 bp, Homo sapiens
ctgctcctgaaatcagagactattgctacatcatattccatttcataattatagaaagtcactcttctaagcatcttcttttttaaagtaactagaattagaaatgtcatgtcagttttttaaaatgaatccagtttagatctcatacaactattaagaataaaagtttgccggggcggtggctcactcccataatcccagcactttgggattccgaggcaggtgaatcatgtggtcaagagatcaagaccatcctggccaacatggtgaaaccccatctctactaaaaatacaaaaattagctgggcatggtggcgggtacctctaatcccagctacccaggaggctgaggcaggagaatcgcttgaacccaggaggcagaggttgcagtgagctgagatcgtgccactgcactccagcctgggtgacagagcaagactccatctcaaaaagaaaaa

SEQ ID NO: 136496 - DNA, 430 bp, Homo sapiens
gagagacacagacaagtaaaatgagctaaaaatataaaagaacaaaatgtcacagaggcaaccaacattaaacgtgaaagattaattaggttaacatggcatttttacctgggtcttaaaagatgtgggagttcaaatgtgctaagagaaaccatcctgtagacaatggaggctctcagattgttttattaacataattttgatttgattatgaagcacaaattagagtctggcagaaaatttaccacaacattctagagagcagggcctgacataaggcagaaggtgaagagaaggaggcaaatatgagggagttgtctaagctagaatcatgggtctcaaggacactgatttcagatgagagaggacagctggaaggtgaagaggggaagctagaaagttcctagcttgataattaaatagatgataa

SEQ ID NO: 136497 - DNA, 727 bp, Homo sapiens
gtttttgtttttctttaaaggaataatgctaaacccagttggttttcttttttttcccttccttccttccttccttccttccttccttccttccttccttccttctttccttccttccttcgagacaggatctcattctgtagcccaggatgaagagcagtggcataatcatagcccacttcagctttgacctctcagtctcaagtgatagtccccccacagcctcctgagtagctgggaccacaggcatgcaccaccatacccagtaaaagttacattaagtgtgtctggctctcctgcctccccctccacatcctccacctcttccgcctctgccacccctgagacagcaagaccaacccctcttcctgctcagcctactcaacttgaagaggacacggatgaagacctttatgataatccacttccacttaatgaaagttaatatattttctcttccttgtgattttcttattaaaattttcttttctctagcttactttactgtaagaatacagtatataatacatctaacacaaaatatgtgttaatcagctgtttatgttatcagtaaggcttccagtcaacagtaggctattagtaaagtgtttggggagtcgaaagttacactcagatttttgactgcaagggtgtcagcacctctgacccttgtgttgttcaagagtcaacttttttttttaatcagcctactttcctatctggattt

SEQ ID NO: 136498 - DNA, 305 bp, Homo sapiens
tacagggttgaccgtgtcttagcaggacaggaaccagggtcttagcaagtcctggtaacctacttctgccctgtgaccctcatgctctatccctgcacttcagggctatccccaacagagtgcctaggagactcctagagagcgcaagatacattttaataagggtaagagcatgtggcacaaacactgcttcataattgtcaattgctttttttaattgatgtacttttttttagagcagttttaaggttcacagcaaaactaggcagaagccacggtcaacccacaagccacggtcaacccac

SEQ ID NO: 136499 - DNA, 412 bp, Homo sapiens
aattcttgatccagaagtgacggtggtacccattctagcatgtaatgatgagaagtagctgcagtggtttcctcattggactagttctgcagtgtaactttgtgctttattctggaagtttagccttaagcctatttttccaaccttcaccaaattttgtgagcccccaatattctttcagtacattgattttcactagactcagattttaaattgattttcaccagactcagagtctgatgcttacatctaagaatcctttgagtcagaggtcatcagactacagcctgtggggcaaatctggccccattgcctgtttttgtaaataaagttttgttgaaacatagctacacacattcatttacatattgtcagtggctgcttttgtgctacaaaggcagagttgagttat

SEQ ID NO: 136500 - DNA, 168 bp, Homo sapiens
caggtggcatccttgcagatgaagtgggttggaagcagccaatgaatctgaggtttggaaaaatgagtctgaaactccattttttcttggttttactgtaatatttccattacccaagactttcaggaaaaactggctacaagaaaaagagctatacaaataaaaaaa

SEQ ID NO: 136501 - DNA, 136 bp, Homo sapiens
caaaactgggcacaggaatgaaaatggattgggaggaaattagcccgaggagagtctacaagctaagaggcaaaggaccatcccacccagcagaccctccttctcagttagcctcagggactttttcaaagccctg

SEQ ID NO: 136502 - DNA, 406 bp, Homo sapiens
ttcctttttctatgctaagcagttacaatccagtttatcttacctcagagcacctctgaactcccaccagccacatctcaagtgctcctcagcttctgtgtccaggggctttggcgcagaacaggctgctgtggcctctcagtcgtcagtgggtgaatattgggagttgttagccatttggaggtgtgggaagcatgaggaggtgatgaaagggcctaacagacagaggtggagggtcaggcctgagcctgtgtactgggctgccagtgacaccacgtgtctctcccaagtgtgagtgctggatgcaaggctgccgtcctggcaaagggatgtctcactggggcctctcgtggaaatggaggggaggtcctgggcagggctctgcagagcacaggcatccgagctc

SEQ ID NO: 136503 - DNA, 306 bp, Homo sapiens
gagaatatagtattggctaacagtcatcatagcttgatagagaataaagtctgtcagacttatctaacagggtgaaaagcctagtcaattgaggaaggaacaatggatataatgtagtttttaaatattttgcttcttactgaaaaatgcacttctcactgtcctggaaaaatatagactgggctgctggtgataaaggatggcagttataaagtggtagacaatttcaatctgagataagatataatatatgggaataagatgaactttattattttaatcagtgatccaaattattatatgttc

SEQ ID NO: 136504 - DNA, 381 bp, Homo sapiens
aagctgatgaacgatataaacaaaactcaggaaattttgggtgaattacggagaggcactcaagaggtctcaaagctgattactgacacaggagtgttcagttttaatgccatttaaactgtacatacacatcttaatcattcttttgtatgtttcacaataaaaaataccaagaaaaactggggtaagagtcttgattcagcacttattaggtgtgatctaatgtggactcaagtaaccctcctagctcacacacctttgtgggggccctatgccataacgtatatgaaagtgctttgcatacggtaaaatgttttccaagttgaggcctcctggggcaatgcctttatccttcagggctgactgttcagctttttgagg

SEQ ID NO: 136505 - DNA, 449 bp, Homo sapiens
acttacagttttctttcaattctaccctattttacccaattcttgcttggttttcatcctgattttttttttccatttctttcacgtctttctgctcctgtgtcatgaaaggcatgtctacttgctgcctatttcaggagccaaatattaaatatcttcttttagccatgacagtaatttattttcctatgtgtccttaggataatttccttattctgtatttttttttcaaaattctcacatataggatagactgacatactcagtatttccaattaacaggatatgtgattggcctcagagctctcacttatttcagtgttgatcgtggcagattctcctagccccctgtccagtgtctaggtagcattcaactggagtagttatgctagattggtgtgatatcttttattctcaatatctggttctttgatccataaatttgaatg

SEQ ID NO: 136506 - DNA, 660 bp, Homo sapiens
ccaagtctttgctattgtgaatagtgccgcaataaacatacatgtgcatgtgtctttatagcagcatgctttataatcctttgggtatatacccaataatgggatggctgagtcaaatggtatttctagttctagatccctgaggaatcgccacactgacttccacaatggttgaactagtttacagaaccaccaacaaactaccatcagagtgaagaggcaacctacaaaatgggagaaaatttttgcaatctactcatgtaatgaagggctaatatccagaatctacaatgaactcaaacaaatttacaagaaaaaacaaacaactccatcaacaagtgggcgaaggttatgaacagacacttctgaaaggaaggcatttatgcagccaaaagacacatgaaaaaatgctcatcatcactggccgtcagagagatgcaaatcaaaaccacaatgagataccatctcacaccagttagaatggcgatcattaaaaagtcaggaaacaacaggtgctggagaggatgtgaagaaataggagcacttttacataatccctattttcaatgagaagttgaggcttgtggagttgcttaacatgtccaggatcacctaatgctccaacataagtttgattaactttaatacttttaatatata

SEQ ID NO: 136507 - DNA, 881 bp, Homo sapiens
ggtgccacctgcacttggataggcccttgaggctctgtctccctggggctgggttgggtgctcccagtcaaggaattgatgaatggataccctgtgggctgcagccacttggcctgtggttgggaaccagtaaacataatggtgtcaggatccacggaccatgtgtgcctgaggcatcctgagcatagttgggagcagtgaggagaggttgggatggtgggcccactccttaaggctcactactcttcctgctagcccctctccccagaccattctccaggttggaggaaagattctgcttatcaagctgagggcactagtgaggggccgtgtctgcccagagaatggttgtagttgactaatttgcacaaaggcacctcatggggtagttgaattctggcctataccccctttcccatcctctcctccttgggaaaggagagggacagaggagcttgagaagtgttggctcagctgggtgcccccaagcctcatcctcaggctgctctaagctttgtgggaggggaagctggataggaaaggaggagagcagggtcatgtggaagataccgactaggaaccgggctaatggccaagcgtggtggctcgtgcctgtaatcccagcactttgcgaggatgaggtgggtgaatcacctgaggtcagaagtttgagacaagcctggccaacatggtgaaaccccatctctactaaaaatacaaaaaattagccacgcttggtaacgggcacctgtaatcccagctactcggaggctgaagcaggagaatgtcttgaactcgggaggcaggttcagcagttgcagtgagctgaaatcacgccactgcactgcagtctgggcgacagagtgagactccatctccga

SEQ ID NO: 136508 - DNA, 168 bp, Homo sapiens
taattttaatattattgtgggttgttggtttattacttgggtgtcacaaaagtagaagattttactggcattttccatgtcagtagagtaatttttgcagggtcagattatttttgattaattgatttccatattggttaggataatttgtggagtggctaattagaa

SEQ ID NO: 136509 - DNA, 428 bp, Homo sapiens
caccacatccagcttatttttgtattagtagagacagagtttcgccatgttggccaggctggtcttgaactccggacctcatgatcctcccggcctccgtctcccgaatagcggtcttactcattttctacgtgtgtgttgagtgcaccatttgagagtaagtcacagtgttagtccattttgtgttgctctaaagaaatagctgagactaggtaatttataaagagaagaggtttaattggctcatggttctgcaggctttataggaagtgtggtgccagtatctggttggtttcttgtgaggcctcagggagcttttactcatggcagaaagtgaagtgggagtaggcatgtcacatggggagagagaagaggaggacccaggctccgttaaataaccagcattcctagctctcaagtgagctgac

SEQ ID NO: 136510 - DNA, 770 bp, Homo sapiens
catcctggctaacacggtgaaaccccatctctactaaaaatacaaaaaaattagctgggtgtggtggcgggcacctgtagtaccagctactcgggaggctgaggcagtagaatggcgtgaacccaggaggcggagcttgcagtgagccgagatcatgccactgcactccagcctgggtgacagagagagactctgtctcaaaaataaataaataagtaagtaagtaagtaaataaagagctgccatttaaaaagtttctactctatgctgcattctttacctctatccccaggaatccccaccttaatccttctgactccatcttgaatgctcatcttcagagttgtgctgactctgagtaacagcacctctctgtgtgctggtgggaggtgaacttggctccgttatttaggctccttcccttgatttttgcatgagctaaataacttttaagaattagctgggcacagtggttcacgcctgtaataccagcactttggtaggctgaggcgggagcatcacctgaggtgaggagtttgagaccagcctggccaacatggtgaaatctcgtctctactaaaaatacaaaaaattagctgggtgtggtggctggcgcctgtaatcccagctactcaggaggctgaagcaggagaattgcttgaacccgggaggtggaggttgcagtgagccaagatcacaccattttactccagcctgggggacaagagcaagacttcatctcaaaaataaataagtaatgataataataa

SEQ ID NO: 136511 - DNA, 347 bp, Homo sapiens
tacatggaaccgtcgtaagtcaggaccatctgtaattagtaattttttctctatacctaaatctacatattttcatctggttctaaaacttcatgtaaacaactgcaaacatataggtcaagacattatgattgagaccaaaaaggttttttctctttacttatttaatgttaacatggaggatcatgtgagtgcctattttccctgtagtaattatagctgattttaaataacactacataggagctttgcagtaatactggtactactgcattgtaattcatattagtttaccagcaaggattaaaaatgatttagtgattaaactttccttacaatgttctcct

SEQ ID NO: 136512 - DNA, 394 bp, Homo sapiens
aatcagacccagtggttaatggagaaagacggtctgcatgattaaagattattggcttcctaatgatccagtggtaaacaagaatatccctaagactgtgatagtaagcaagagtaatgattgtccacttgcagcaatatttagaagattttatatctggtctttctgttttctgctggtagttacagcctagtcatcctgtcttcaaggtaggaaaaataattggtttaatttctcatcacatcgaaaggtctgatgataatatgatatataggatattcggatagaaactacaatagccatgctaatctttacagtttctctgctagtattgatgttttgagatttaaagtggaatatttcacttctgtgtcttctgaaatcttgaatttgt

SEQ ID NO: 136513 - DNA, 211 bp, Homo sapiens
gcaaattaggaagtaattagctgaaagagaatgcaagggagtagaaaaaataaagtaggaaataatcatctagaaggaaaaagtccatcaactgagagagagataacggagaggggagaaggtatgaagtaatcatctaggtgagagggagagtgaatggacctgagagacagagagagagagaggctcactcaagttgtatagtgatcaa

SEQ ID NO: 136514 - DNA, 721 bp, Homo sapiens
ccaaggcaggcagatcacctgaggtcaggagttcgagaccagcctcaccaccatggagaaaacctgtctctactaaaaatacaaaattagccgggcgtggtggcacctgcctttaatcccagctacttgagaggctgaggcaggagaatcgcttgcacctgggaggcagaggttgcggtgagcctagatcatgccactgcactctagcctgggcaacaagagcaagactccatctcaaagaaaaggaaaggaaaaaaaccacccacaatcctactagcttgagaaaaccacaattattgttgttttgattccttttttccattcagatatttttacagaggtataatcataatgtacctacagtattgtatcctgcttttttttactccatgtcatatattgatagttctcaaaagcattttttatggctatgtgatattccattaaatagatatactatatttactttacttagccctagttattggctgcttaggttgtttactttttttgtcattataaattcattcaacaaatattgagtagtcatatattaccattagataccagagccactgaggatacagctcccagataatatttattagtgccacacatttttatgaaggtaggttttttccccatgttttaggctccttccttatgatcaagtctgaattgatgagtgactgagtcaaagaagtcatgaaaaataaattct

SEQ ID NO: 136515 - DNA, 375 bp, Homo sapiens
tattcccaaggcatagatgatccactccatgctttaaaaacttaagtgcagaaagattaagtgactgacttatttaaagtcagacaataaatcggagcatgagtcacgatataggagataagagcacatgaaactcttatttgcaaaaggacttaatcattatttttaaaagcctcctccttaattcggaagaataatactgtccttccacccacagtacatggtgggggtggattccaaagctgaaaaccagccaacagggagtgcagcggtgcaggctgggactcggggtcccagggctgagtcgcctcgccagtttccctcctgcagcgtccggaggtgctgctctgggtaccttctcaagtcccttcgacc

SEQ ID NO: 136516 - DNA, 1367 bp, Homo sapiens
gaaactttcctaagagaaaaatttgaacacattcaacacatcgtcattgacgaagctcagaatttccgtactgaagatggggactggtataggaaggcaaaaaccatcactcagagagaaaaggattgtccaggagttctctggatctttctggactactttcagaccagtcacttgggtcacagtggccttccccctctctcagcacagtatccaagagaagagctcaccagagtagttcgcaatgcagatgaaatagccgagtacatacaacaagaaatgcaactaattatagaaaatcctccaattaatatcccccatgggtatctggcaattctcagtgaagctaaatgggttccaggtgttccaggcaacacaaagattattaaaaactttactttggagcaaatagtgacctatgtggcagacacctgcaggtgcttctttgaaaggggctattctccaaaggatgttgctgtgcttgtcagcaccgtgacagaagtggagcagtatcagtctaagctcttgaaagcaatgaggaagaaaatggtggtgcagctcagtgatgcatgtgatatgttgggtgtgcacattgtgttggacagtgtccggcgattctcaggcctggaaaggagcatagtgtttgggatccatccaaggacagctgacccagctatcttacccaatattctgatctgtctggcttccagggcaaaacagcacctatatatttttctgtgaagtgactattaggaagaactccaaaccaaaatactgtgtaaatgtctatgggtgacagtctgctgatggtagaaacctttctttttagttcacaagtcagttagagatttggacagagctgacacaaagagtttggagctcccccatttctggctctcctttcaggggttcctcccccaactcttttcagcagtggtggctgccccccattctgacccctgactcttgcagccagaaagatggtggttttctaaaggaactttagctgtgctgcacaatgcagacctgtgtcttgctctctgggtaaaagccataaaaataagaaactcagcctgtggcctttcttccaaggctggagttctcgagttctcttttatgtgacttcgtgtagtttgttgctttaaaaaatttgtccagaattgttttctgcagaagcatggtctgttaggagcttacaggccataggagaagcagttgtttcctgaatttatctttgctgtattcatttagggcttgggagagtcccaagataattcagtcactgtcagattaatcatttcggcagaacaaacaatattgttatgattatttaatccttaaaattgtgatctccagagtttgttatc

SEQ ID NO: 136517 - DNA, 427 bp, Homo sapiens
ccagccaaaagattgttgttttaagccacctagctttggagttgcttgttatacaccaagagctaaccaatacagtctctctgtggaggaggcctgggttttatgaagtaagcaggtgaggaaggggaagggcttgcaaatctgctttagtgtgcaagtcgggcaatggagccaaacagatcacagtttctagcttctcaataaggctacaagacaaggtagtcccagcccagcactcagagttccaagatcagaatgtgcatcctggcccttattagttgtgtgactgtagaagaaaatgatactaaagagacttactgaagacctcacaaatggtaggtgacaaaaccaggaatccagctccggagtgtctcattctaaagtccattcatctctgcctagtattccatgtatggttctctctcca

SEQ ID NO: 136518 - DNA, 459 bp, Homo sapiens
acgacgcgcgcgtacatcgtggtaagagcattgtcaccccgtgttaccaccccgtggaagggcagggctttccgtgtctgcggatggcacactcacctgtggatccgcgctgtcattgctcgagagaaagcgggtttccacaggctttgttcctgttctcatgtcagatttcagtgctgagcgcccttgctgacatagatgagtaaatgggaacaagagtagtgttgtagctttgttgcttaagtccttaaactttgagaccattctgtggtttgggcacatattttcaggatttattttaaagctctatcagtaagtgacaggtggactgggtccctgagttgtgcaggggcccggtgctggcttgttacatttgttcacttccccagggtgacaccagggttcaagctttgccattgattagtgctggaggtctcgtgcctggggcagtgtgccatt

SEQ ID NO: 136519 - DNA, 274 bp, Homo sapiens
gatcgtgccactgccctccagcctgggtgagagcaagaccctgtctcagaaagaaaaataaaaggagggatagtaatagtgcctcatgaggctgctgtgaatggtaaacacagggaaagcagtgaggctgtaagtagctcaccatgggccatgccctactctaagcattacatcacaattaattctaacaactccaagaggcaggccttagtattatctccattttatagatgtggacattgaggtacagagaagtgaagtaacatacccaagg

SEQ ID NO: 136520 - DNA, 557 bp, Homo sapiens
ttgcagtgtctcacttatgtgttatgttccaggctattaatgattttattgaagacacttccagaacatattagtcaaactagttctctctgcctgcttatagaatgggctgaacacctccagaatgtcaccaaaatcagtgggaaacagaattggaaggtgctgcagatagtaaacacaatggcagttcatgcattaaaacccagtgtgacgggtcagggaccgtattggtttgttgtgctgtggatcatcttctctgaatgctaatcaagagaatctgaaatgcccactaatggagaactaatccaggggcgtataaccttctgattcaagaccttacagaggccacgttacaacacagcaccctgaaaatccaggggccctacattcccaccaggccacaccaaacgtccaggctttcctgggagatattttggtggactggcggccaaagttaagtagcttctgatctaaaaatgactctggctttcccatgaaaataggacagcatcgtcatcatcactgacttcttgtctgatggtgcaggcaacagtctg

SEQ ID NO: 136521 - DNA, 466 bp, Homo sapiens
  misc_feature (22)..(22): n is a, c, g, or t
  misc_feature (47)..(47): n is a, c, g, or t
gttagaagtttcaatagcaaantcggcaacctgaaggaaatcttcangaaacccctacgttttatttatttatttaattttaattaagtgtggtagtttttaaacaaactgtagaactcttcattgtcagcaaagtgaagagccacataatcaatgaaagttcaaaagccttctgtacttaaacatgatttgcaacgttccattttttgtatgtttagaatgctgaaatgtttttgaagttaaataaacagtattacattaaaaagtaaaggagggagggatataaaactacatattgagtacaaagtacactactcgggtgataagtgcactaaaatctcagacttcaccactatgtgattcatccatgtaatccaaaatctcttgtacctttaaatgacctttgagttcattgattttttattatgcacaattgactctgccattgaatctctcttattgtatt

SEQ ID NO: 136522 - DNA, 376 bp, Homo sapiens
gtttctttagccctcccaatgttctataagccatttagtatattgtaataaatccctttctgcttaagttagccagattgaattcttttctttgcagtaaaaccctgacccccacagcttgccaatgtggggctgaatcaaactttctgagttaggtattagagggtttccctccccagttactattgccttggttttagacaattatttgcaaaactgctgatgtgttacttttgattcctgaattccagctattgtgttttttccactatagtctagtaagtggtaagcaattagaaattcacgattttgcattttattatgtttaataacatgttgaacctgtaacatattaaattctatgttcagaaaactg

SEQ ID NO: 136523 - DNA, 334 bp, Homo sapiens
ctcccaggttcaagtgattcttgtgtctcagcctcccgagtagctgggattacaggcacccaccaccatgcttggctaatttttgtatttttagtagagaggggatttcaccatgttggccaggctgtctcaaactcctggcctcaagtgatccgttcaccttggcctcccaaagtgctgagattacaggtgtaagccaccacacccgacccaacatgacattttcatgtcacttgttttgagcgtatattcttggcccaacccttggtgtagcagggaaaacagacacgtgactaagaactcaggaaaacctttgaagttcggaggtatgaag

SEQ ID NO: 136524 - DNA, 364 bp, Homo sapiens
atccggatttgtatcctggttctgccactttcatggagtatcacactatataaggtgcttggtgcctctttgggctccaaatcctttccaatttcctattctaatgtaatatgcaatcacattgaatgttccttcacacatacatttcacaatgtcaggttttgtctatgccatactacaccatcagtattaatatgcttcctgtcattccgccatagcctcttcaaacgtcaactcttacattgatcattctgtcttttctattctttagatttttttttctttttctttttctgttttctttttaaattatactttaggttctagggtacatgtgcacaatgtgcaggtttgttacataggt

SEQ ID NO: 136525 - DNA, 405 bp, Homo sapiens
gagcctaatgcttttttccatccacagcatggctgaactacaatatgagataaagtttactttaacagcaacacgaggccgggcatggtggcgcatgcctgtaacctcagcactttgtgaggccaaggcaggcagatgacttgagagtccaggagtttgagaccagcctgggtgacatggtgaaaccccgtctctacaaaaaatacaaatattagctaggcgtggtggcatgcacctgcagtcccagctactcaggaggctgaggcaggaggattgcttgagcctgggaggtggaggttgcggtgagccaagatcgcaccactgtactatgaactaggttaggcctccttcatattcagtgagggtgcaagtccacaggttactttgttcaagcacagaatgcct

SEQ ID NO: 136526 - DNA, 385 bp, Homo sapiens
cgaagatttgagctctgattaaaggctgaccacattcaataaattatgggatttctctcctgagcaaattcggtgatgtagaataagatgaggattctgaggaaaggctttcctgcagtctttacattcaaaggatttctcttctaacatgaagtctctagtaaggctaaattatagctaaatatttacctgcactccttactttttttttttttttcccttgaaaacagagttaagcctcttttggcccgggggggaagttagctctaatgtgcccaggggggaagttagctctaagtggcccaggtgggagttagctctattggcccaggagtggagtagctataatggccaaggcgtggattagatataatggccaaggcgg

SEQ ID NO: 136527 - DNA, 446 bp, Homo sapiens
ctgcatcagcattccccccaaggccccccatccccagcagctgggattatagagattaaaggcacacaccaccacaactggctaactttttttgtatttttgtagaaacactgttttgtcatgttgcccaggctcatcttgaactcctgggatcaagtgatccgctctccttggtctcccaaagtgctgggattacaagtgtgagccattgcatctggcctgccttctgagaattctgtatcctgaaggagctataacaaatttttctgggtcttaccaggcgaggatgacaccttctaaaatcaacctctcttgcaacattatcaattacaattatgcagacaagttaattataattgggtgcatgagtatagattttatttggctcctatatcttaattctatgctttatcagtttcttaatataaattatgtcccctccaaga

SEQ ID NO: 136528 - DNA, 440 bp, Homo sapiens
gtgcgcgaggcctgcaggcgcctgcgccctccgctgccttccctcagggctctgatgggtttgccatttcctagcacgtggacgggaaagggcccgtgggctgggggtgaccggacggcggggggtcaggacagcgcctgtgggggtggccttccggctcgactcagccgagacgccagcgcagggccagggccggggctgctgccggccggacacccgtgctgtacggcgctcctcgccccggggcttcatctgcccttgccggagccttcccggctcgctggtttgtggccggcttaatcccacactaattagatttctgcgctggtgatgaaagggctccgtgcgtgccagcctgctggccggcccagcccactgcttgttttgcacagaattttaattgtttccaaattaatcctcagaatcgagtgagctcagcg

SEQ ID NO: 136529 - DNA, 237 bp, Homo sapiens
gcttgggggagaaaaggcaatcttctgttatcctatgaaagatgtattatggggaaatgaatgtaaaatcctatgaatttaaaaaataaaactgggatttcagacattattggctgccttccaataaataagtggttggaaatagtccattctttgctgccattggggatagcttaataatggagccatttggaaagcattgttataggcgatgggaagccatggatttagctccat

SEQ ID NO: 136530 - DNA, 176 bp, Homo sapiens
acgtcagggaggaaccagggtctgttctaaagactcctgaggagggcgtgaactctcacacaggcccaaggcttgccctttctggctgtccttaagcaggaccaggaggtgccaggctggagaaggaatgaggggcagagaagacaggtggtttgcagtccagggggaggaaggag

SEQ ID NO: 136531 - DNA, 552 bp, Homo sapiens
attgagagttgctgtgaagaacaactttcatacttgttgctttagagaggattaaaataaggtttataatgtatgggccagctgtggggggaaaaaaaaaaccccaaaacaaaaacactttctgtcatggcccattcattaattcctcaacattttttttaatgacttattatgtgccaggcacatgccagtttctgagcttccaaccatgaatacggtgggtgtaatgtgtgcctgcatggggtttactagtaaatgcagaccggcagaaaggcacttctccatacagtgtgggaaagctttgattggaagtatgtggttctgtgactgcacatagcgggatcgcccaacctaaatttggttggggttggggttctattgtgaagatttttcagtgcaaaggaaacttaagctaaaagagacagacctacagatgattagaggtaagccaaaggagggttaggagtggtggagaaagaacataggccaggaggaggtacggcacagttgaagaactgaggaaagactgattggatttgagagtaaagtgct

SEQ ID NO: 136532 - DNA, 131 bp, Homo sapiens
ctgggatacatgtgcagaatgtgcaggtttgttacatacgtatacatgtgccatggtggattcattttgcagaagaaagttgattttttaaatagggaagaatgtccttcagtagatatctgaaatatctg

SEQ ID NO: 136533 - DNA, 523 bp, Homo sapiens
cacacttctttttctacaacgtgcatttatcctgtgtacacccactgctttgagaggagggtgtaaaagatacgtcacgccttttatgacacacctctccctacaaagtttcctactgtgctctgatggtcgccgacagtcagtaaacagtaatttaaaataatttccaaatggcacagtctccctctccagggagatgcacttctgcctgggagtatgtaaccagacttctgaacgaacaggtaatgttccttatataaaagttattagcactcattttgggaaagggggaaaaacagaagggcaatgccatcactattccttaagccaaagaaaacatgaactaatgtatacagtggtgtcccggacgggggctctaaagagtgtttgtcgcttgggagagtcccactgccgcccaagccagcaacctccgagaaaggtcactcccaaagtggttccagctctaaatataaaggtgtgtttgtgcagaggactaatttggtagttctgatgtgtttactgg

SEQ ID NO: 136534 - DNA, 262 bp, Homo sapiens
cattttatgcttgtatcgcatctcgattcacaccagccacttctgaaataaatgctctcaggccacgtgtggcttgtggctgccgtactgagcagtgtgtgaggtgtgactctgctgggaagagactctcaggacgtgcacctggtctgctccggactctgccccgtgcacatttcccatttgctgagtttgcttttttctttctttttttttgtttttgagatggagtcttgctgtcttgctctgtcgcccaggctggagt

SEQ ID NO: 136535 - DNA, 284 bp, Homo sapiens
tgctgctaccaacattaaaatccattagggctctatggggatatataggctacacacatgaggcaacaattggaggagtttgaattgctagtgaatttgaatttgggaattatttttattgctattcacattgtttggtacagtcattacaaactacatgcagtaccttgtgctctgtagatcaggttatgtccaaatggagacagagtctcctgctgaagaacgagttggatgctcctctcagttaaaaagtgagctgaagatggctcgaggatggaagagag

SEQ ID NO: 136536 - DNA, 366 bp, Homo sapiens
tcttatatgctggtatgacgctatttgctctcccagccgctagatacttccagttctgccctggtaggtcgttctccgatgtaggcataccacgtggtgctcggctgcatatttcacccagctgctgctttgttcgtgtggctcttttctttctatatatatgcacggcgtgtacgagtaacgcattttgatgattccccatcttctttacctgcatgctagactgatctccaatttgcaatccatcccttcttctgtttctccctctttacctccctctcagccaaagatctctctttagaaaccatcacccaaggtagaggaatgaatctctatgctttgacacctccttctattcctcttttc

SEQ ID NO: 136537 - DNA, 214 bp, Homo sapiens
aagtatataagcgcattacagggatgtacccaatcaacctgcagaggtgaagccaattctacataggagttgtttgaataccttttaaagtttgtctggaaactttccttatttaattctgagtggtttttttcagatggcgaacaatactgtactatcgattgagcaatatccctcacttttcttttacttcctccccgcttatatcacgtta

SEQ ID NO: 136538 - DNA, 412 bp, Homo sapiens
cagcctgcggaactctaagacaattaaacctcttttctttataaattacccagtctcaggtagttctttatagcaatgcaggaatgtactaatacaccttccttttatactggtgaatgatcctggttgttggaaacacataatgcccttagtttaaattgaaaattaaccactagacagtcttttctcaattatccttcaagtatgtatagtccttcaattatattttgaaatgaatttgaggtaaaagcattctgaagttaggatttcaaattctcttagtttaagcaaaatgactttagtcaagtctgaattgtcaagtaaattatataagcaaaaccttctaatagaattgtctccagccagtactctccaagtctgaaaggagtcggggaagggagtgattaatctg

SEQ ID NO: 136539 - DNA, 282 bp, Homo sapiens
tgctactcacatgggcttcctctctgttcctgcaagaccagcccagtgccacctcagaacattgcatttgttactatatacgtggtgcttccacattgcctggtacctgaaaggtacttaatatttgttaaatgtgtgagaaaacagccttctcttgagagaactgtggggagagggagtttcaagttaatgccaggagattgaggttgcaggagagtttaattatggaaaatgagttccccaggatacaagggaaggctttaaatgtaaaagaggagtgtg

SEQ ID NO: 136540 - DNA, 770 bp, Homo sapiens
cccccaaattcctatgttgaaatcctttcctccaaggtgatggtattaggcagtggggactttgggatgtgctgaggtcataagggtggagccctcatgaatgggattagtgcccttataaaaaagacccaagagggaggctctctctttttctccaacgaggacacagcaagaagtcattgtctatgagccagaaagtgggccctcaccagacaccaaacctgccagtgccctgaccttggacttcccagactccagaactaggagaaataaagctctattgtttataagccacctgggtctgtggtattttgctatagcaacctgaacagactaagacatacactcaactctcacgggtatcttttctgaccagagacttcttactgttttatatccagtaaaatgcctggtcaaccacaggcactgaagaagtagacaaaagtgaacccatgctagctgtatcctaggaacatcaaccagggaggtcttctcatgagcaaaacaggcaaaagtgctacagaaatctagactgcattttaagattaaaaagtagaaatcaaaggtttagaaaacatctgagctctacaggtcaaagcaatcttgtccctggagttcttttatgaactccacaaaataaaccaccataatgaagggggagaggagaggggagacgagaaggcaggaacggagaggaggaggaaccgagaggacggcaagagagacgacgaaaggcagcggaagaaatagagagagagagacgaggcacg

SEQ ID NO: 136541 - DNA, 302 bp, Homo sapiens
cattctctcctcactctcatcagcattgcttcatttaatttcacatacttttgttagtcacttcaattcttttgggaacatgatgggctataaataaccaagcgcgcacctcatctgtagggtggctgttaactccatcacacagatcgtcgtggggtgactcatgcagtgcacgccgcacccgaccgcttcctcctcagattcaggccccccggttagcactcagaacagcgggtgagagcccatcgcgggaggcccactccccaccaggcacctggcccaggccaagcacgcagggagaa

SEQ ID NO: 136542 - DNA, 765 bp, Homo sapiens
gtacttagcatgaaaatttctactattgtaaaaattttgtagaggttttttattgttgttttttttttttcaatttaatatattctatgtctacttatttccatcccattacgccagtcacaggacagtctttaaaatgtaattttggtgccagcaatctgcaggtataaaatgtgtatttttccatcaacgtagctctagccacagtgagaagtcataaagaaaaattacattcaaaggtaacccagaaatgtcaatttagccaatcatcttatatcacttaatatgaaagatactaagtagcaaaattgtcaaatttaattttcaccttctgtttcttaccaccttttggtggagctgctaataagcagtgaaaaggataaacggcaggcatatgtggacagaagaaggcaaaatgaaatatttcacagctgtaattattagcctgtgaataagtgactgaaatggtggctgaaattgcaatcaagaatatgttaatgacatctgcatacaagtgatctgtgtttgcatgaaataatattttaacattttttcagtgagcaatttattgaccctgagacttttttctcccatatctcattttacacacacagcacaccactcatggacacatacacatacatatgcacacacaaaaaaatatacatatggacatagggatcagtaagactcatgagtatccctaataaaataatgtacaaaaatatatgagaggacaatgattattccccatatggggtgaaa

SEQ ID NO: 136543 - DNA, 184 bp, Homo sapiens
catctgtcttgtaaccttacactgtgttttatcctctgtctgcaaagtcacccattaaagaaagcctctcaagagtctcctgtttcaacccggaaaggagccctcacttctgcctgccacacatgaagctttcttatgtcacagagtaccaccggaacctggaggtaggtgcaagcaatgagtg

SEQ ID NO: 136544 - DNA, 431 bp, Homo sapiens
tactgccttcagacctttacatatgcagctgtcacttctggctaaaagcccattccctctttgccagcatattggcctcctacttacatcttatgacctagttcaaccaatccctcctctactccagaaaagtattactccttctatagcactaagtataccaacctcactaataagataacaagttctctaaggcaggaaccgtattatgtaatattatattcatctttgttcacctaatattcaagacatttgccaaaataggtgtttaattaaattttcccttttgcctcaaatatattaggtccttggaattatgtataaagtcctcaaaaggtatacacaaggccatataccagaaactgcagcttatctcatttaaggttcacaataaccctattacatagctacttttcctattgtaatagatg

SEQ ID NO: 136545 - DNA, 412 bp, Homo sapiens
taatctctgaaaattgacattctcctcactccccacctggtgcagctggcagctggtgcctcagggagctgatccctccctttgccagcaccccactccccatgctgggctgggtgtccacaggagtggacgggcccaggaatcatggctgggaggcctgggttccagccttgctttagctaccaactcaccgcgtgaccttggccaagtcccttgacttctctgggcctcggttttcctctctgtaaaatggggatggccacaccctccttctggggggatcagaagcttagctgagtttaaaaggaacatgactgacatcaaaggagcccggtaaaccaatgggatcctgagttgatttccttccctgtaacgagtggcagggcctccttctcctcatgtggtttgggga

SEQ ID NO: 136546 - DNA, 351 bp, Homo sapiens
agaggatcctcccgactagcccgacagcgtgaaaacgaactaatatagtaaatggtaccagtagagtggggtgttgctgaaaagacacctgaaaatgtggaagcgactttagaactgggtaacaggcagaggttggaacagtttagagggctaagacaggaaaatgtggaaatgtttggaacctcctagagacttgttgaatggctttgacaaaaatgctgatagtgatatgaacaataaggttgaggctgaggtgggaggatcacttgaatccgggaggcggaggtttcagtgaacagagatcgcaccggtgcctggacaacaaagtgagaccctgtcataaaataaaat

SEQ ID NO: 136547 - DNA, 360 bp, Homo sapiens
tgacaaccaaaagcttatgttattaaataagctttggattaacgggatcaatgaatgaagagtttaaagatagcaaaaaaaagttcacagaagtacctgccaaatgtgccaactgactactatgaactaatttacttttgagaaacatgctatttcttatatgctactgacagtacctataaaaatggtgcacattaactggctgttttattttctccccaatcttaatatctaatatccacagactgagattagagcaccaacgtatacaatgtaacttcatactagagttagaaggggatacaaagtgtagaaatcataatcttctccataaagttcctgtcaccttggaattaacct

SEQ ID NO: 136548 - DNA, 226 bp, Homo sapiens
tggccatgtctgtgtgtcaaatgccagccagtcctccaagacgctcagacatctttcccttattgaattcttttcacccctgccctgggagcctaaacttttctttgcacccctatctcagtttgtaccttatcacttgctcttttacagttttcacagatctcatggcaactctttctcatatgtctgtctgatgaagagtgaagcctctttggtgcaggactgt

SEQ ID NO: 136549 - DNA, 264 bp, Homo sapiens
ggagcctgcctcagctctgctccctagctgggtggtcttgggcaactttgttaccctctctgaggctgagttctcatctgcaaatgagactggtcctgatctcacagagttgctacgaggatgaaatcagataaaactgagttcaattaacttttaccctcttcctttctgtttcttccctgaaactgctgctaggctcccctttccaataaagcacctgggagaccaaagccatcaataacagggaccacttgtgggccgaga

SEQ ID NO: 136550 - DNA, 366 bp, Homo sapiens
agccctgaatacccaggccatatccagtgctgtcaggggctggagaggcctccaagcctggatattgggactggtgtttgccgccagtcagggcagctcctgtgggtttttcttctttgcatgtttgtccagaaatggggtttctgttaataatggtggctctgactatgtgaattgaaatctctgctcgtttcctttcctgctatggtccagaagtgaaatttaacccttctagaagctggaggaaaagctggctttggccacaatcatgaggacatttccctcatatttggtggtggtaaatccctcctgggacacggggaaatgaccagaggctggcggcccacctggcaggaacagatgcca

SEQ ID NO: 136551 - DNA, 740 bp, Homo sapiens
cagtgttgtgctggtagatgttgaacaaccagccccgcaggacaggagccttggttggaaatgtttgtcggttccacagtgtgaatacttccactgcagcccatctccagttaccaatgcggggtactgtgcatggagctggagagaggtaagtacaatcgcttctccaccgggcccgggcttctctcaggtttgaggctggaggtgagtgagctccccctgggaagaggctgggctgccgggggaggagctgtctgggggcgaagaggggcccactgagcccaggactctgcagccagcctggctcgctggcacagccgggaagatttccctaagactcaccactctgtgtggggctctcagtaaatgtttattgagtgatgcatgatggatgttaagacattgaatcaaatcttgctctgacctttgagtcagtctgttgggtgtgaaagaactagcttttctgctctgtttgctggaagcgtctgaacccctcctggggcctcctgctctcaccctcctcccattctctgggaccgtcctcagggaaggcctctgggcttggcgtttcacacagcctctttcccacctaatctcaggcgttcttgcaacagcccgtggaggtaaacagctgtgtctctcagttccaccactggccacaggcagggccttgggtgaggttttcatcctccctgggtagtggtttcctctctccaaaaatagagggagtaacaatatct

SEQ ID NO: 136552 - DNA, 108 bp, Homo sapiens
agataagaagctttcttagaatagtactgagagacgctggtggtgtaagaacagagaaaattaagttaatatgctactgatcctctttcaggacattaaactcagtgg

SEQ ID NO: 136553 - DNA, 542 bp, Homo sapiens
gggctgccggccattgtattctcacgatttgcctggtgactccgggtgaggaagtggggtggattctgaattgtgctttatttttactttgagttcatggccttagttggatttatccacaagataatggaaacagttctctttgagttgcctctcaggcattgctggggagattgttctccttggagaattttcactaggaatgacaatgtgacttgatactgccttttacccaagacatctcaaaatattttaatacgtatttgaatgaaaactattctcttaaagctccccacagtagctgcattggcagtgactcttggaacttgagctctgactggggctggggtcaggatgcgagggcagctgtgggcagggccagctctcctattcagtggagtctttgtcggccggaaccctttgttctggaagtcctgggagttacagaccagatcacctggagttctcccggggcctcgttctttctgaaccggacttcaggaagtggttttcccgggctgttttggtagttatcagatact

SEQ ID NO: 136554 - DNA, 402 bp, Homo sapiens
atgaagagctttttgctgttcagctgagtttaacttgaattactttttttaatgaaaggtaaaatagcacaaaattagcagcaaaaagatgttcattaacaagaagcacagtggcttggtgttcagttaaattgaattttcaaccatgttttcgacccgcaaaggcatccttccctgtctttttagtaatgaaagggtttcttctcttccaccactgcagtcaggagcagcagagctaacatggttgtcttacagacgtttaatgtactgtggtcataattaaactaaaggattcttaggggagaattggccctcagttgaattttcctcttccctaatgtgtgtggaatgaacaagatgattgggaaatagctattttcacacttactacgttacaagatg

SEQ ID NO: 136555 - DNA, 368 bp, Homo sapiens
tttacttgggtatcccctccataaatggatgtcaaacttcaatgtatgtaagtgtcaattgccagttatatctattaggaaatacagattggctgggcgcggtggctcacgcctgttatcccagcactttgggaggccaaggcgggcggatcacgaggtcaggagatcgagaccattctggctaacatggtgaaaccccacctctactaaaaatacaaaaaataagccaggcgcagtggtgggtgcctgtagtcccagctactcgggaggctgaggcaggagaatggcgtgaacccgggaggtggagcttgcagtgagcagagacagcgctactcactctggcctgggcaaaagagcaagattctgtc

SEQ ID NO: 136556 - DNA, 284 bp, Homo sapiens
ctggaaccccagaccagactcctgcagtttcaagcagcctcctccttctatcccggtgtaccttccatatctcagtaccaccacggggaacctcaaagactcgacaacccatttcaaaagcctggctatggaaagaagaggaaagggaggagccgcaagtttgggagaaagtgtatttgggatgctggagtgggagcctgtttgtaggagccatagggcaggcttgaagatgaatgggaaagaagatgagaggaagaggaggtgagactgagagcttcaaaagc

SEQ ID NO: 136557 - DNA, 415 bp, Homo sapiens
tgagtctacactgccccgtggtccttctggagtttttgagagccatgggagtggtcagtgcccatcccggcaggtccctttcccaggtttctggcagcctcttccctcattcctctccctgtgcacacaagacagccccactggaggagtccattgggacccaggggtgacttttgttaaaacctggaaaattgtgtcccataccaggaccacgttcctgggagggggtcaagaaaagtgagctccacatggatccctacctgcagacagtcactgggagggtcctggatgtttgcgcctgttactttcttacagaaggcccaccttcagctatcacttttctttttttttttttttttttgagacggagtctcactctgtcgcccaggctggagtgcaatggcatgatcttggc

SEQ ID NO: 136558 - DNA, 147 bp, Homo sapiens
tggattatagactcaaagtttaagagccagactgagcttcagataatcccatccactcactcatgttacacatgaactcccatgccagcagatacttcccccaggttgtatggctaattagtgatttagactgggcctaaatctctt

SEQ ID NO: 136559 - DNA, 492 bp, Homo sapiens
gattctgagagttgtgagagttaaataagattatccacataaagtgcttagtacgatgtctcacatgcagaccttcaataaatgactcattattatacaattatcactaattctattactgtctctacactcctcatagcctaaagaaagtgtgagtgctgtttcccagagcgcatactgcactgcccagggagtggccagagcagtgagagaatctggctgaacaggttttttcaaagcagtggaaaataaatcaaaggtgataacccaaattcggaaaaagaatgtactcctttgtttgttctttcctagttgtgaaagaaccttcaaaatgcaatttatgctgaaataaatcagaagcaacatggctgactctctctggtctgtgttcttcctgaccccatgaggatagacagtggtaactctgagtttctgctggatgtggtgatagctgaccatgttctgtgatgatgtctacaccagtgagtggac

SEQ ID NO: 136560 - DNA, 284 bp, Homo sapiens
gagatatggtcccattgtgaaccatagtgaacaacattgggctttggaactagaaggtactgggtactagcttttaaaatgttttataaccttggccgtatacttaacctcattacacttctatggtatgtgactttaggcagatttcttaactgttctgaatctcagtttcctaatcctaaaaattatgataaatatacatattaaggatgaaatagaattcagacattttatttaaataatatctgtaaatgacttgctgtgtccaacacacaagtttggaa

SEQ ID NO: 136561 - DNA, 522 bp, Homo sapiens
taatcctttaaatatgctgttgattttggtttgctagtattttttagaatttttccatcaatattcatcagtaatatgtgtctgtggcatttttttcttgtagttctttatctggcttttgtatcagcataatgctgtcctcatctaatgagcctgaaaatgccccctcctcttcagttttttgggaagactttcagaaaaactagtatgttggtgcttccttaaatgtttgctagaattggccgggcgcggtggctcacgcctgtaatcctagcactttgggaggccgaggtgggcggatcacgaggtcaggagatcgagaccatccttgctaacacggtgagaccccatctctactaaaaatacaaaaaattagccgggcgtagtggcagacgcctgtagtcccagctactcaggaggctaaggcaggagaattgcgtgaacccgggaggcagagctttcagtgagccgagattgcaccacttcactccagcctgggtgacagggcgagactccgtctca

SEQ ID NO: 136562 - DNA, 162 bp, Homo sapiens
ttcgaagatcatcatcagacttttctgctctctcttgacacaacagcctcaagcccccacacgtcactggctgctactgaaacatgctcacaagaaatcctgaaccatgctttgagccagagttaccaaaatggacgaggtatttctcaggagaaactgtcg

SEQ ID NO: 136563 - DNA, 408 bp, Homo sapiens
gtggccacaggtctggaagacaaggtcctagccaaaatcctgccgtcttactattttctccagagattggtaatgatcgtatgtgggatataaaaatattttttacaaaagaaaagataaatattttttccagggaaactgtaagaggcagatttgaaaaggacaaaaaccctaggtgtttcaggtagattctatgatagaattgtagattctagattatttcagttgcagttgtcaaacaacaggcacaaactggctttctgcaacagaaaaaaatccataaaagcttcaggtatagttggatccaggattcaattgatgccatcaagaaagtgtcgggccaggcatggtggcttacgcctgtaatcccagcactttgggaggctgaggcaggcagattgtgaggtc

SEQ ID NO: 136564 - DNA, 221 bp, Homo sapiens
gtgttcagctcatgattatgtattcttagagataaacacagtgtagttaaaaattgtgttctgttttttacacaagaaaattgtgctctttttacagtgattactgtgcacatttgctacatattggaccattggaatgatgtattatgttcttttaatgtccctgcattaaacatcgacattgtttctctttttttttttttttttttttttttttttcc

SEQ ID NO: 136565 - DNA, 172 bp, Homo sapiens
ttggagacagcagggaaactgggcaggaggcacaggtatagccatggtgcaggcatttaatttcaagatacctaagacctggggcaatgagtttgggggaagggctccagtcaaaatcccagtgtctctctttctatatatcctgtcaccatcacccatttcctactcacag

SEQ ID NO: 136566 - DNA, 200 bp, Homo sapiens
caaatggctacggtgcagagttaatgtcgtcattgggcactgcgaaaaggagactgaagaactgacagccattcctcagatggcgtcgaggtgcagggttgactctggatgttgtaatcagaaagagtgttggttgcctgcagcaatcagctggttgcctgcagaagtgagcctcttctggtcagggggcatactttttt

SEQ ID NO: 136567 - DNA, 281 bp, Homo sapiens
acaaacaaacaggaaatcaaaaaaagaagtggattgggaaggaggtggataaggataaggtgaaatttgatggcccaactttagacattgagtttgatataaaatagcagttaatatatattgctagttcagcaaaaggaactaaatctagtggaggcccatatcaaggaagagggaagaggaagttgagacagtcaccagaaaagaggaagcccaagccactgtcccatcacttactctaggggtcaacagagggaggtattcaaggacaaagggaatgt

SEQ ID NO: 136568 - DNA, 421 bp, Homo sapiens
ctgttacgctgaaaagtcctccataccagtcacctctccaaagggagccaaatggctgagtgacatccttgctaacaagacaacacagaacggagaaactgcaaggaatttggggaaggcatttgagtttcctcagcttcatgaaaaataagtgcagaacaaaaggtcagagcaacagctacaagcacatgtacattttagtgaacgtgaggggatgtggtccttgccggccacacttctgccctcaaatgcagaggtacttgaaacaccagttggctgtatgaacgaacaaaggcatgacaaggcttctgcaatcagtccaggtgctggttacacggctttggacgggtcacttaaccttgattttctcatctgtaaaacagagacactaatatctacttcacagagttatgagaactaa

SEQ ID NO: 136569 - DNA, 325 bp, Homo sapiens
cttgtctgcagtagtgatcatatgaatctctatgtgataacatacacatacacacaaatgaatgcatgtaaaacaggtgaaatttgaatatttgcacacccatgttcactgtggcattatttacaacaaccaagaggtagaagcagcctaaatgtccttagacaatgtatcaaagtcaatttcctagtacaaaagttatgcaagttgttatcattgagggaaactgggtgaaggaaacataagatctattacttcttaccactgcaagtgaatctacaatggtctcaagtaaagacttttttaaaaagagagattttcagattgg

SEQ ID NO: 136570 - DNA, 558 bp, Homo sapiens
tatacacatacagggctggggggagtggggatataaatgtagaaaaattgtaacaattagagtgtctgaagaccataagggtgttcattatactattctattttcctgttactttggcatttttaaaggaaataaataaaacaaaatttaatttctcaaatggagttgaaaatgcattgctggattgttaacattattagttttaagtatttttggcaacctacaaactcatgcaggtttatctctctctccaaaatttatcatagttaatctgtaaacaaaaagcactcaagaaatgttgattgaactaaattgaattggttttaattccaaacatttttcccaacagtctttttagtactgaattctcgttaatgccaatatttttgttgtgtttgatctactctccatgaagcactgcagaattcctaatcccccaatatattacattcccatcagtttaatcattttccctcattaaaatgcattaaattttggtaataatttaaattgtcaacaagtatttaaatctagtctaataatccctgtggaaaagta

SEQ ID NO: 136571 - DNA, 1582 bp, Homo sapiens
tctgggaatttatccaaaagaattgaaatcaggatatagaagagatatttgcactcttgtgttcattgcagcactattcacaatagccaaatgtgggaacaacccaaattctatctgcagatgaacagataaagaaaatatggtatatacatacaatggactattattcaacctttaaaaagaaagaaatagctgtcatatgcaacaacagagacaaaacttgaagacattatgctaagtgaaataagctagtcacagaaggacaaatactgcatgattttacttacataaagtacctaaatagttaaaactcatagaaacagaatgtgagcatggattgggcgtgaaccagagggatttttgttttttgggtttttttttgtaaagaacagtattgggataattggcaacatgtgaataaggtctgaatattagattgtaattctgtatcaatgttaatttcctggttttgataattatactgtggttatgttagagaatggccttgtttttaggaaacatttaggagtaaaggagtattgtatctgcaaacttaactctaatggttcaggcaaaaagtactgctgtgtatatatattgagagagaatatggaaaatgtcaagggtcacagaatctgagtgaagcatatatagggcatctttgtactattatttcatagtagaaactacaaaaaaaaattgaaaggaattgttccaatatgacagttactgtttcaaggtgcttttatcatgggtagttttctttaccagattttctataatatagccttgtgtatattttttggagaaacaccatatgtaatcttacagttatgccagacatatacctcagacagtgtactttaattgtggtagttgtttttggactcgatccagggtatagtattatagtgtcatggcttggatttttaattatgattccagccaagacatcgacataaatataccaaagggaaggaccctgagagtgtgatgcagagaccagtggtgtgatgttatacaaggtcttatttcctacattgttggttctcactgctggcttcatgaccctccatcataatccaagttatctcaagacgtataactcttaccaacccagtttttaaaaaatgtattctcagtgacattcttagaaggatggagcacatattcaagcatataatagaatgccgtataactttagaaagtttggtagttacagctcaaagctatctggagatgaaattaaatatgtgaagagaaattataaataaaactgccaacagtgactacatctggagggtggaactagcgggggaatcagggactttctcatgtctatttaaaattattttgaataaagattatatttatctgatataaaattattaagatataaaatagtataccatggaaagtgtcccttctcgctctgtcccccagatactctgtttccctccccagaggcaaccatgattaactgtttctggcataactcccaagatactggatgcatgtaaaagcaaatgcttattttttcctgtttttctacacaaaaggttgtccattattgtcactttta

SEQ ID NO: 136572 - DNA, 487 bp, Homo sapiens
cagggaacgcgggaccggggtggaggcacgaaccgtgtgtggggaggaaaatgtaaaccactcttttggaaaggaagtaataacgtccaatttggccgggcactggggcttgtgcctgtaatcccggcatgctgggaggctgcggcaggcagatccctttagcccaggactttgagaccagcctgggcaacacagggagatcctcttacttttagtttttttaatgtccaatttgcaggatttagaacggacaggaccaaactccagataagagtacgtgaactgggaaaagagcaggcagagccaacaggctcaaaagtctccgcgtcattctagaaggtcaaggccaggcacaggggctcatgcctgcaaccccaggatggggagaggccaaggcaggcgggtcactcgcgcctgcaaccccaggacggggggaggccgagcgggtcacttgaaccctctgaaatccaagagtttgagacctacc

SEQ ID NO: 136573 - DNA, 277 bp, Homo sapiens
ctttcctgcagtctaggcgtggacgggggcgggagagtgggcggagggtgtggggccccactccacagccccaggtttgctgctgcgctgtctgcttggagattaaaatgaaacgtgacttctaggtgagacgaatctgtgtgtctttgcattcctgagaccctcataaatcgattctgcagcttctccggtggatgagtcgtgcccagccacaccctagcaaaataccgtgggtcacacaccacctgcatttctgagttccggttaccatctcact

SEQ ID NO: 136574 - DNA, 403 bp, Homo sapiens
caccatctaccttctcaccgccagcctgtaagagccttgtgggcaggaacccttgagggagacagtgagggaggtttaccacttcaacaaatatctgagcagcaactgcatgctaggagtgaataggaggaggtgtgagattcggaaccaggagttccgcgttctgtctgagccttcctcatcccctgctgctgggtctcacacaactccgtctctctccattcttcagtccctctccacatctgtacaacagggacagtcctgaagaagaggctgtcagagccatgagatgagatgggagaagtggaatgttttgaaatttcagggaatcctccttctctttctcctcctttgtaaatgctttgtccctgagggtccctaaaagctgacagtagatcacgcc

SEQ ID NO: 136575 - DNA, 370 bp, Homo sapiens
gttagaggaatctttccataaggctccgtctttggtttaacttttctgttcatttccttctgggcctgaaagatgtaagttgatgaccctgattgccattttatcctcaccctttcagacagacccaggaaaaatcattaggagggatgctagctgtaccagtctgagggccaaggacgcatgggattgcaggctgtgatgtctacaggtctctgaagaagagctgagtccacttctcaggataccagcccattccatggcttccctcaactcaaggacattcttcttctggtcattttcttcctcaaaattttcttttctccttcattttattaaagccaagtcaaactccaaagaaatgcagaggacc

SEQ ID NO: 136576 - DNA, 364 bp, Homo sapiens
gagtgcagtggtacaatccagctcactgcaacctccacctcctgggttcaagtgattctcctgtcttagcctcctgagtagctgggactacaggtgcccaccaccacggccagctaatttttgtatttttagtaaagaggaggtttcactatgttggccaggctggtctcgaactcctgacctcacgtgatccaccctccttggcctcccgaagtgttgggattactagtgtgaactaccctacccagcctttagtggtaattcttggaattccattataaaaattcctttataaaatattattgaccagaccttaaaatccaacttctaccaccaattttcgattaagtagtattgggtaggg

SEQ ID NO: 136577 - DNA, 323 bp, Homo sapiens
tcaacatagtcttggaagttctagtcaggtcaataaggcaaaaaggaactaaaaagcacacacatcaggaacgaggatatacactatttctatttgcagcaaatcttaaaaacaaatctacagggccgagcgtgttgtctcacacctgtaatcccagcactttgggaggccgagacaggcagatcacatggtcaggagtttgaaaccagcctagccaacatagtgaaactccgtctctactaaaaatacagaaaaattagctgggcatggtggtgggcgcctgtaatcccagctactggggaggctgaggcaggagaatcact

SEQ ID NO: 136578 - DNA, 260 bp, Homo sapiens
aaggacctttatataatttcaacaaattcaaaattctaaatctccatagaaacacctttatgaggaatataaggtaagaaatatttctgcagtttatatggatttaaacattttaaggtcaaatcattgtaaaatgtcatgtaggaagggaaggcctgaagtctcaatctgggtttcaggcagggaacctgaaaacctcacaaagccacacataacactattagctcaaggaaatgtttctcactgtaacaggaaaaggg

SEQ ID NO: 136579 - DNA, 500 bp, Homo sapiens
gcccatgaaacccttagcgtagtgcacaacacatgctgtgtcttctaattacggttctgactagatcctgcgttactgaagtcccccatgctccaggctttgagatcataccctctggaactttggaacttcagtccaaccactttccctttctgggtctctgtgtttctgcctgaaaaggagacctgtatcttgccaaagaagttctgaaatctctgctcaccctgacaatgactccaaaaatctggggctcccagacttggctctctgcctaaaactccactcttgcagacatgccgtttggggctttggtgcctttggagactctcctttaaacacaagcgccccaggatcggatcacaagttgttatcagtcattcacaccttagcaggaaagactttaaagctggcttctccatcccactgtgcttctcactcctaggaggcacttcttgacttgctgaatgaattagagacctgtctagctcccaagtaccaag

SEQ ID NO: 136580 - DNA, 596 bp, Homo sapiens
tgtgatttccctattttaatgaatggtaggaagcaccatatcatccaggttttacacactggaatcattgattccgtactcccctggttgtctaatctagtgaagccacatagtctgctagttctccatgtgcagcctgcctcctttccttgctctcaccacggtcaccatcactgaccatcagaccttgttgtcatactagaggctatggtggtctccaggctttttgtctgcagcctttgccttctctgttctcttatctgggcttgctggacctcccggtctacttttatatctaccttttggtgttgggtcattttttagggtcccttctctgaccttggaaaatcctaccagtatttccaatatggctctgtcctcttctctgcttactttgcccttttatttaggtaattttattcactctgagtagatgaatctcagggttttttttctactagcccagacccttcctctgagaccattgtatgtcctcatttgccttgaatgtctcatagatacttaaactcaacaggtcccaaaatgacatagtccccccacaagcctgcttagtgattcctatctgaggaaatgcc

SEQ ID NO: 136581 - DNA, 546 bp, Homo sapiens
agagaaaaagagagaaggtctcagtaaataaaatcagaaattaaaaaggagaccctgcaatgcaaggctggttcaacatacacaaatcaataaatgtaatccagcatataaacagaaccaaagacaaaaaccacatgattatctcaatagatgcacaaaaggcctttgacaaaattcaacagcacttcatgctaaaaactctcaataaattcggtattgatgggacgtatctcaaaataataaaagctatttatgacaaacccacagccaatatcatactgaatgggcaaaaactggaagcattccctttgaaaactggcacaaggcagggatgcccactctcaccactcctattcaacatagtgttggaagttctggccagggaaatcaggcaggagaaggaaatgaagggtattcagttaggaaaagaggaagtcaaattgtccctgtttgcagataacatgattgtatatttagaaaaccccattgtctcagcccaaaatctccttaagctgataagcaacttcagcaaagtctcaggataca

SEQ ID NO: 136582 - DNA, 479 bp, Homo sapiens
aattccatgtttgcacagctcccatctccctggaaagaggaactgatgtttgaggggacagatgtgggtcactttccctggcagtgccctctagccttgctgccttggctttctgaccccttccaggcttcaggggcctgggagatctcatgcctcagcccaggaaacatttaatagggaaagcagagacatgtcatgtcagccccacagacaagaatttctagagcacttgtcctgttgttccttgccccgacattactcagtctgggccatggaatccatccaataaacacagcaacaccctatgctactgaccaagcaaagcttgcccctggtaccaaagagctaaatcatgaccaaagtgtgacatgaatgtaactgaaatgcgggttagttgctcaatgtatgcaaagtcccacggacaagagtaaagtctgataccaataaagtgaatgtattccaaagctaaaaaagaggag

SEQ ID NO: 136583 - DNA, 549 bp, Homo sapiens
tgccaattatccctacctttatttaacattatttcagaagttacacttaaggcagtatgacttgaaaccaaagcaaaaagtacagtcatggtgtctggctcggggcaaaactgtcattatttagagatgatatgattttctacttagaaactcagtcgaatcaactaaacaacatcagaactaaaaagagcatttagtaaagcagtcaagtacagtctacaggttttctttgaagcagaagtcaccctaactaccattttatctctagcaacacaataaagaaaaatgggtggcaaatgtgaaacttacccattttagttaccactctaaatttctaaaactctttagttgtcctcttttctctctccttcttattgcctgtaattgggctgtgctctctgctagaacattttcagtgttaatctaagcagtagaagcgccaaaagttttattttaaagaagtttatgagctatctagttggaagtttgggcatgggtaaggaccttttcttaaaactgtctgcttagagctttccataggttgaaaaa

SEQ ID NO: 136584 - DNA, 359 bp, Homo sapiens
aaaattctatctactgggtccaccctcagaagatccatgaaggcagtggccaaaagtctttatttttgctcagcagtgtatctttggtgcccagcatgtagtaagtgccttataaatatttgtcaaatgaatgaaaccaatgaatgaatatttggtagacaattgagtgctagttacagcttaagctcctaaaccggtaatttcacattgagaaacagtctagttcttttggcattatttatattcttcagtttaggtaaaactagtaaacattttgacccaagatcttaaagtaaaacgtaaaattgtttattttcacaagtgtcagtcaaatctattatgtcagagagacaacaccc

SEQ ID NO: 136585 - DNA, 139 bp, Homo sapiens
ccccacctcagcctcctgagtaactcagcctacaggcacatgcccccacactcagctaatttttatttttgttgagacaggatgtagctatttgctcaggctggtctggaattcctggcctcaagtgatcctcgcgtca

SEQ ID NO: 136586 - DNA, 293 bp, Homo sapiens
tcagcgtcctccactgctgccagggtcacgtcaagctccttagtctggcattgaggccccttcacagtctgccctgcctgcctgtccatcttgtctctgctcccttttgatttttaagtttgtactgaaacaaaaaattgcatatgtcatgtctatttttatgaattttcaccaagtgagcacacccatgaaaccagcacccagatccagaaatagagcattaccaggaccccagaaatcctcctcatgtcctacttccaatcgctatcctcctcctcgtcaggggaacagct

SEQ ID NO: 136587 - DNA, 269 bp, Homo sapiens
agatagtctgatttaataaaaatgtattactttgtactttcaaagggtaggtatggacataaggaaactatttctgtcccatttggtatttattgctttgaacagacactgaattttaatttatagtaattctaggaagggaagataagttctgtagaaattacataaataaagtggcctcattggcctttctcattttggtcattatttaggatcactcacatatagtaaaatgctgactaaatcctcttgacccacaaaaaaaaatt

SEQ ID NO: 136588 - DNA, 320 bp, Homo sapiens
ggggttcgtgtgtcttcagcccacttcatccaagaaggcaactcttgatagtcaggctcctctccacctttctcaagtcttagcattcggacataaggaatggactggggccgctctgcatccagtaaattgccttcatcctcacctattctgggtactgtatgtgacaatctcaaagtattttaagatgtagggtttactgctattcaggtacggtgaggccaacagttaaaagacaattgccactgaaaaagtctgttactcacagtccccaagaagaggtagtgcaccatgccaaggggccacacggagaagaacca

SEQ ID NO: 136589 - DNA, 368 bp, Homo sapiens
gggcagggtgcaggtagaaaaggcatcacatcttttatgtaatggatgcagatatatgtcacaagaacccctgtggacagggctgaggtgtttggcccagtgaaatgtcacaataaccaaaatatgtggttgttagacagaagagtcacatcacctaagttctggttccagtgatatgtcacaatctttccttttgacagggatcagagaggagtcacatcggttaggtgatgaacaaaaataaatgtctcaataaccccatgctacctgcctgacaagcgcctatagcactcgattaattcttgtcaccctaacaggtgaacctcagttacgcacccttactaacattaacgaaaatgacctcaccc

SEQ ID NO: 136590 - DNA, 314 bp, Homo sapiens
tgatgtgaggaggggagagccctgtcccagagggaggcagtggccgagggcagggcacggccgtgagctgagactccagtgtcctcagcctgtgtcttccagcccctcctcggcccggggccctgaggccacccagcatttcctccccggcggccactgagcatgtggtcgtccagagcatcaggcctcaaaggcacagccgtgcccacagcactgtggcccagggccaccctgccaagctctccaacctgtcactggcaagctgggagtgccagtgtaaggtaccaggtcctccctgaggggtccacagggca

SEQ ID NO: 136591 - DNA, 281 bp, Homo sapiens
ggcctcccaaagtgctgggattacaggtgtgagcaactgcgcctggcctacttaccctcttaaagcaagtaaaatatcaggcaaaacatgaaataactatttttaagacagtgggcctcaggcattgaattgtgttgattcatgagagactggaaacaaatgaatgctacagttctaccagtttactgcctagagagtttccagactgcagagcatggagcccagtggtcttcttgagttgaggaaatggagttaggaatctaaagaagccaagacagcta

SEQ ID NO: 136592 - DNA, 277 bp, Homo sapiens
ctgataaatcaggaaatatggtcatactactttgaatgtagttatctattaaatgtgtctcttgtcattcaactgtaaagctgtgttaagtttgagccttatttctcttagcttcctttgttgcctggaattgtgtctggcacgttgtggtggcagaagaaatgttagtgcccctttaaaaatgttcatttatttaaacattatactatattgatgtagaactcataccatcccatttggggccttttatgagccattttctcagtattacaaatgt

SEQ ID NO: 136593 - DNA, 688 bp, Homo sapiens
ggaacttcacatttcaatccagggctctgacctggtcttggcatgctgccaacttcttgcgacaatctggctgcccaccgaggtagaaaccacatctctttcagccttggtctgtggcatatggtagtaggaacagacaagagaaaccaatttattgagggcttgctttatgccagttttgtgctggacactttgcatattctcttccaagtcttcacaatgatgccgtgtgattattgtatctgatttatgtgtgagaaaacccaggctgagaagagttaagggacttgtagtcaagtggcaggctgagatttgaagtcaggaccacctgaccacatttcttctgctttttctgctgcactgacctgtggtggaaatatttcttggtaatgtgccttccctcagctattaaaatagttttccggaagcatctgttggatgaccattgtggatacttgtagttacttccagttgcctcttaggtcagcaccttccggcccaagctgaggtcagtgcttcctgctggaggttggctcctggccttatttaacaccactgtttcctgtcactccacagcttggtcatctactctgccaaggaaatgggccagtcttcattctctgcacttagccaactgggggcttcctgggtcttggctcaccctggagctgttaacacccattttcaa

SEQ ID NO: 136594 - DNA, 255 bp, Homo sapiens
acggtgacagcttctgagtagctgggattataggcacccgccacacaccatctaattttcttttcttttttaaatttttttgtagaggtgaggtcttgctatgttgcccaggctgccttagcttcaagcgatccttctgccttggcctcccgaagtactgggattacaagcatgagccactgtacctggccaggcagttctttaacataaacaacgtgtgctgtgggtctggattttttttatgctaacattctg

SEQ ID NO: 136595 - DNA, 704 bp, Homo sapiens
acttacctacacagagagataacaaagaagtttgtttgtttgtttacttatttattgaagactgagtcttgccctgttgcccaggccggagtgcagtggtgcaatcttggctcactgcaacctctgcctcctgggttcaagcagttctctgcttcagcctcccgagtagctgggattacaggcatctaccaccacacccgtctaatttttgtatttttagtagatacagggtttcactatcttggccaggctggtcttaaactcctgaccttgtgatccactcgccttggcttcccaaagtgctgggattacagacatgagccatggcgcccagccaaagtttgttgatttttatcttcagctctagaaagagggaaaaaaagtcttccatataaattttcaactgcagttttttgttttcaattttcatcatgttttgaggtatgaatttatacttctcccaaactgggaaattaacataacagccacacctgggcttctggttctggtaaaggtcgaggagctgtattgggcttaccctcttgccaataataataataaaagatctggatggaatataaaaacaaaaataggtagaaactggaggcaacacactacttgaaacaagggaagtgacctggctgagctgtacatttaactggtttatcctgcagatgtgctaggttcacaccaagggaatagag

SEQ ID NO: 136596 - DNA, 376 bp, Homo sapiens
tgaggggaaaggtatgtgtttgcatcttctgttagcgatttctgggattctgaatcttcactgtcacttagttctgtgcagttgtgggagatatacccagaagacacaggcaaatacaacctgggtaactagctaggggtttgttcccaagtccctatcttatatgtcctggcgagctgccctaaactacgtgtgaggaataaagactgtgttctttcagctcagacctgtgattcttgagtgttttaagagtcttttaaaatctatgaaccctctttccagcaagtcgtaaatgtacagaatagttttgtgtaggttttcagggaattcatgaataccactaaagctgttccagtagactgtattgggagtctta

SEQ ID NO: 136597 - DNA, 428 bp, Homo sapiens
gtcgaccatccagatacacctaaggtattagtaaagcggtgcattaagctgaaatatctggcttgtgcaaacttggggcatttgtaccttatgtagaattccaaaatctgcttaggattttccctgtccactggactgccactggcagggtctgcttccctgttcctgggttgagggagcagcattggagcatccctcaattcctgaatgaggaagttagttaaaagggcaatgtgagctgtagggccacactcatctaacaggtgagcttaagtttccattgatggcagacctatcagatgtttcctcccattctcactacttgtattctgtcattttgctcttatcctcccaaaatcatgctaagatttttttttttttttataagacagagtctcactctgtcccaggttggagtgcagtgatgc

SEQ ID NO: 136598 - DNA, 509 bp, Homo sapiens
ctggatctttatttagtcacctccagccttgctgggacagggatctggggctaagctgctgtggtctcggcaccctctgtccccacttcccctcgaggacggctgtttgaatattgtctagtgtgggccatttacccccgtgggcaggaggaaggtaggagggacttcaaaggagacttcaagggcccccccactgcccttctaaccttgcagattcccctctcgggcctgtttcctcttctctcaaccagcgatgccaggctgaggctgtaggttcgagaatcacgtaggtaatgggcctggcacatagtaggctctcaagaaaaggttggagcctcttgaggagtctgcctgtgatggatgcggagcgcagacccagcgcagtgcggcgattcgcccaaggtcacacagccgccccccccaattcggaccccgggcggcctgactccgggggccggggcttgtcgggagccagcgtgggggcgagcagtgtttggaagagcggccgc

SEQ ID NO: 136599 - DNA, 305 bp, Homo sapiens
ttgtgctgaacccagggtacaactcatggcaatgaccaacaaacagggtctctttctatgcacacagaaacgtctctccttacacagtttgtttctttattcactgagaagacatggatgtgcgcagatatatcttattttttcttagagctgctagaacatttatttagcagatactttcttgtgagtggcagcagtcttcaacagtctaggtatccattgtgaacaaggtgagagccctgtacccatagagttcatatattcatcagcaagacataataaagcaatcagtgggtcgggcctag

SEQ ID NO: 136600 - DNA, 287 bp, Homo sapiens
ggaaactgaggcaggggtggggtgctgacttggccaggtcgccccacccccagcagtcctgaccccagacccccagctctcccagcgcacctgccgctcactccatggaggttatggcccgggtggggtacaggtaacatgaccaccaaaatcagcggtgacctggcctccaccctctggaagctagcgctccagaacccccagcccctccctgggtttcaaatcctgccttgccccttccaggcttccgtctgtgaagccaagtgactcttcccactctgtctaca

SEQ ID NO: 136601 - DNA, 393 bp, Homo sapiens
agacagggccaccgagtgaagaggagtgtcatttctgcatgggatgcaccaccccagacaggaccaccgagcacacacattgggcggttgctcagggtcacccaccgaggggcagaatagagcctggagccgctgtttgctcccagccacagacaccgggcaatgccgcctctcacactgtcctgaaagtggatgggtggctgtcagacttcagtggatctatcctcccactccccgacataagcaaaacttcctcccctccatgcttcctcagctctaacagttctcagcatcctctcagctgtgcaaactgaaaactgcttgtcattctcaggttaaaatgcatccaccattcctgtgacacctgccgccaatattctaggtcatcgtctc

SEQ ID NO: 136602 - DNA, 121 bp, Homo sapiens
aaatgaaaagctttcagaaagactccagcaaagcaaataaacatgattataagctcaaaaaaggctttatttcagatttaaagcatgctggctgtccttggagcttgtctttagacctttc

SEQ ID NO: 136603 - DNA, 453 bp, Homo sapiens
ctcatctgtaatatatggcaggacaaaaacgtctcttaaaaggggggtgaagagaatgaaatgaggtggctggcgtgaagtgcttccccagcacactgtctagcccagggcagacaaagagttcatccgagttcccttcccaatacaagcaggcaaccagctagaggtcaccaccccagcccactctcaaggagctcttccctcatgccaggcattaccacacacttgacacggattttccaattcaatctttacaatccctagtttttcaaatgaagtcaaagctcacaggggttaagtcacttttccaaggacccagggaactgggatttgaaccctgaccacctgcctctcaagactacattcctgaccctctctgccaaggtgtacattaaaggacgcatcttcctccacactggacgcagagcccagcttccggctaaggagtgtggg

SEQ ID NO: 136604 - DNA, 335 bp, Homo sapiens
caccatgttgcccaggctggtctcgaactcctgacctcaagtgatctgcccacctcggcctcccaaagtgctgggattacaggcgtgagccaccatgcctggcctgaaattcgctttaaattacctcaggcaaatacagaaatgtccatggcttgataagaggatgctgaggcagcaagatgctgagatctcaggatctgggtgataggcggctggaagggctctgtgctatcctttcttcctgtggttgaaaatgttcataatttaaagaaggatgttaaggttcggagtgtaggacttccgaaaacattgcatctccagtgggcattatggag

SEQ ID NO: 136605 - DNA, 343 bp, Homo sapiens
agtactgtgatcctcacgtggtggtgacggggaggcagacattgagaactgaagggctccctttgatcattagccttacataggatgcctttaatgttgagctagattggaagcccaagtgactgctgaagtgcaccaaattaactcagaagtcaccaatttcactccatttatggaagggtattaacagggggttgagaaacaatttaaggaaatgttaaataatgtattatttccaaatcactgcatcatataattaacatcctacctgttgttagcaattatttataggtcatacagtataccaaaatcagccaaagcaataaatcacccagaataaggc

SEQ ID NO: 136606 - DNA, 217 bp, Homo sapiens
gatcctcccgcctcaacctcccaaagtgttaggattacaggcgtgagtcactgcatctggccaattggatacattcctgcagccaaattttaaattcttcctattgtgctatagtatggatgtgccttaatgtatttgacccaccccttattattgggcttattattgaacttatttccagcttaagtgatagaaacagtgctgtacatcctcctag

SEQ ID NO: 136607 - DNA, 578 bp, Homo sapiens
caaggctgcagtgaactatgattgtgccactgtactccagcctggccaacagagcaagacactgtctctaaacaaacaaaagaaacaaaagctcatctagagcttctacaatttcttatgcacaatggcattcaatcaaaaattgccaggtatacccagagtcagaagaaaaaagtggacaatagaagcaggcccacaggcctttcagatataaaagctatgaatcatggattctaaaataattgaataatatggtcaaggaaatatataacattcataagaaaatgtgaattattttcaataatcatttatgcttatttaaaaattttcctggagtttattttcttgtttgtctagggtctcaaatataccatctaatttatggaacttcccttttctttggcattacaattctggatagttattaactttgaggggtgggactggattagagaaaaggtactggctccatagcaagctagaaacttctctatagaaaagttatctgcagaggatgatattgctttgcttctgatatgctttggctgtgtccccacccaaatctcacctcaaattgt

SEQ ID NO: 136608 - DNA, 679 bp, Homo sapiens
gatgattttccaaatataagtacatactgcttcactctagcaattatcttaaggtaatttgaaagcaaacagtacatatgcaatcgctggacggcggctaacaaagaggcctctaaattgtttaaaaaggattaaaggcttttctacacactcacaaaacaattattgatgacgaaaactttagggtagagggactgtttggcagaagactgcatttaactttgaataatatcctgcaatgaatcaatacatttaactcccggctagtccacctcttcgttttccccccttgccttcccaccaacataaaactattcaataagaacacttgagcccggaaagttcaaatgctgcgtagacctacaaatacctttcgaatacaagacaggctttaaaaatagattttcactaagtttgtgcagaaattaagctctgctcaaatcaaatgcaaaagccaatcccttcagcaaacccatctacatacatcacatttcttacgtgcatcttcaacctgatcaaatatcttgtcttacaatttttttaggccaagtaacaaacggtagattaattcccgctaattttatcctctctttaagaagaatccattctatatagcattgtgtaaaaatgcagagcagacgaagcagtcctgttaaggacaggtttatatatatatacg

SEQ ID NO: 136609 - DNA, 417 bp, Homo sapiens
tttttgtagagatgggatctcacagtgttgtccaggctggtctcaaactcctggactcaagtgatcctcccaccttgacctcccaaagtgctgggattacagatgtaaactacagtgtctggcctttttttttcctttttaaagctactggccaccaaagcctgtctgtggtccctaggtcccagtttttccttgcactattggcagagaaggctgtccttgagagtgggcactcccacacatgctgctagtggtgccacagtgaggcctaggcctgcagctcccgggaccacttagctcccacggtggctcccgcagtcttcagggccctgcacagcctctcacagtggccatcctggcttccccaccactcccatttgtcattgttatgccataactatggtctatccactctac

SEQ ID NO: 136610 - DNA, 749 bp, Homo sapiens
agtgtagttgagtgttttgtagacgcaattgaatgtgaaaacacaaaacacaatatccaaaaaatgctgacaacacagtacactatagaatattggttaattaccctcatgatcgcatagctcactgggagctgggacttattaatacctccatgctcagcatcagaagagagtattgtaccacatattactagcctgggaaaatatcaaatatcagaattccaagtatggttcctactgaatgcatatcacttttgcagcattgtaaagttgaaaaatcctaaattgaacctttgtaagtcagggactatctgtatatttttaaaggcattttaagattagcaggtggtaaaattaaaactgcaaaaacaaaaacacaatcaaaaacaaaacaacaaaactttgtcgcggggcgcgccctgggcccctccagagaaatctttctctaacacccttcgcgttgtgggcggcgcgcgggcgcccccgtgtggtctcactgcgcaacccgtgtggccatatcagacttgtgtttccccaagagagaagaccctgtgggaccatacaactatcgggtgcttggattttctctccccattaaaaaagagccgcccgggggggaaacccagacgttgtcccttggaaaaacattcccacaattggaggcctccaggaggggctacatcacgggggacttctttcacacacgggggggctctcgaggcaaccctcatattatcaatttacgccag

SEQ ID NO: 136611 - DNA, 526 bp, Homo sapiens
ttaattctcaactgggatgaagacatcttaatgttaggatacatgggtggttgtccatattccttgcagtatatgctcctcttaactagaatccttagtgtattctttccaccaaagtagtggaggtatgttcacataatctgctattgaactgcaaaaacttttacagtttcagagtttgagggaacccaaataggaaaattgatggagtcattttcctctgctggtgttcaagtcagatttgaaactcagacactctcagatctgttcaacagtcagtaaaaagtgcatttttacatagtgtttccctttagttttgcctaccctcttgattttgtacaatctagaatgtatgtaactcatgcgtaggtgatggaggcgctttttttcttagaatacttacaattatatatttggttttgctttgactagcaataggaaaatagacaaatacaagtgtaaaaatgagaaattttaaactcaaattataatttgtgttttatagtcgtttcataagtctgttgct

SEQ ID NO: 136612 - DNA, 512 bp, Homo sapiens
gtctttggacatgctgtcttgtgtggctgagacgtagatcaagagaaatttgtaagaaagacaataaggtacaaaaatcgccgaagctaatgtcaagatggagataaatagatctatatttgccatatatggtagtaaaagaaaagtctgtgcaaatttgctcgacatttatggacttctatgattcatctaccagggccagcagctccagccaagagatatagaatgtcttcaactgtatttctttcctaaattgtttcattacaaagaagccatgttgtgtattcagaagaaaattccaggaccgcatgaaagtcactatttgggaacaggcctgagaaagcttgcttagaggaattccaaaagtattcaaaaggcagttattgaccaaacacataataattctctaagcatcaacaattttccatagatccaagctcacatatacagcgtattttctgtggctagtcactccagaaatagagggttctctgctttcttgactgattgac

SEQ ID NO: 136613 - DNA, 874 bp, Homo sapiens
cttcctatattgtttgacctcatggatacagttttctcttacttagttgtatgtgagggatcagagaagttcagaggtagaagggactcacttaatagcacgctctattttgcagttagggaagtcgagtccagagagaagatgatgttcatggagagaaccgaagccagaaggggaaccagagcgcgtgccttagtgcctccctggcgttcttcccagcattgcttgttgcctcctggacagataagcacctccgtcttcattgatgacttgggggccaggcacggtgctggactgtagtgctaccaaaaaggactgatgagctatagtccgtgggcttggccctgccctgctcctggttttgtatgacctgcaagctcagaatggattttacatttcctgattttggaaaaagaaaaaaatcgggaggaatatttactaacgtgaaaatataagaaattaagatttctgtgttcacacataaagttttcttggaacacagctaaccatccattactatgaatgaatggagctatccattcatttacttccaccaccaatcccggctaatttttgtatttttagtagagacagggtttcaccacgttggccaggctggtctcaaactcctgacctcaagtgatccacctgccttggcctcatgcctggataatttagaaaaaaacaaaaaaaagaaaaaaaaaacgtgttggggacggcattagggccctagaggaggttgtagaacacactcgtggggccggggccaaggaggatagtgacacggtgcaaacgggtccaaggaaacaccggcagagcacagggcgggatctcagcaataaaaaagccgggggcacgacgctcggagacaagc

SEQ ID NO: 136614 - DNA, 529 bp, Homo sapiens
aagaatcggcgtcaagaacacaggtcgatagcctcttgctagctgatactatcactctgctattcaatacaattattggtataatgcatagttatgagatcttattttacatttacttaaaagtgtccttcactgctcctaggtctacttttcagtattatttaattctaagctttgatgaaagggtgtggttagcactgacgtaaagttttgttgagaactatgttcctcaaatatgagtatacttaagaagtcttctcttaaaccattacatcactaaactacaaatacttataagcagtcatcatccaattcaggatggcaatttatagtatagttctgtcagctacacccacttaccacaggcagagagcacaaatgaattattaatcagtttgtatcttgatgcactgtgcaaaataatcttaccatacaaacgtgccttttcccaagcctctttgctaggatttctcaggtctaaattagcatcagcaaatttcctctctgagggccaaggctatcaattcaa

SEQ ID NO: 136615 - DNA, 799 bp, Homo sapiens
tgtcaaagaaccacgtagaaaaatctaaaactagaaactacaggaccacaacattacatactcattagaaattcactgaaaattcattaaagacagtgagtcaaccatagctagtgagatgattaagagccaggttatatatataggtatgtggttctatacctatatataggtatagaatataggtatagctatattctatatagctatagatagatatagatatagctatagcatatattctacatacctatagaatatagattctatattctaggaaattacctcaaatacagcaaagagggttaaagagatggcaaatatgagaaattcagatggaaaatagagttagaaggcccaatatacatttctggaatgagaattgcagaaagaaagattcaagggaatagaaaagatgcagtctccagagagaaaatgagtaggaattttaaaagtggatgaaagatatgaatcctcatactgaagaaacgtaccaaattccaagctgcataaactcagataaaaacctcatctagacacgtcgaggtaaaactatggaatataaagcacaaaaagaaaaatctcaaaaggtaaaaagacagattgcctttgaaaaattaagataggaaaaaaactttttcacaaggagaaatttgtaatggtcactgtatctttgttatagcagaaaatgaaaacctcttaaatgtatacatatatgagattgactaaataaactgtaatttatgtttatatagtgggatatatagcagttaatatgaatgaacgaactatgcatata

SEQ ID NO: 136616 - DNA, 415 bp, Homo sapiens
tctgcccagtaggaaggagtctatgatatcatcatcaagagatgtttcttcaaaggctgcagctcttccaaaaacacctagactgtaagatccatgagagaagggaagactgtagctatattattcattgctacatctccaattcctagcatagcacctggtacatagcaggccctcaataaatatctgtgataaatttccccaccttgcagaggtcctttttctgcatgtaacaatgcttagattagaatgttccactcccagatcttcccacaactggtgccttctcatctttctggttatcaggctcaactgtcacctcccaaaagaggcctcttctgatccccctgtctactacagtggccactcccaccctctctttcacactgttttatttccttcacagcatgaatca

SEQ ID NO: 136617 - DNA, 225 bp, Homo sapiens
ccccgaaattacaaccatttgccaaaaataccaaaattgtgaccattttgctacattgcccccctccaactgaggcatctgagagtttcttataaacatcatggcactggagccctaaactcgcccacagacacctgagagcacagccgtcttcctcagtcccccccgggcagggtgcgctgccgtcctcccagtccgcccccaccgggcagggtgcgctgccgt

SEQ ID NO: 136618 - DNA, 458 bp, Homo sapiens
ggaggtacctatgggcttggccttgccccatgcatgaaggtgagacagcagattagcaatgattccacaccaagtgtcactgtactaactgctctttcacactctggaacttccttctctttacctacaccaccttcatacatgatctgaccatccctgcggttttagacgccacctaagtgttaatgactccctggtccaccagcaccttccttgccctgaattttctacaatatatgttgataggctggagcttgaaagacacagacatgaagagtcagccactagcaccccactcctcaccacaaacagatgaggctaatagatgatagaaacctctccctatcagctggggtgaagcctcatagtgttttcagagcactctagacagttacaaccaaccaatcataattgacacatgagctgaattatatttgctatccctagaggaataggta

SEQ ID NO: 136619 - DNA, 424 bp, Homo sapiens
actcctggccaaagtattgggattacaggtgtgagccaccacacccagccagggtatcattattaagtgtagtaagattgatggtgccagcactggctggtgttgacttgaagactcactgaaagactgggactggcagccatgatgcataagggcagaatagcctgggggttgtactgcccagtgatacttggggaaaggttcaagatctggatttgactcttgtgccaagcttccaagaaacctaggttcagaggtaagagcacctttcctatcagctgcctctgtggggacatctgacactttcaacatccacccccttgaaatactcttccctttgattctgtgacaattatctcccaggttttcttcttcttcactcgctgttccttttcaaagattctccaagagctctttttctact

SEQ ID NO: 136620 - DNA, 148 bp, Homo sapiens
tgcggttagcgactctgaggatcccgggttcctttgtctgaatatataaccagagactacttaaacaagaagaacctaaaatgtagtgaattaagaaatttattttcccatgagcagagtgagagcccattagaggtcaagggaaata

SEQ ID NO: 136621 - DNA, 193 bp, Homo sapiens
aagtgctgagattataggcttgaaccactgtgtctggcctaaaaaaattttgttttaaattatttttgtctcctatggtcttgtctgaaatcaatactatgagttgaatttgtggagaaaaacttactctagaaaagtatagcataggtgacatcagggttacaaataagtattagaatatcagttctagtca

SEQ ID NO: 136622 - DNA, 750 bp, Homo sapiens
tactatctttacaacactgataggaatcaggaaatatttcctttattaaaaactcacagatgggactattagctagtctgtcctgcttatttcacagatggggatttcagggaccagaacaaggaagcttctttactcttgctataccataaaactgataccaattatgtttatgtgatataaaagtagtacatgttaattctaaacattttgacaagttcaaacatacataaaggagccaacaaccacatgaaaagataacttgaagaatcattaaatgtaaatcaaaaccacaatgaggtattacctcaaacgtatgaggacagctaatataaagcaaagcagaaaccagaaactaccaaacggtgagtatgtggagaaactggaacccttgtgtgctgttagcgggcttgtaaaatggtgcaactgctatggaataatatgacagttcttccaaaaattaaaaatagaatcacggcatgatctagtcattttacttctgggtatatatccaagagaattgaaagcagggtctggaagaggtatctgcatgcccttgtttatagacgcaaaacccaaatgtccatcagggtattaatggacaaacaaaataagaaatggaatcttacccaatcttaaaacaggaaggtaatctgtcacattctacaacatggatgaacctcgaggacattatttttagtaaaacattccagtcacaaaaaatcaaatgctgtatgatttcactaatat

SEQ ID NO: 136623 - DNA, 413 bp, Homo sapiens
ttagtggctcatgcctgtaatcctaacactttgggaggccaagaagggaagattgcttgagcctaggcatatgagactagcctgggcaatgtagtgagaccccgtgtttacaagaaataaaaataaacctggcactagcgtgaacctgtagtcccagctacacaggtggcggaggcaggaggatcccttgatcctaggaggttgaggctgtaatgagccgtgttcacaccactgcaattcagcctggatgacagagtgagaccatctcaaaaataaataaataaataaaaagaaaatccaagatgagtggtttcgaactatgccagattctatgtgtgcgtgtgagtggttccctgatcttctgttccttgtagctttgggaattaattgtggatctgtgcctgggctttcag

SEQ ID NO: 136624 - DNA, 237 bp, Homo sapiens
aaaaaaaacagaaaaacaaccaataatcactcttgcacacactcacacagaagctgacctgagtcttgtccagaatgattcatttgtgaaaagcttatcaaagaagtaacataccaacactgcccattccctagccatccatgtgaagggacgctgacaaaaatctaacacaggagttcttaaacttcagtgtgctggagattttaagatccaaccacggagattttgattttgatg

SEQ ID NO: 136625 - DNA, 1006 bp, Homo sapiens
aaaaaaaaagaaaagaaaagaaaagaaaaggaaaaaaaatgaaaaagaagccattgaataccctattgaccataagaaaaagcagggcaaagctggtcaacggcaacccagacactgaaggaaaaagaacatggagaatgacaaaagcccagagggaggagtaaaaggacacaaacaccattctcagggaccaggactgggcgccgttttcagggaccaggactgggcactaatcacagaactgtaacaggcgccccatgggaatgaccaactgttagacggggcctgcagggcagcacttccctcttgcctcccaccaaagcttctaaagggaaatgtcgactgttttcacagcagtcccctcactgcggctgagtttgtgggctcagatgatagctcacaacaacctgattcagtccccactgtggctgtgtgtggggggtcagatgacaggccaccacaacctgattcagtcctcactgcagctgagtgtgtgtgggtgcagatgacaagccaccacaacctgattcaggattcagttgggctactagccagtgccataaggaaaaccattctggggctcttgagaggggcaaagcataatttgcatgtgggagaaacgttaatagtttgtggccagaggacaagctgtggtttattaaagactgctgcaggttcctactatgcttctcatcaagaggtggaatctaatcacctttcccccttgaatcatggctggtctcagtgatgagtacaactggacagtgtggcaggagagatgctctgggacttctgagggatgatcatgagagaccttacagcttctgcctgggcctcttggacacacaccctgggagaagccagacaaacctgactacctgatgctaccagactggaaggaagtccgtgctggccacaaagagagggctgggtgcctgctccgtgtccccagccactagagtccttctgggtgcctgcttcacgtccccagccactagagtccttc

SEQ ID NO: 136626 - DNA, 330 bp, Homo sapiens
gcaagaccccctcttcccatagcctcctgatcagggtagtggctctgaacttggcattgaactgaactgaagaggaggaaaagacggatctcccagaactgtctgagaagcagcgaggtgcagtgggcagagtcctgggccagggcaggagtgaggcagggtagcctgtttcaccccattttacagaggaggaaacctgaggcttagagagctagcacccagcatcacatcacagtgctgcttcctgtttctcatgcatgtggcctgagcaaggtgcctccctcctggtgcccttgtttcttcctccgtgaaatcagggtgaaaattctt

SEQ ID NO: 136627 - DNA, 265 bp, Homo sapiens
ggcggccattcctttcttttctcaaaatgttactctacttagtgaagtataggactatgataacagcagagacaagatgccgggtagaaacttttttaatttttttgaatggtaatcatgggtccgataactgttatagttgtttcttaatttttttctctgttgtatctccattctgctattgagttcacccattgagttttttacttagttattgtaatttctagttctaaaattacaatgtagttcttccgtatatcttcaa

SEQ ID NO: 136628 - DNA, 823 bp, Homo sapiens
ggtttcatcatattggccagaatggtctctaactcctgacctcagatgatccacccgccttggcctcccaaagtgctgggattacaggcatgagccactgctcccagcctggttttcattatgcaaatacctgctaggtcagaccttaccctggcaggcacagtagctttttcagttatttcaaaatttaatatttattattttccctgaaaaatcagttttctaaaatttgggtcacaagttgttatttgagttcatgactaattggtagtcaatatgaagtcaaaacaaaattttactaactagactacatagaaaatacaaaaagtttacatctgagcacttttcagcagggggaaaccattactttgtcacatctggatattctaagctagccaaattgaagtgggaatttcctgccagatgttagttctttgagcaacctgtgaacatctaagtaagtgaggggttatgagtccttgtttggtagagctatacccactctggaggcttgctcctaacaggcagcagacattttatatgtactaccaccagtcaggaggttgtgcaacctatttgaagtcaatatgatgtgctcttgttaaatgtcaaaacatccaaggcctcattttgaatgtacaacatcagtcttacagatattatatccagggtgaacattgcattgaaatgtcctcccaaatgtagatgacaaaaattttgtttcattaatagaaagaaggtaagactgaaacaccacaggtattccagataacttggatagggccattttgtaaagtcagtgtagaccaaaatatgtctctaa

SEQ ID NO: 136629 - DNA, 376 bp, Homo sapiens
gtcccgccccggggctgggtggcatttcctattgtagaagctgatgggatgtgacctgggtgctcacttggctctgcaacctgtgactgggagcccgcaggcctgtgacctcagtttccccatctcaatcctaaaagcctcctcatcctcttttcccctttaaatggggcttcccacagcgataggattttaggtagtgggtgtctcagtccccgtaatttggaagtagagctaaaatgaggtatgtgtctgtgagacaaaggcaagatggggtttgggcagaaggagggagtgggcactgctgcctctgagaggaaggtggttggtgctacagccagagcaagacctagagaacttggtctcctgcctcacttca

SEQ ID NO: 136630 - DNA, 708 bp, Homo sapiens
tggtaacttgaaatctgggtcattctcgttttgtgaagtatggagtagataaccaaatgactttaaaaaataatactcattaaaactcaaagagggtctatggaccacctggtaattttctttccatctcactgtatgaaatttatcatctgtagccaagttaatttttaggatttgggggctcaatattgaaatatttttgaaggttataggaagtaatggcttgtatagcttactcttttaaaaattttgatattaaattattactttaaaaaaggtattgtctgagccctgtttgttaaacttcgctgtggtataaatctcttgaaacaaaagatatacattatgtattttgaaatgggaggtacatccatagtttacaaataatttgctaaatcaaaactgctttgagctaatgacagatttcctatgttgattgaaaggtaaaatgtttatttaagaaatctattgtacaacaaggttactgtagttaatgatacaatgtattcttgaaaaatgcaaagggtggatgttaatgttctcaccacagtgataactgaggtaatacgtttgttaattggttgaatttaaacattggacagtgtatatatgtcaaaacatcgtgttgcacatggtaatgtacactattatctgtcactttttaaaaagttaaaaaaaattaatgttatagatcctgtaaggtaacag

SEQ ID NO: 136631 - DNA, 383 bp, Homo sapiens
ctgattctgattctgtggactgtaatgaagatatgtaatggtcccagtgttttgagtcagtagaatatttatgaacagtttataggtgaagctgaagcctctatagcttggcctgtcttcgtaggaaaccctggcatcatatctcagcaaggctagaggggactctcagcttcgccttgccctcctctttcctcactggtgtaatgcgtatattaatttgtcttcaggtaaaactggactaagaggggaaatgactaagaggggaaatgacatagaggtcttggagtgaggagagagaaaaaaaaggtctttgtaaaaaaatttcctgttgatttttaatgacctccaaacctagaattttaaacttgtgttcctttggaaaa

SEQ ID NO: 136632 - DNA, 331 bp, Homo sapiens
gattttcagggacaatgtaagatcaacagagggcaaatataagccttagaggcacaaacatttagaagataagaagaagaggaatcctaaaaaacaaaggtgagaagatgtagaaaggagaagaaaatcaaggggaggacacagtttttaacaatgttgaattttgcagagatgaagtaaataaagactgaataacactaattggatttagcaactagtatgatgctggtggctgctactgggaccatttataatttcttcctgggaattatatttttcttttttttttcctcaatatttcttctgtgacttcatatactctatgcctata

SEQ ID NO: 136633 - DNA, 157 bp, Homo sapiens
cagggagatgggtttttcctttcacatgctaatcacctgctcctggtgatatttctctccttgactgcagtcttggaattgaataatttatggaatgaattttgttgtaaatttactgtgtcacaagcaggttgtaatttcactaacagttcactta

SEQ ID NO: 136634 - DNA, 556 bp, Homo sapiens
atctcaggatcccttcagccaatcagaacaacaattaattggtctaccttcatccaatttattgcaagacttattaggcttggctccacatctcttactttggtgttaatcaaaagtgtcactctgagcccacgattaacaggaagtcttcttttgaaaggaccatttagaaaagaaaaccaaatggttgggcatgattgctcacccctgtaatcccagcactttgggaggccaaggcgggcagatcacatgaaccggggaggttgtagggagctgagatcacaccactgcactccagcctgggcaacagagcgagactctgtctcagtaaacaaacaaacaaacaaacaaacaaacaaacaaaggcatatttagaagaaatgtgacaaggagtacaggccagacctctggatctgtagcaaggtacaacatgggtatgtttttactatttgtgtggcaccttagtgctctgtggtaggttgtaagtgctcagtaaatgtttatggtggctattatcattactagtattatttagaattcaatgggaaaggttagt

SEQ ID NO: 136635 - DNA, 140 bp, Homo sapiens
aagggagggggtgaagaatcagagatgagtaaggcctagagtctgagagagtagaatatagaaaaatacattaaacaggaaaaagagaatgttgtagaaggtgatagcaggttctgttttaagcatttgagttaagattg

SEQ ID NO: 136636 - DNA, 366 bp, Homo sapiens
gtttcgcttttgttgcccaggctggagtgcaatggcgcaatctctggctcactgcaacctctgccacctgggttcaagcgattctcctgcctcagcctcctgagtagctggaattacaggcatccactaccatgcccagctaatttttgtatttttagtagagacggggtttcaccatgttggtcaggctggtcttgaactcccaacctcaggtgatctgcccaccttggcctcccaatgtgctgggattacaggcgtgagccactgtgcccagccacactatgattttaataccacattggtagacctgcaatcccccagagaaggaacatcctgggatgtacttagagacctgagcaagccagg

SEQ ID NO: 136637 - DNA, 359 bp, Homo sapiens
atgtttgtagcctagaagtagcaagttaagggaagtgttgtcatgtagcttctgttttctcattaagctaggaagcaaatctgttaaggttgagtggaatttggcttggtagatggtttaggaagacagtgaagattttcactcgtgaaggaaatggagaaagatgcttgttagagatatgttggattgctaggcagaaatgaacttcaactgaggttgaagaccaataattagtagtgatgtgtgtgtgtgtgtgtgtgtgtgtgtgtgtggggcagaaaaagacggaacacttgcgcttgtgtgtagactgataataagtaattgctataattggaggacacagtagagagagcgcc

SEQ ID NO: 136638 - DNA, 965 bp, Homo sapiens
cttaagatcatctttaattcactcactaatgactgagggtctttctgctctccaagtaatcgggtgatgtatgagccgatagtacaccttgtggcagaggtgaaaatcattcaggcaatgcaaatattgtcacgggaacaaatgttttccctgttaataaaaattaatgaattctacccaggagctagttaaggaagctgtggcgaaggaaatccaaacacaaataacttcttactgttaaaaatcacttatgtattttttctagatatagaaaaagaccatcattgctgcatatttccataagagatgaaataatgacaaactatagaaatgcactatgttgtttttaaattatctttttcaggttcttgagtttatttaaaattgtgaactttggcatcttatttgttttaaccttggttaaactacaggcttcccatactgtactagcctaatgaatacattcctcttttcatagcctagttaggaccaagaattatagtggtcagggtttataactataaaatgatgtaatgaagtttaaatttgagaaactccttgtaacacatcataaaagattgatgaaacagactggagattaataagtggttcaaatagttttgagagaaaaaacaacaaaaacatttaacactatcattatatttattgaattctttaaaaataaaaacatctcctctcttaaaaatttgcctcacatcattaaagctttttccttactacatctacctcaaccccagttcattttgtaagacaataaatgtacaatgttgtgaggtgtgcctgctctttatgtacagacacttgctatagaaataaatctgctgtctttttgtttcattttgatagtccatgattctttcttctaatgaccaaaattcattgtctcaatggaataaatatttctgaaatagctcccagtccttcccctatcatttacatcttag

SEQ ID NO: 136639 - DNA, 614 bp, Homo sapiens
acattacctccaccccctcagcaaccccccaagagaggagactgggaggggtatacaaagcccagctccctaaatcccaaattcaggagaaaatgggctggtgctgatggtttacaaacggggaaaccgaggctaaggactctacataaggtcactgtgtttgtggcaaagccaagaggaactggatccgtgctcagtgcaacacctcagggctcaacatcccctcccgactccccctatcagtcatcccccagccttctccgctccgcctgggataagcatatctctcccgagactgaagagagcctccaagccaggtaccccggcatggcccagagcctactcagacctgcacgccacgatggggttcagggatagggcgtcctgggctcgtctgggttaagccaggcgagcagagctggctcccgccccgagaaacgcggccagctctggggcacaggccccagaacggcaggaacagccgccatcacctcgggcctggagcgggcagcgggcctggagcgggcagtgggcggcgcgggaggtagccgggcctaattagtcggcctgggacccgggcgggcgccggggcggcagacgcggccgcagagccg

SEQ ID NO: 136640 - DNA, 539 bp, Homo sapiens
tgaaggtgctgacagtgctgaatctatgtatagtatattcaaatctttttaactatagaggttaagatgcatccattctaaagtgaggaagacaaattttccaacttgtctaatcatggaaatcttgctcaggaggtggaactacattattaaatcagagaatgtggatgggacagtagcaggagatagggtagtctgtgagaataaatttgtaaactggtcatcaaaagtttcctgaacactgcttcttggtcaggacttcatacatagcagagcaacttcactgctttctttggttcgttcgtatttatttatctagagataaggtctcactctgtcgccaggctggagtccaggtgcgtgatctttgctcactgcaacctctgcctcctgggctcaagcgatcctcccacctcagcctcctaagtagctaggactacaggcgtgtaccagcacacctggctgatttttaaatttttttgtacagatggggtttcgccatgttgccaaggccgatctgggactcctgggctcaaatg

SEQ ID NO: 136641 - DNA, 418 bp, Homo sapiens
gcaatttttaatagggattacattgaatctataaattgctttgggttgtatggtcattttgacaatattaactgttctaatccatgagcatggcatgtcttttgatttttatgccctcttcaatttttttcatcagtgttttgcagttttaattgtagagattatttacctccttggttaaatttattcctaagtattttattattttatttaagctattataaatgggatttccttctccagttccttttcagctagcttgtttttggtaaataggaatgctactgatttttttgtatgttaatttttatatcctgcaactttattaaactcatttcttagtcataagagttttttgtgaagtcttcaggtttttctatatgtaagattatctcatttacaaggagggataagttga

SEQ ID NO: 136642 - DNA, 591 bp, Homo sapiens
gcgcttatgaaattatatgagcagagacactgccagtttgaactgtagtggatggaaacaggatgaaaggaaggagagaggctgttggacttcttagctttgaccagctgggatgatggagctgtttggccactaacatgcactattcttcaagaagaaagaaaaataaccttgaaagtgattcagagatcattaggtccacctcctcagtttcagcaggccagatggcctttgcacagagccttgtgggcagagccatgggggcaggatccctgccagagttaggagggtgatgctgacaccccagtaggcctggaggacaggatatcaaaccaaagaagactccactcaagcctcaaaattcaatggaattttctttgcgagatttgggatttgcttggaacctgtcaccactttcgtacttccagtgtctcctttttggaatgggaatgtctattctatgcctgtcccacaattgtattttggaagcacataacttctctagtttcacaggttcacagctggagagcagttttgcttcaggatgaattgtacctcaggtcccatccatactggatttaggtgacaatt

SEQ ID NO: 136643 - DNA, 998 bp, Homo sapiens
cggcaagggcggccctcgcgcacctggctgccagcccgcagggggctcgcacgcagacctgcccttgccacctcagcgctcgggtgcgggctgggggcggtggagccacgaaaggtggtgccgagagcggagcgcaggacagcgcaggagccccggcgcatcgcggcgcgcacagacccaggatttgtgaagaggtgacccaaatttcaagacaatgttggatgcaaacggatttgccagcaattgcatcactgtcaaaaccagctctgcccgtgtcttccgaagataccaagtgaaatacatgtagatgggatttacatctgaaaaaccaaggcaagaggccatgggaagggacggaggtggaacaggactggacagaagctgataaatggttgttgctgagtactgggcagataggggttggttatcctattgtctttactttcatatattttattttttctgtaataaaacaaattaaaatcacctgtcgtgacctcacaggggccagtgtgggttgtggcgtgaggcaggaagctctgcagagttccttggtcaaaaggattaattacagaagaactccacgaacaccgagaagaagagaagggaatcctggcatttaaagccacaaagaaacttgatatggtcttgtctccttctctcaattgacagtgagaaactgaagaccagagagggtgagtggtttacccagtttggcacaactgaccccaacctagccctccatgaggactgagcgcatgagagatcctgagccacagccgcccagccctgctcctctcgaatttctgacctacaggaactgcaagaagtaatgaaagactgctgtttaaagccactgcattttggcatgatttgttatgcagtcgtagataaccagaaaacatcggatttacattttaaggaaacagagaagcaaagaagttagcaagcttgttttggcagaagaaaaaacacaaaatacccaaccacagatcctc

SEQ ID NO: 136644 - DNA, 659 bp, Homo sapiens
cggcaagggcggccctcgcgcacctggctgccagcccgcagggggctcgcacgcagacctgcccttgccacctcagcgctcgggtgcgggctgggggcggtggagccacgaaaggtggtgccgagagcggagcgcaggacagcgcaggagccccggcgcatcgcggcgcgcacagacccaggatttgtgaagaggtgacccaaatttcaagacaatgttggatgcaaacggatttgccagcaattgcatcactgtcaaaaccagctctgcccgtgtcttccgaagataccaagtgaaatacatgtagatgggatttacatctgaaaaaccaagtgagaaactgaagaccagagagggtgagtggtttacccagtttggcacaactgaccccaacctagccctccatgaggactgagcgcatgagagatcctgagccacagccgcccagccctgctcctctcgaatttctgacctacaggaactgcaagaagtaatgaaagactgctgtttaaagccactgcattttggcatgatttgttatgcagtcgtagataaccagaaaacatcggatttacattttaaggaaacagagaagcaaagaagttagcaagcttgttttggcagaagaaaaaacacaaaatacccaaccacagatcctc

SEQ ID NO: 136645 - DNA, 131 bp, Homo sapiens
gagggggtgctgctgaaatagggtgagtgacacccactcggacatggctaccatttacacagaaatggagcagtttctgggtgtaagtttcttaagagaggctgcctggtaccagcccctgcagactagtt

SEQ ID NO: 136646 - DNA, 298 bp, Homo sapiens
agctgggattacaggcatgtgccagcatgcccagctaatttttgtatttttagtagagatgggatttcaccatcttggccaggctggtcttgaactcctgacctcaagtgatcagcctgcctcggcctcccaaagtggtggaattacaggcatgagccactgcgtccagccaagaagttcttagattactaaatttaagtaaaatgatttttactttaaaacaattttaatggctgataaggggaccttgtagaatttctgaggttatcaatggcattggagttctttgtgtcaggaa

SEQ ID NO: 136647 - DNA, 187 bp, Homo sapiens
tgagatcccatctctaaaaataatttaaagaccagcttaggccaggtacagtggcacacacctgtaatcccagctactcgggaggccaaggcaaaggaattgcttgagcctgggaggttgcagggagccaagactgcgccactgcattccacattccagcctgggcaacagagggagactctctctc

SEQ ID NO: 136648 - DNA, 489 bp, Homo sapiens
cgtcgctctgaggatcccctgtctcagtttcgggacgagagtaagaacaggaggccgattgtagatgccacagcatgggggtacatttcccaaggctgactggctgagaccacgtgaagcatgtctgagttgtgcaggctgcagacccttcttccttcactgcacatctctcccctggcatgaaagttttccttttcttccaggggccgttgtctttttgcattggaggttgtgggccttagccccagttgttgaggactttaggaggctttggtgctttccaagcctttgcttagggaaaggcagcttcctcacggcccttcctcatggcattccctctccctctccctcttcctccctaccttttcctcctccctcctctcctttgaccttgatcccctgagctttgtgtcaaggaggtcttcattaccgagttttcccctgagcgaggtttcaacagttctcattctggttggtctgtgatgtcaa

SEQ ID NO: 136649 - DNA, 744 bp, Homo sapiens
tgtttcattctataaaaatgatcagagttgatgggaaacccatgaaggtgaaacagatgtgtgtctttgcagaagacacagtgaaacagatgtgtgtctttgcagaagacacagtgaaacagatgtgtgtctttgcagacgaaagggagggcctgggggaacttggggtaaatacttttggtcacagagggcatcaccttgcccactgttgtgtcacaagacctaaatagaactacccaggtcagcaggcagcatggttcccctccctgctggcttgggaagcagtttgagcagagtaagaacaggaggccgattgtagatgccacagcatgggggtacatttcccaaggctgactggctgagaccacgtgaagcatgtctgagttgtgcaggctgcagacccttcttccttcactgcacatctctcccctggcatgaaagttttccttttcttccaggggccgttgtctttttgcattggaggttgtgggccttagccccagttgttgaggactttaggaggctttggtgctttccaagcctttgcttagggaaaggcagcttcctcacggcccttcctcatggcattccctctccctctccctcttcctccctaccttttcctcctccctcctctcctttgaccttgatcccctgagctttgtgtcaaggaggtcttcattaccgagttttcccctgagcgaggtttcaacagttctcattctggttggtctgtgatgtcaa

SEQ ID NO: 136650 - DNA, 150 bp, Homo sapiens
tctttgatctttaaaagagttggtcaatatgacgaagaaaaatatcaagaatattcctcaggataaggataaaaagaatggtgttgcagaagtggaagtgatcaaataacagagaaaggaagacaaatgaaccagctttgcctaagcagg

SEQ ID NO: 136651 - DNA, 316 bp, Homo sapiens
cgctcggtaccggtgtttatctgatgcactgtacgagtgtggggcacccccatgctcatttcaagcctcaggattgggacccgcagcccaccagctgaggcctgagcagggctgacccttttcaggcatggacttcagccctaacctgggaaggccccatggcaggtcacttgggcctcccagctgaaatcacatgcttcacgtgtaagcacaaggaggtgggctggtgggaaggcgggaaggcgagtggttcctgcaccgcccccaaccccccaacatccctcttctcaagggctcgccactccttggtgagcct

SEQ ID NO: 136652 - DNA, 539 bp, Homo sapiens
aacaaagttaatgagatgcctatgacattgcaatagtaggcacaatacaaacttcctacggattaattcaaagtgtttaaatttgattgtctcaaaatttagcatgaaactgccacaaaggaatccattttttttaagaggaacaagactcccattctaagaagctaatacttttcttaaacatttttcattactgtaatacagttgatatttctaaacttcatgagagtctagtctagttagaggactaaaggaattgataataaagacttctgactagaatgaaagcacaaaagaaaggatgagagaatgaagacaatggtagcctctcagaaaaagaagaaaaagagaggtgtacctaggacacagtaggcctgatcttagggactgagactcccagggcagaaaccagaaccagatcaagcacctggccttaacagcaatagaccagctgagaaacatcaccaagggggcccagctccttctatgaggggtcaggttcacactctgtatatgcggccgctaaagactgaatttga

SEQ ID NO: 136653 - DNA, 179 bp, Homo sapiens
ttggccaggctggtctcgaactcctgacctcaagtgatctgacctccttggccacccgaagtgctgggattacagctgactgagtgtctaccctgtccctggcactgtgcggggtgcaggagatacagtagtgtgtgggtcacagtccaggaggtaacatttaggcagagctctaaaag

SEQ ID NO: 136654 - DNA, 355 bp, Homo sapiens
gtgtgcctatagtctcagctactcagaaggatcacttgagcctgggaggtgaaggctgcagtgaaccaagatagcaccactgcactccagcctgggtgacaaagtgagaccctgtctcaaaaacaaaaacaaacaaaaacatgagactgggtagtttgtaaagaaaagaggtttaggccgggtgcagtggctcacgcctgtaatcccaacactctgggaggccaaattaggcaggcggatcacaaggtcaagagatcaagaccatcctggccaacatggtgaaaccacatctctactaaaaatacaaaaattagctgggcatggtggtgtgtggctgtagtcccagctactctgg

SEQ ID NO: 136655 - DNA, 303 bp, Homo sapiens
aaaaggccaatgaccttggtcctctctgaccaggccccaggtgagaactatgtcctaaggggcagtggccacaggatgtggtatttggctggaatgatgtaacctctgccctttgacatcgtcatgtaactgggttgtcagctagagccctaaataataaaatgcaaataaaaccctcatttcttgtaaaatgggaccccagccaacttcccaatctcaatgaggattcttgtaagtcagatatttccctgggtctcctcacattctgattttccgcttccactgaatcctggctctttctcc

SEQ ID NO: 136656 - DNA, 210 bp, Homo sapiens
ttattatttgttctcaatggcgggtgtctggcggggagtccagtcgcctgacgttgaatgcagtcatttcctaggtgtgggtcaagattctgatgtccacaggcaataatgtccgtgaacgtgtgtatgtaccttgatggacattactgactgtggactccagaacattggacattgtatatattgatggacatcatatatatatataca

SEQ ID NO: 136657 - DNA, 118 bp, Homo sapiens
tcacccaccagggatgtaccacattcagcttttacttttgcttttaggcactcaccttttagttacaaaatgtcagtcaactctcctctctctctggccctgctgtcaggacaagaca

SEQ ID NO: 136658 - DNA, 510 bp, Homo sapiens
aataaagttaggaactgtagggacatgttttctgctgtgtgaattggagaagccctagtctacagagagagagaagagtgaagatgaaggagggtcaaataaggcaatgtgatggctaattttatgtgtcaacttgattgggccattggatgcccagatatctggttaaacattatttctgggtgtgtctgtgagggtctttctggaaaaaattagtatttgagttggtggactgaataaagcagatggcactccccagtgtggatgggcatcatctaatccattgagggcccaaatagaacaaaacggtgaagaaagattgaattcacactgggtggctgcttgagctggaacatcagtcctctcctgcccttggtgctcctggttctcaggccttcagaccaaggctggaatctatacccttgactctctggctctcagtcctttgaactacacccagctttcctggatcttcagctaaaataaaaagaggagagaataaatagaaat

SEQ ID NO: 136659 - DNA, 282 bp, Homo sapiens
ggggcaagcccgccctctcttaggggcctttggtagcaacctatgtgagcctggccagagctcgagccctaaccctttcatgggaccccaggagggccccagcctgatcgccaaaaacagttcactattcctccctcgaattattctggcggccaaggtgctggaactgcttcagctcatttgcaagacatttgaccccatctgtttaaaaacctctgctttctctgtgggtttaagtggtcctgaccaggggtccccctccactcacccacagacacactt

SEQ ID NO: 136660 - DNA, 402 bp, Homo sapiens
cgtgagatacagtcggcgctgaaatgacaggcggctcatgtgttaatgccaagcaggttccatggatgtccccccatcatggtgttgggcgagaggcatgtggagaggccctgccaggcgacatttacatggcactggtcaagacctgtgcaaaactggtcactggggcaatggctggaacaagaggtgaggccgcgggcatctgaaatggcacacaggatacgccccctatggacagggatagctacagctctcgcctcataggttactgagaagactaaatgatttaatgtatgtgtttggaggagtgcccagctcttagcagtgaccatctacatggtggtaaccctgccctgacatcccgtctgcctagtggacacctcggaggcctgtcatgttcaa

SEQ ID NO: 136661 - DNA, 703 bp, Homo sapiens
gcaatcctcccacttcagcctcctgagtagctgggactacaggcacataccatcacacctagctaataattttttgtgtttttttaatagagacagtatttctccacattacccaggctagtctcaaattcctgggctcaagcaatctacctgcatcagccttccaaagttctgggattacagacatgagccactgtgcccagccacagttcattgttgaatcagaaagcataattggcagaaagacaaccttgttagttcttgtacctagaaaaacagtatagaaatggccagtcccaagaatgaccttatttagagaaaaggtctttgtaggtataattaaaaatctcaagataagaacatcctggatatctaggtgggtcctaatccaatgacaaatttcctcataagagacagaaaaagggaagacatagacatggaggagaaggccttgtgaagacagagacaatgattggagtaaagcagacacaagccagggaatgccaggagccaccagaaaaaacacaaaaaaaaaaaaaaaaaaattttgggcgccgacatgggaccgtcggaaagaggctcttgaacacaaagcgttgtggcgccggggggcccaggagggcagtagacaaggggcacagcagggcaccaaggagaacacggcgcacacaaaaagcgagaggagatccacacaaaaaaaaag

SEQ ID NO: 136662 - DNA, 297 bp, Homo sapiens
atgctgtgctaagaagttttaataccgtcttgaggccatgatagcacaaaggtgtgataatctacgtacccagagagatcaaagttagctttccacagaagctaagtttgaacagtaagtataggttggcccagcggatgacagtggaggagtacaccaagaagaacaagggaggtatatataaacagcaagttatggtcaagggatttcaggttttgtgcagtgtaactcaatcataaaaattgcagaagagatatgtgctggtccactggctcttagagtggtagtggtggggaa

SEQ ID NO: 136663 - DNA, 190 bp, Homo sapiens
tgttgaaattagataatcataaaaccactgaatttttctaaccacttgctcttctcccaaatctaaacccatcagttttctaactggaataaacattgatttaaaatactgtcctcaagccgggcacagtggctcactgtaatcccacctgggtaaagagtgaggctgtctgaaaaaataaaaataaaaa

SEQ ID NO: 136664 - DNA, 375 bp, Homo sapiens
aaagagaagcctcagggggaaaaactagctgggagagccccaggaaagcaacccaatacatttttatgaactacagggctcactcctggactacacatgtatggccttgatcctaagtagcacagatcactaccaaggtcacagattgaccactaggtggcgtgcacacacaggacagatctgaatactaccgcaaaggaaaatgaactaatgttaaaaccacaatgcacaggcagtggtttggaacttcagcttgaacctaaccaggtcaactgtctgctaaaaaatatcaacatccttcataggatttaaataagatccacagtctcaaatagtgtattttaataatacactattcaaaatgtccagatgcag

SEQ ID NO: 136665 - DNA, 462 bp, Homo sapiens
gatatcacatgaggaatatatcatgagagctctcttgtaatctgtgaggagtatggaaacaggatttgtcagtgtcgggctgtggatccataactaactgtcctttgtattgattgggctcactcttgccaagcctcatgctttgtttttgtagcagtgatagattcctgttaatctatccttgttttcttacctgatcccatgggtgaccacttgttaggcaagatttatttggcttaatcatactatctgtgtcctgaaaatagggcagtgcttcctggtttgggcagaaaccaaggcccagttgaactgctctagggaattttgctctaagctgatgccaccagtagtttaactgcacataacttcaaattgttttatcctagacattaattatatttcataattttatggtagattataaagtaaatcctaccatgagaataacttcatatttttatt

SEQ ID NO: 136666 - DNA, 407 bp, Homo sapiens
gtgagtactctaaggatcccgtgtcatccccctttgtgtgctctccccaagagcttcacagctagaaggggtggggcttgccccctgacaaatcctctgtggcacacacactcgggcaaagctcccttgggcacctgctccggtgccagcatccctggccctggcctcggtgagggcacagagggaagccccaagtaccactccccgatgtgagtgaatcctggtctaactctgagcaccaggcttgtgccaggtgccgtcacacccttcctcaccttcagtgcctaccttaacccgggaagtgactgctgctctcaccagggcgagggaggtaacacacttcacccaaggccacccacccacagctagttagtggcagagcctggatttgaacccaggtagtctga

SEQ ID NO: 136667 - DNA, 182 bp, Homo sapiens
gtgtaacaccaagctaggttcttggggtatattacttggcttaataatgcattcatttattcaggcagaaaacttatacttatcaaggactatgtgtcaggcccaggactgtaggcaggggttttgagggctgtcctcctcgactctgtcttcagcctctccttttccaatccaacctatgc

SEQ ID NO: 136668 - DNA, 262 bp, Homo sapiens
gcaccaaatggctcaggatgctctggtttcaaagcttataaaacagagggtgattcccttgggactcactcagctcggctccgaaaagcaaaggccagaaggcagcagtgagcctgggtccctgctgtgtagggagactcaggggctgggaagaaggatggaatcagaaatgctgaaggtttacgtgagctttgcaccgagcgcctccgaaccactgcctctgggctcaacagaacacaggggtaagtctccatgaacttct

SEQ ID NO: 136669 - DNA, 305 bp, Homo sapiens
gaaacttactgactacatttgtttgggacagggtataagagttagatgcatttgacatgataacaagaacgtctgtggagtggaaagctcaatggccttgaagtcaggaaacaaggttcatatcttggctctaccttgtgaagccacttaacctttctgggactcagtttcactaccacatgtaaaatgggtcaacacctaccacgcacagtgttattttataatgtatggaaacagttcctgactcatggtaggtaaacaatattaactaagtctgaatttcagaaaataattttctcttaaaa

SEQ ID NO: 136670 - DNA, 246 bp, Homo sapiens
ttgaggagcctgatcatggcccagaggccaaatcacgaggctgtgagcactgcctgaggagcctgacctttcccctgaaagctgctagggcttgatgccatctcaacacaggccactgattcttcctgatcctttctttctgctccatcttggctcttgacacatgcttctgtctcttctcctggtttccaactccacactatctaatctgctgcagcttcttgaaactttgtgtttcctttgaca

SEQ ID NO: 136671 - DNA, 627 bp, Homo sapiens
gtgggtgcagtgcaccagcatggcacatgtatacatatgtaagtaacctgcagaatgtgtacatgtaccctaaaacttaaagtttaattaaaaaaaaaaagtctaacagttcaaaaaaaaaaaagtaaaaaaggattggtttacataaatgaacactcatataaaatgtacactaattcaaccaaatgccttcaatttcacacaactttagtaaattcttaataaataagctggtttaaaaattattagtaaaataaaaatagagatatctttaaattgtcagcatatatttttgcctgggtttactgatcaaacattcttatatatgtctctcctagatgtcttaagatatcaatgtttgtcacaaagtttataaaactataaaaccaacctaaaatagaatgactctatttgtgcaactctttaataagtaagactaagttaatattattggtttaataaaaatacctctatcttctgagttaaatttgaggctcttacttaggtgaacacctgatactcataagctataaaaattgttgacacagaaataatttgaaaagattctagctttgtctaatatttcagtttgtatactcaattgatgaattgcctaaaataaataaa

SEQ ID NO: 136672 - DNA, 767 bp, Homo sapiens
acctggatgagttccccatcaacctgccccgctccctccgggagctgcacctgcaggacaacaatgtgcgcaccattgccagggactcgctggcccgcatcccgctgctggagaagctgcacctggatgacaactccgtgtccaccgtcagcattgaggaggacgccttcgccgacagcaaacagctcaagctgctcttcctgagccggaaccacctgagcagcatcccctcggggctgccgcacacgctggaggagctgcggctggatgacaaccgcatctccaccatcccgctgcatgccttcaagggcctcaacagcctgcggcgcctggtgctggacggtaacctgctggccaaccagcgcatcgccgacgacaccttcagccgcctacagaacctcacagagctctcgctggtgcgcaattcgctggccgcgccacccctcaacctgcccagcgcccacctgcagaagctctacctgcaggacaatgccatcagccacatcccctacaacacgctggccaagatgcgtgagctggagcggctggacctgtccaacaacaacctgaccacgctgccccgcggcctgttcgacgacctggggaacctggcccagctgctgctcaggaacaacccttggttttgtggctgcaacctcatgtggctgcgggactgggtgaaggcacgggcggccgtggtcaacgtgcggggcctcatgtgccagggccctgagaaggtccggggcatggccatcaaggacattacc

SEQ ID NO: 136673 - DNA, 1272 bp, Homo sapiens
ggggtaaaagccacgcagaggcccttcagaagaggtggcgggctgcagacaaaagggcaagagttgaaaagggctgtggaggtagcaagcagcagaggccaccctgctcagggctgggtgccaggccacagggcatgcccgacgaacagggagtcggaaccccctcaggccaccctcgggagtcctggggtccagaggggtgtccctgtaccccttgcacacaggaccctcactctgcagggataagccagctgcgcctgcagcctagggtgccaaggaggctgctgattgtggcccacagcctcatctgaacgccaggagaccaggataccgaggcaccggatcccctctctgtgccctggggagccccagtgctgcccagtcaccccagggctgaggtctgcgtccctagtggtgcaaggcctggtaggaccacggggcaggtaatgtgagcgccatctgagctcacggtgtcctgagtcgcggcttcgtgactttggcaggggcctccggaccagtgaccccagtcaaacccagagggtcttgggcggcagcgacgaaggaggtattcaggctccaggccaggtggggccggacgcccccagccatccaccatggtggtggcacaccccaccgccactgccaccaccacgcccactgccactgtcacggccaccgttgtgatgaccacggccaccatggacctgcgggactggctgttcctctgctacgggctcatcgccttcctgacggaggtcatcgacagcaccacctgcccctcggtgtgccgctgcgacaacggcttcatctactgcaacgaccggggactcacatccatccccgcagatatccctgatgatgccacagcctctacctgcagaacaaccagatcaacaacgccggcatcccccaggacctcaagaccaaggtcaacgtgcaggtcatctacctatacgagaatgacctggatgagttccccatcaacctgccccgctccctccgggagctgcacctgcaggacaacaatgtgcgcaccattgccagggactcgttcgtgcctcattttccccatgtgggagaatagccccacctcaccagctggtgtgaaggtcaatggagaggggtcctcaactctgagccccgctgcaggaagacctgggtccccgccccctccttggactaggggtagtgctgccaggcagagctggactgacggctttgcgacaggtccacaatagctcaggtccacgatagctccgcaggtcccaagat

SEQ ID NO: 136674 - DNA, 315 bp, Homo sapiens
ctgagctcaaaggtggcttaacctcatcctctgctcattgagggaaagggatgtgggaaatgtttttatttcatagccagaaggaatctgtaggagagtactcatgctgcttcccatcttggcaaaaaccagcctgtgtaccccataatatgtcaattacctaacattacacatatacgtgaaaactcccaattgcccccagaagctagtatcttgggactctctattaaaactcttaactatcagaaagatcctagattcctgggtcagatgtggtgctttctgtgcaagtccttttaccaccctgaactcaac

SEQ ID NO: 136675 - DNA, 522 bp, Homo sapiens
tggagtcttcctgtaacaatgacattcataagacttgtctctatttatcttaactctgtgcttgcccagtgcaaacagtcttattcccaggaaatttgttgaaaaaaatcagtggcaattgtttaatactgtaacttaatgaaatggcaaccacttggggcagatgaaacattggccataaaacttcaaactcaaacttgaagaatgaggtgtccacggagggctttggataactctgacatattcccgagactatagaagactactcacaagtgcacaggtgtatgcgtgtcctggaaagaccttaggaggctgtaatctctcaccatgggctgacttgaggagtttcacacaagaaattaaggttaaagaattgcaaactgctggagcactgaaggcatgccccagcatccacacagagccccttaacaagggctagtgacttactcggtcaagaaatttaaaaacgttattgtctaaccattatatgacaactaatataacaattagaaaaaaaaggaa

SEQ ID NO: 136676 - DNA, 505 bp, Homo sapiens
agtccgttcgattgagctatttgtaagagaaaagtgcactaaacgaataacagaagtatcaagtggaattgacgtgggatgacacagctgcaaactccacccaactgggagcagccaggaggtgatcctggacttaacacacaaagttctttctttcaataaatggcctttgtgtactccccagttctgttcttttcatcatgagtgtattttttttctgccttagaaaatttgaaatcattatgtattcaactctgtcaacctttcccttttactgcttctcttttcgttcatatgcataaaaaaagtcacctcaataccagataacaaatcacttaatacctagaaggataagccttcagaacttgccaagtaacaagcagagattaatatacagtaaggtaaatgtctatgtaagatgaataactgaaattcaaataggtggatcaaactggtgctagagaagtcagaagaggcctggaatcaccctgaaacggttagataa

SEQ ID NO: 136677 - DNA, 348 bp, Homo sapiens
tagagacaggtatgggcctcccattcctcaggagtatcatctccaggaggttggaggtgtaatgagagtagtcagcacagcttctccaggtcagacggaggtcggcaggactcctgatctggagccaggtgggctgctccagacctccgcctgagggagcatgacagctgcacctgggctccccagggcatgctttgcttcagatttggagctcatcttaattagatcttgtatcttttcttcagggagctgctgggatttaatgattcttggctaattgcagaaagagggctgttacttaagtagatgtgtgtctgtgtgtgtggtttgactatatttgagcccgag

SEQ ID NO: 136678 - DNA, 163 bp, Homo sapiens
agcggaagttttccactttgaggaagtcccgtttatcaatgatttctttcatacattgtgcctttgaggttgtctttaaagagtcatcaccgaatccaaggtcacctagattttctcctgcgttaccttctaggagttgtacagttctgtgttttacacgtag

SEQ ID NO: 136679 - DNA, 236 bp, Homo sapiens
gcagcaagtagaggacgggttgaatccaaggctaagggttgggccactcggccaggaaggcagctaacctcattgcatatggcccaccttgtgtcaggtagccctgcaggagaaggttgaccagcacttcctcttcctgcctttggctctgggttgctctaatgtgacttgtgttaggactgtggttacatagcagtaacacaacagaacacgtttccctgtcagtggtgctcgtc

SEQ ID NO: 136680 - DNA, 391 bp, Homo sapiens
tcatgctacttgattacttataattgttatctctaatcttttctaaatgaaatacaaatacttcagggattaaactcaaggtcctttattagcagtcatcacttaacccacttttactttttttccttctacttcctcagttcatcaggacactctgctaatacatatatactgtcttaaagttaatttttttcattgttgtatatctccaccgagaataccgtctatattcgtttttaccaataagaagttttgtcttttggtttaatttaaacagaaaccctgtgtttgtttgaatactacttggtttagtttaaacagaaaacctgtgtttgtttgaatgctacttaccagctgtgtgatttggacaagttaattagcctcactgagc

SEQ ID NO: 136681 - DNA, 166 bp, Homo sapiens
gtcctttcttgcagaggaatgtgattctctgttcccataactggtcttgacagcagcttaacccttagctgtggtctgtggaggagggagctctccaccactggggacctgctgcgctgtgcctcgggcttcagctgtctcagtatgagagagccccgcttgtcct

SEQ ID NO: 136682 - DNA, 311 bp, Homo sapiens
acagtgcattagcaaaggagtggaagccttccaggagaatgagggagagccccagggaagtggtttgttgcttgttacagagggaccaacccctgtaggaagcctaaagggctgggaaagatatgcatgaaggaggccttggagaagcagctttctgagccctggtgggtgatggtgttagagagcaggcctccaacacttcacacccccatttcagaaaagatgagtcaagagtaataagaggaatgattttaacattttagaaacatgggccttcggctaggataaggggcccaggcagaggagtgagg

SEQ ID NO: 136683 - DNA, 189 bp, Homo sapiens
ggcagtcctgatcataaatctaattgcatttgcacaaaacagtagagttaacctatcccttcctgccttaaatcatgctcacttctcttactaattgatgtcttttgtggctcttttttttttaacttttaggttcaagggtacttgtgtgcaggtttgttatataggtattttgtgtgtcataggggt

SEQ ID NO: 136684 - DNA, 185 bp, Homo sapiens
agaggatcccagttcgacggagatctcttggataaatattgtaaatatcaactgaactatactctttatctttatatttttctgtgattacttaaaacctgacaccaaactctggttatttgctttatatatagcctatctacttggaaacaatcttgctaaggaaagagatatattcctatgaa

SEQ ID NO: 136685 - DNA, 218 bp, Homo sapiens
gctacagttatgggaaagaaaagcctgctgaacttaaggtggtctcatggaacagagtcagaatgggaaggaaggtaacttgaggaacttcaaaatacagcctgtcagaagctagaaccattcctctcgagaactgaaacaaaacaaggatgcttactctcaccacgcttattcaacatagtactggaagtcctagcctgagcagtcaggcaagagaa

SEQ ID NO: 136686 - DNA, 211 bp, Homo sapiens
ttgatgaattaatcacgtgtcccaggtagaccaccaaagaccaaagttacaattcacatttgattgcatgttaagccattggctgaaagtgacttttggctccatgtctttccattcagtggactgagtttatgagcacagtacatgacatcaagataatgctcctttgaactgtgaatgttcttgcatctatagcaccatgactatcaga

SEQ ID NO: 136687 - DNA, 436 bp, Homo sapiens
aagaccagcctgaccaacatggagaaaccccatctctactaaaaatacaaaattagccaggcttggtggcgcatgcctgtaatcccagccactcaggaagctgaggtaggagcattgcttgaacccgggaagcggaggttgtggcgagccaagatcgtgccactgtactccagcctgggcaacgagagcgaaactccatctcaaaacgaaaagaaaagaaaggtgcaagttaaaccgcagtgaactattgctagaattgttgctaggttggttaaaatgaaagagactgatgttactcagtgatggtacgtggagccatagtaactctcatcccctgctagtggtagtgtgatttgctggaaccactttagaaaaccgtccgaccttactggctaaagccaaaaatagaaacacccacttcctcaacaattgtatt

SEQ ID NO: 136688 - DNA, 435 bp, Homo sapiens
cttgcccatgcacccaagccatttcctccaaatccttacatgtgattaggattttccccagcatgccctaagtccattggtcatctacttgctgctctgattttagtgcaaaatgcagcttcctagaattgtggcaaatagattgcatagtcgttcaacaaatatttactgagctcttaccatatccctataactgggaggaagagggtgccactgggaaaatgcaagatgcatatcccattccaattccagcctcattccatattttatttctaaagcttaatgagtagaaatacatacacacatacatatacacatacactactccagttggcagttaaaatgtcctcatttaacgtaagctgcacatgaccccagtgggatgctggtgtcacagcctcagcacaaatgcgacagctgtgtcatgctagacca

SEQ ID NO: 136689 - DNA, 397 bp, Homo sapiens
ttttccccatccccagaatctctagttattcttactttgtagaaaatcactactaagtcactttgaaaaatgtatttatgtatgtatgtaaagtacctagtaccatgccggtatttattaggtgctcaaacaatagtatgctattagcagatactcagtcgtatgacattaaatgctattagagagatttatttttgtgtgttaaaaatgttcaatctagtggagctatttttgttttttttaataatctctacctgacaaattatttggtaacatacagttagagacaatttggcatatgaatttgtgttttaaaaagtctggccaggcgcaggtggctcacgcctgtaatcccagcactttgggaggccgaggcgggtggattacctgaggtcag

SEQ ID NO: 136690 - DNA, 682 bp, Homo sapiens
aaaagctcctcaaagtttgtatgttccttccagtctctcgtttctccctcttacccttttaaaatacccaggagaagtgctgtcttttggggaaaatattgctataggaaatatagcaaacatttgctataggaaaatatctcagacttggcagtttagacataatatgtgtttctcaccgctcttgatactgggaagtccaaggtcaaggcatgatacagaagcacagctggcggcattgcttcgggatctcaccctcctccttccaggtggaccagctcctgcagccctgccctcctgtctccatgctccccagccagtagcccacgtggaaaggtttggagtttggggctggaagatttcagttcaaattctgcatagtcttccctgtgcatctgtgagccttgcttcctgatatgagctggcggtgtcataattcctatctcagatggcttttggaaggttggaggatgcctcctgaagtgaaaaatactgcacagtgtcgctgcaaagaggctaacacatggtttcagggactctgaggggtagagtccaagaggcatggtctccaggtgtgtcagaatacacaggggccaagcacaggaagaccagagaggaagcaggtgcttagtgacatcagtgagggaagacagtcccaaagggcaattgtccacctaagccc

SEQ ID NO: 136691 - DNA, 450 bp, Homo sapiens
gggattatgggtgtgcacaaccacgccctgctaattttttgtatttttagtagagacagggtttcaccacgttggccagactggtcttgaactcctgacctcaggtgagtacctgtggatttgtatcttaggaagacaaaaaccagctggtattagccccttgtctccccatccacaggaaggagggggaagtactcggaccttaaaggggttcactctggagtggggcaggtgggacagagggaagttctgagagctcctcactggctcgggagggaggcagagctgtgggcccagtgcctgcctcaggtgcctggcaggtggcagatgaccctcaggatgtggcccctggcacctggttcctcactgtggccaggatcctgcaagggtgcctgggcccagcccaggagctgaggaactgcaggtgcccatgtgggcacaactgggccc

SEQ ID NO: 136692 - DNA, 589 bp, Homo sapiens
actccaaggagcaaagattaaatcctggtgtttgctgcaaccagagcttctaagctgatcacttagaagatatgatttggggatgtctgaggggccaaaaagaccttgcaaataatcacatgagataacatgctggaaatcactgtgaaaggtttaatatagcaatcatcatattcgcatgacaatatatatgggatacgttataacacccataacaaatgtgattcaacttggttgtaccagtgactttcaaaaggtgagcatctttgtgcctttgttttacgtatcttaaattttctatatttaaaggtcattggttccaagatgctcctttaaattttgataaataaatgttctgaagatcatctatggggaattcttccccctcacataataaggttggatgcgaagcgcagttttacgccctgtagcagacttttttttttaaatgcccgctctgttttagctgcttccaagtcccagcctgggatcggcaggttgtgggacaaggataaagagtgtggtgagtatcgggctacagttctcaatgctcgagggataagatttcttatgaaaactggcagctttt

SEQ ID NO: 136693 - DNA, 537 bp, Homo sapiens
tctttttcccagagcataagttttaaattttgatgaagtctgatttaccacattttttcttttacacatttggtgttcatctaacaactttacctaacccagaccttgccagactttttctgtaaaaggtcagatagtaaatatttcagccttgctgtccctgttgcagctctgccattgtagcaatgaaagcagccatagacaatatgtaaatgaataatagctgttccaataaaactttatgaacactgcagtttgaatttcacataatttacaaattatcaattatattgttttgattattacaaaaacaggtagtggattggccatggtttgctgattcctggcctgacaaacccaagttcacaaagagtttcctctttgattttgttgtggtcgttgttccacaccttcttttttcactgtttccttaaggtagagtgtacatatttataagggtacatgtaatattttgatagattcatacagtgtgtaatgatcaaatcaggttaattagggtatccatcatctcagatg

SEQ ID NO: 136694 - DNA, 415 bp, Homo sapiens
ccttctgctgactcctctcagcgcccaaggcagccacccagtgcttgccctggcctgttcaagtcctactcctgtccttcactaatgcttgcttaattcgtggatatacctactctacgaatctttatgagaagatactgtagggtgacccacagtcctgatttgcccaggagtgagctgaggggtttcctgagatgcgagactgagactgtcccaggaaaattgggatggctgacgaccctcatgtactgcatgcctggtccctgggctgggtgccaaggacacatttatctaccaaacatagtcactgccctcaagaaacttccagtcggagagtggctgccactcaatgagaaaccactgtcaaaggcacctgttcagcccctcacacacatgatccatcaccaccctatga

SEQ ID NO: 136695 - DNA, 518 bp, Homo sapiens
ggtatgacatgatacgcatcgatactcggacggtgtttatcgatgccaccaaaatatattttggtggcctgcaacgcctgagaaacttgagtatgaaagcaagtagatatatatgacagccttggaaccagaagaatctacactgaaggctgtttaggatttaaagaaaattctgtaatttcatctttttagagcaggtaatttaatctgccctaaacaggagactttactggttaacagtgtggaccatggaattaagtcatacctgaattcgaacgctggggtctgcatggacataatgtcaacatttgaaacataaaaactgttttcttgctgctgtatatagaagtaccttgtccacagaagagtgctttcacacagtaggcattccactaatattggggaataaatgcatcagttagataagttataaaacttatccaagcctgtctcctcatctataaaattatacttgacctacctcaggggattgttgtaaagattatgcgaagtaaaca

SEQ ID NO: 136696 - DNA, 289 bp, Homo sapiens
ccatcgcttcttcctcatcgggtgcagtcttggggcccagtccattaaggcttcctgccctcccttagacactgacctaaactgagctcatcagaccctctgtcctggaccctgagccaggaacagacagcaacagggacaagcaccccatccccaaagagagagaagcaaacagcaaagagcagtcattccagccctggaccgacgaggccatcgagtagctccagcttcccaggcttgggagctgctgcagttcctgcccattttcaggtcctcgttttcagatccc

SEQ ID NO: 136697 - DNA, 459 bp, Homo sapiens
gtcattacctttatcacaccaacttcaaaaagggagttggagtgaattcttggacttaattgctcttatgaagattcaagtcagtagactcactttcctccaacaatatctctacaaaaggtagggaaattaaatgctaaattgtgagtttaaacatattaacaaaggctactttcatttttttttcattcttgaatctcagaaggtttctaagagaaaaaaattctaagtttgaacatggaaacaagaatgtacattaccaattaagtcaggggaattttgtggggtttttcctgtttgttttgtttttgttttaaaaaggcttcctggtcataccaaacattgctagtaagcaatgccagcaagtgacagaagaacagaagaatgtattacgaaaaacagggatcactatctaattatcatctgatttgtgaagagctcccctgaaaggggagaggg

SEQ ID NO: 136698 - DNA, 301 bp, Homo sapiens
atatgccaagcactattcaaaatagtttacaaatatgacctgacttattcctcataacaaccctatgatggagttaccattgttattcctatttaacagagtaattgcagcatagagaggttaaataacttgaacaaaggttgcgtaattaataagtatatgatccaggactccagtctagacagtatggttccagagtgtgtgctcctaaccactatgctatgtgtctcctcatactttaatggcctggtagtagtttatcctatggatgtgttatagtttattccccagttccctatag

SEQ ID NO: 136699 - DNA, 299 bp, Homo sapiens
gtgattctcattattgtaggcttttcagagctgtgaaatacacacgaatattttcacaagctcattctcattaaatttaggactataatgtttttatttaatcttctatctgtatcttattttctcactgaaaattctggttcctagtgacacaaaataatgattcatttgctttatttcaaaaaaggaatacaaagcagtctcagaataactataaccactactaccagtgatacagttggtgacaattttacactgagctcttactattttgagggtatatccactagatacaagtt

SEQ ID NO: 136700 - DNA, 191 bp, Homo sapiens
gcctcagtaggtctgatgccaccagcctttactcagaatgtgcttaatccaattagagcattctatcacattagagagttcacattgattctctccctctgaagtcgggccgcatacacagagaaaccatctgggactcagccatgttcagtgaagaatgtggatggcatgggcatccttcccatttgggg

SEQ ID NO: 136701 - DNA, 301 bp, Homo sapiens
tgacacaatgaccctccaggtatcactggccagtctcctctgcaaagggtggaaggagcagatgaaacacaattggccagaagaccccagacaggtggcatggtcctgtccttaaccctgcccagggaccagcaccactagcacaggttccagatttggccacactcttacagttcacctgccaggcactagcagcacaaatgcccacactgcagccaccagaccccctctccagaccccctcccttcacatgttcacctatgtctctgtaacttgcttctcctaaacccttgcctgcaat

SEQ ID NO: 136702 - DNA, 492 bp, Homo sapiens
agcttcccgctgagccgtgtggggctttggtcacccgggtggagccgaagcgcggagaaaagtcctgacgtttcactcctcctgtctcctgcttcccatcctttccaggagatcatttcacttcattgttttgcaaatcttttctcccatctgagcgctgcttctttattgtcttaaatgagtgtttcacaaagagcacggattgggttttgtactttttctgtgtggttggtttttgtgtgtctgtgggtgatgaaatcgggtcggagtcgctctaaagtcatttttgtctcttgcgcgcctcagggaggatattaaaggcttttgtggatttcaaccgctaaagcctttcctcaaagttcattgcgaggggtttcagttccgcccggcagcatccctcagggttctgcgcgctcccgtggcaccgtctgcgcccgagctccggtcccgtcccgattgcctgatgccccgcagggagcgcccagcggccgc

SEQ ID NO: 136703 - DNA, 494 bp, Homo sapiens
aatttttgtatttttagtagagatggggtttcaccatgttggccaggctggtctcgaactcctgacctcaggtgatccacccacctcggcctcccaaagtgctgggattacaggtgtgagctgctgcacccagccttttgtctgacttcttacgttattttgagattcatctatgttgtagctgtaaattgttaattctttcttattgctgagtagtagtacaggttgagtattccatatatgaaattcgggatatttttggatttggggatattcgcattatatgcttactggttgagcatcctaaatccaaaaatccaaaagctgaaatggctccaatgaacatttcttttgagtgtcatgtaggtgctcagaaacattcagattttgaagcatttctgagtttggatttttggatttgggatgcaaatcatttatccatttgcttgttggcaaacgtttggattgtttccagttttcttctattacaaatg

SEQ ID NO: 136704 - DNA, 242 bp, Homo sapiens
agtgtgagccgccatgcctggcccagagctacttttttccttttggcagctgttggagttccatggcctctgaccatttacaggaatgctgtagccagtgtacttgttgagctatttctgtaggatactttcctaaaagtggagtggttagttctggattgtggtcagaggtgggcaaccaaggcagaaatgggcgtacgcatggaggaagaatggagagagtatgtgcattctcggctgac

SEQ ID NO: 136705 - DNA, 427 bp, Homo sapiens
tgcacggggttcccggggaccctggaatggggtggcccgtgagcctcactccatctccaccagtcatggcctctgctaccttgggctagccatcgcgtgagccgggcccggtcccgcagccaccgccctgcacggcaccacagcaccaacagcagcccacagcccaggacagatagggcacaggacgccccgtgcagagggcacgagtggcctcacagttctcaacggtttgaaaggccgggaaaccagtttccaggggtctgaaacaaaatctcaaaacataattcgtccaatcactgcagttatctactgagcacctactcatgccaggcaccacgctgagggctgcacacaccaacaggcccaacagacccacagaaccactcagacgcagcgggagacggccagtgaaccaactgatactgca

SEQ ID NO: 136706 - DNA, 739 bp, Homo sapiens
catgagattacagctaatgaaagttttcttctttggtttatctgcaatgtacacttttttaataaaaatatttctgtttatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaagaaaaagaaaaaaaaacgaaaagaaataaactaaaaaacagagcgcgaaccgccaagaaagagagcagaataaagactgacagggcggtaagagcgagaatataaaataacacaagacatcacggcgaaacaatgccacacaccataccctcacggagcaagcacaccacagacgatcagagagaaacacagacaacacatcacccacccacattacgacacaaacgtctaagtatacagaccacacagaggtacttataaaactacagaatctattctcctggcacagaagtatgagaaagagctaccaaacatacatacaggctataggtcagagtgatgaacagctagacgacaaatacgacgtaatgatatataatcaaatgagattcgagagagtacaataaatactcaacatacaagaacgcctagacacattctacacgtaacacctacaaatctccaatgcatggcaaccacagacatagtaaacataccaccacagttaacatcaatccaaatacatcaacatcagacaggcgctgacgcc

SEQ ID NO: 136707 - DNA, 808 bp, Homo sapiens
gagctggctggacagtttggcatgccggtactgtatcggagaaatggtatgttgagaggacaagtttcttctgttgttgctattgattattttgtgtttggacagtcaaagaaatattttatacaaaagcaaattaccaaaaaaagaggaattcagaaaccctttatgttcaggattctgtttacccgttggaagctcattcacagataaaatggaaatgtgctcagctcagctggttacattaagagggtgtttccgtgttcaacaacttttatgatgggcacaggctttcttatttttaagcctcttgctgttgccatctccagatattttttcccagctctttgcttattttcagagctgtttagcagctatttactaccttaggtcaacagcctataaaatatgttcttagttttaaattatagatcatattgcttttacattttctcaaaactacttgatttccttaatgaaaattatttcaattgttatgtgaatagtttattctgtaaggaaaacaagaaagcttccaaacgtgggtaagataattctgtgtacagcaagagtcagctgaaatgccattggtccaaggttaagtcaactgtggaaatctcaggaaggttgaatatttaaagcaaaatgttgcatatgttcctccttgtttaccaggatttataccctatatcctccaagagaggttcaaatagagattagggtgcagagaaaaagtaataattacatgaaaaggcaatgaaatgttgaaaaacagttctctaaccttccttttaaaacacctatgcttata

SEQ ID NO: 136708 - DNA, 447 bp, Homo sapiens
agagatcaggccgggcccgatggctcacacctgaatcccagcactttggggggctgaggcaggcggatcacctgaggccaggagttcgagaccagcctggccaagatggtgaaaccccatctccactaaacatacaaagaaattagctgggtgtggtggcacgtgcttgtaatcccagctacttgggaggctgaggcaggagaatcgcttgacttgaacctgggaggtggaggttgcagtgagccgagattttgtcactgcacttcaccctgggcaacacagcagaactccgtctcaaaaaaaaaaaaaaaaagatcaaaacaagtacacataagatgaagttcaaattagaattgatcgtaaaaatgaaagaaagacttaaaatattcttataattcataatctcaggtgtggggaaagaaaatagtatatcacttaaaaaaaaag

SEQ ID NO: 136709 - DNA, 318 bp, Homo sapiens
ctctgacaccgggcggtgtggagtccttggagcccttacctcttccgaggctatgctgtccgcgggctccctgcagcccctccccagtcgcgctggaggggaggttcttatcatggggtcgtctaaggactgaggggtgccagacctcaggttcttcaaaaccccgactccagatccccggaacacagaccccagatcctcaaaacccagaccctaaattccctggagcccagactccatttctttaaaacttagacctgagatctcctcgaatcagaccccctgaaactcagatttccccaaacccacattccagaa

SEQ ID NO: 136710 - DNA, 249 bp, Homo sapiens
ctgcaggtgtgtgatattataacatttctgatatctttggtcagctagctggtcgtctagccttatatttctttccattcgtgtctatgaatgagataatatgaggcaaaaagaatgcatcatatgtgagtttccattttcactttttaaaatgcaaatatttattgtgtaccaactctgcaggaggcactatgatatgtgccagggattcactatgttatgtgccggtggagtacaacgtgccggtgg

SEQ ID NO: 136711 - DNA, 391 bp, Homo sapiens
tcttagtccacccaactccttccctctcggctccttgaccgctcgtctctttccctgcgttacacttctgccacccactgtcaagccttagaccttgtcattaccagtaactgttgcctccgaagcctcagtttcaagcatcgcacctgataaccaccaccacctcctatctgtccagctcacttccttaaattgcctcccttcagcagctccaatcaacgcagcctgagaacaatggtgatgatgaaaataacagcactgccgcaacacttaccccatgccaggcactgtcctaaatgctttagaacagtattcaaaattgaacaagtgttcggtcacttgttcaatcctcacaacagccctaggaagtagccttattcttatccccatt

SEQ ID NO: 136712 - DNA, 226 bp, Homo sapiens
attcataacagttccgagtgcctgcttccaaagcttcagttgattctgtggcattgctgctagatcaagccttctgaatgtggccttttgctgaggagttcccttctgataaggattgttttgatcagggtaggggtggtatgagatccagagcttagggtgaactctcatccccttgacctctgcccctatttgagtttatactgacttggtagggactccctat

SEQ ID NO: 136713 - DNA, 507 bp, Homo sapiens
ttcctaaggggcagataagaaagcaagtacaaagcaaacttaacactttggcagaatgtaatgtatctgactttctaaaattctgtatgccagaataactggctgtttcccattccttgctcttgatatacagccaacagcctagccaggagccatgtcgaaaaggaggggaggcactcagggcagtggtttttcatggcctcattctttatagtacaatagttagtgtcccactattgtacttgtggaatgactctgaaattgtcacaccatttatgtgtaagaattgctacttctctttatttctccaattcaagcttaagttttcctgaagtttccccaccttctggagtggcaggaaatttagcaatttccttttctcataatggagctatatatggttccccagctagccacgacagaaaaacgtcgggatgaggatggttcttcagtcatggtggagacatattttctgtgggtcttttggctgtagtgctttgggccatg

SEQ ID NO: 136714 - DNA, 178 bp, Homo sapiens
agtgagccaaaattacgccactgcactccagcctgggcaaccaaatgagactccatctcaaaaaaaaaaaaaagtatgtgactgtttcaagagtgatatgaaactcaaattccagtttccaaacacttccagttttaccagcacacaaccacccccacttgtttacgtattgcccgtg

SEQ ID NO: 136715 - DNA, 622 bp, Homo sapiens
agaaaaaccaacaaagtaaacagagaaaaagtcatcagaaagctaagagaaacatcaggagagtgggtttcataggaactaagattccgggtttcaagaaggaaagttctgtcaatattgtcaaatactacagagacagcaagccatcaaggagggtccaagttcattggatttgatgattaaggaaatcactgatgactttaaacaattggccaatgaatataagaagaggaggtataaaaagcagtagaattgaaaggcttgttgatttgtttagggaggtggggaatggggttccttaggagcaggggaaaaaaataaaagacaagattaagctgcaaaacaggacaaatttatgaagcaagattttggagaatctaagcagtgatgagatcaagaaatggaggaagagtaacatcaagaataagcattataattctaacaaatattgttcaattacaagtaactttttaatgtctatcatcatgttttcttgcccaatggcctggtttcttttcacctttagccctaaaataacttcataatctaaaaaatagtattagaacttcaacttagtaatatttcctaatgttgcttttaaatcctctttttataaacaggt

SEQ ID NO: 136716 - DNA, 740 bp, Homo sapiens
cctgaggtcaccgctgtccatctgcagggcttgggagggtgagctggatacacagcagtgcagactggcttgacatccagcccaggcatcccttttcctgtgctctcccctccaggcaggccagagatggtggaggttcctctaggccagagtggctatgggagttggtccagtttataggagcattcaacttgcaacattccatctcccgggggtctgtgagagcccctacatgtccatctgtcctgcctcctcaccagaccatgaggaagcaggcctggaaaggggaaaccaattgctcagggacattgtcacccgcaccagaaatccagtgatcccaacttcccattcaaccctgcttcacaaaccccaagcaggaaaggacttcacatgtaactgttggaatgtttaaattttagacttcagaacccgtggagggaggttagaattacagggttctgctgggaggtggggtgagaagtttccgtttgcccacaagagtgtgtgttggtggggctttgtggaaggaacagctttctataaggtggtctggccactgaagcgtgtcgggaatgtcggggggcccggggttacagctgcagcagaaatcctctcccacgcctcggctcttctctgttgcacagaatgttttctgcagcctttcagacctaaagttctagggttctggcacgtgtgttgggagggggtggggggttgctttgttttaacccctgcccttc

SEQ ID NO: 136717 - DNA, 576 bp, Homo sapiens
  misc_feature (21)..(21): n is a, c, g, or t
  misc_feature (23)..(23): n is a, c, g, or t
  misc_feature (102)..(103): n is a, c, g, or t
ctctagttgagccccgcgtgncntccttgcagattgagctgtctcttcaaagaggccaaatatcaagttcttgttcttcatcccctgctggaagaccgaatnnctcctggtcttacagatgaccaagtcggcccactgcacccggccaggaagcagtactttccactggtcttcaggggcaagggtttgggaaagagggtttgtgtggagatttaacatttcttatgagtctatggcaggctaggcaccatgctaggctgaggatgcagagatgaatagacaacagtgcctgcttgcagaaagccctggtctagagggaatatgctaagacagccagctctctgagggaacacagatttattttaatcgagtcttagagacctaggcttctggcagacttcttttaaaaacttcttattttgggataattttagattcacacgcggttgtaagaaaaggcacagagagatcccatatacccttcactcagtttcccccagtggtgacatcttgcatcactctagtgcaatctggcagaattttaagtctgtttaggcgtgttttctctgcaccgtc

SEQ ID NO: 136718 - DNA, 318 bp, Homo sapiens
agctgcctgacaggagcctgaacttggcagtcacgaccagctgaagggatgaaaccaaacaccgaatagtgtcagggtgtttacccaaaccaaagacttctttcttcatttaaatttgtcttgttggaaacatttcaaaaaaggacagggtgtagtggctcacgcctgtaaccccagcactttaggaggcctaaatgggaggattgcttgagaccaggagtttgagaccagtctagtcaacatagggagatcccatctctacaaaactaaagaaagttagcctggtacagtgtcttgtgcctgcagtcccaactactc

SEQ ID NO: 136719 - DNA, 865 bp, Homo sapiens
ggtcaggaccatccacatcacaagtgactgtccctcatcactttcaaatgtcctgctcaatgtttatgtccatgaaaacttgtttatacataggtggatctagcatccaaccccattttatatataaacacacaggatttattttttgcagttttaaaatacactgaatttttcaggaatgcagcatagagtgaagatggtacatatttgttcaggactttatgaagattgttcaccattttggaaaatcatgttacaaatggcaatggtaatcacagtgtttgagccatactaaaaacacatgtgactctgtgtgcatttaaatctattgcattcatggcgactctacacataggtgcagacatctaactacttagtaggatttccagtgtagtcatgtacaagattttttagatactgaaatacttatttttctataaaatgcttttctttctttcttgattataacccagtgagtgtattccattttttttttatattatgaattttgggaggaaattttatgtgtaggtagatatattatctatgggtttcatttgagcataacaaaaggagagttacaagttatgtgttgttggtttgttttcatttgtttgttttttctgagacggagtcttgtgttataagaagggacactgagtctgatgtggcagagagccactatttcaactgaactagtgcctgtgaagaacacgcatctgtctgttgggctgagcctggccccaagggacctgtggaccctggatcctgaagacactggatccttgagaatcgcttgaaccccggaggcagaggttgcagtgagctgagatcatgccactatatgacagagcaagattctgcc

SEQ ID NO: 136720 - DNA, 258 bp, Homo sapiens
tgccattgccagcaggtgccttgcgcgggtacctggctgcgcttattcatccattatggtcgctctgtcactggtgccattatgtgctcacatgcccactccctcaggtttagaagtcgcgttgcccggcaacagaacaatctgctggcttagcctttggccaagttggcagctggacgaggacgctcagagcccagctcttgagagttcaagtatccgacagttccccactgctcccaggagcggtatatctccgct

SEQ ID NO: 136721 - DNA, 460 bp, Homo sapiens
tatgaagtgggagacaaagagagccacaagtcttgtcacttgcagatggcggaggggcgccctccggcccttcctgacctaccctctctcccgctatggcggttgtcccaagcactcagtgatgggcacggggctgggcaccgccactctagggacatcagccaggggctggggtgtgagttgcaggaggggatgcagggctggagggggattagcaattccgagcactggctgcataattaaaaaatcattacggcaggcgggcagagctgagtgtgagctcacgcttagagcgggcggggacactgccatggcgctccccctcccactgcttccccgaggaaaaatcccacctgctaatataattatggaaaaacacaagcacagaaatttggtttcagcaaacaacgtgcctcagtgcccagggcctgcctggccctcagcacagcgagcaggctgg

SEQ ID NO: 136722 - DNA, 799 bp, Homo sapiens
ggaatgacatggctctggcttaaacacagatatgtcaaaatatgttagctataaatagggtatgtgcaatactcaaaataaattcctgtttgaaaaagaaatcgcatcattctccttcatctactctctgctttctcttcatgtctcctttccagacttggcctagtcactaatttaaaggtcaagtcatgattaacctctaagtttccctgtctggtagccttgtcattcccccggccctgcctcaccacctcagctgaaatacagtttcactttttacccagtgttctatgtgcgtttgtcttgcgtactcatctccctttgtgcatggatagagtttttaaacatctctatacaggtatgtgaatatcatttggtttcaaaaagttgaatttcactcttcagtgaatttgctctataatgatgacatgagcaatagagaatatgaaaaatcaagaaggaactctctaggtaacatggacaataaataatcacagtcgactattttgttaatatcttttatcttacatttccaaggctaaaatatattacccagcagaggtaggttcccttctcccttacttcctgaccaattcttttagcttttagataacccctaatgatttaatttttaaagaaaggttgtagtggaatggtggatgaaaatattaccatagctgcttctctctgtgggtctggagcatatcatcactctgctttggatctctctctgcctctgctgattctaccaacttaaagtgtggttgggattatccaaggcagagtatactctgtgatt

SEQ ID NO: 136723 - DNA, 241 bp, Homo sapiens
taacataggcctcatatttacactatatgttcgctttataattccgaagttgttatttgctaaatctccaatggttgcaatcaaaccccacaatgctgaaaacagagattgattttgatgttaagaacaaaagaagtatggaaacttccaggctcaaacatgtcccccgtgccacaaggcaaactgcgatgagctcacagtccaggtctcttgctgtgtgtcctgcagggagtggccaact

SEQ ID NO: 136724 - DNA, 361 bp, Homo sapiens
aagtcgaagacgccagaggggtctctcaggtgaggtctacagagagaggtcagggaataatagtacattgtgacttggcagctgttggttctgacaatccatattcccaacagctctccttgatctctatccatttatgtgggaagttttgctgtatgaaagggggaagaaatgtctggaagtagatggaagtacttgtgccccctactcactccttcagactcgacataagcactctataaagagagggacttagagcaagaataagctgatggaacaattcaagatgggacttcccaaaattcagggccaggcagagctgcttgagagcccaggcaagctggtgtagctcagagggagc

SEQ ID NO: 136725 - DNA, 155 bp, Homo sapiens
ttagaaaaaatcctgtgaggccacaacaaacactctgaacgtgtgtggagatccaagcaaagagactttttgttattgggggttgagggggttgcaccccttgtcctcagcaactctttgacttgtttcggacacaaacagctttctaagttgca

SEQ ID NO: 136726 - DNA, 707 bp, Homo sapiens
cctctggcagtggaaaggcaaagcagcttgcttgctgttgatgttttttccagtgccaatacgggtgtttatggctaaggcagctgctcccggcaacatgccgaggcctctggagaaactctgctatgcagtggaaaactgggaacagagcaagaaacccaagaaagagtgaaccttgattcaactggattaaatctaaaagaaaaatgctgatctctggatagaaaaataaatccaagacaaagactcttttatggccttaaaaataacacatttagggttagggctagggaaaaaaaaaataacacatttgcagccattcgcttttaggagaggtctctcttttgttttcttcttatttaatataaaacaatttcactatttaaataaaagttatacagcttccaactattcaagcagttttcatattttttcatcactaaaggaaatatgctccactgaaaattcaataactagttggaaagaatgatatattttatgcacaattagctttagattatcatctattgtattattgagaagctgttctctgagggcattattctttaaacaacagatatagaaagtcttccaaataatataggcaaaaaaagaaaaaaaagaattcttttttggaagtctattaggttaactacagttaataaaggctaccatttactgagtgcagaacaccgtgctaaactcat

SEQ ID NO: 136727 - DNA, 124 bp, Homo sapiens
actctagaggatcttttggaggcaggccactgcaccccaccccactctcaagactttgggcagtcctggccagcaccagaaacacactcctgggaacttccttccccggaaggaaagaggctcc

SEQ ID NO: 136728 - DNA, 407 bp, Homo sapiens
gaacattagaaatagttttaactcattaaatacacatgttttatgggaaggttttatatatatatttatatgtaatgaatgtgaacaaacaagggtcagatatacactctgcttccctccagaccagttccggctgctctgctgcacatttcaggagtcttattagaattagccacattctgcccacttgcccttacttctcatatttcacaactcctcctggtggggacttaaggagacattcaaactaggccttgaaagatgagaatttttccaagtggaaaaagaggagtggcagcaagtaaggtaaaggtacagagtcatggaattcccaggaaacgtaaagttgtcatgtgttataggaaaacaacttgtgtgaggggtgttgggagaaatgagagataata

SEQ ID NO: 136729 - DNA, 327 bp, Homo sapiens
ttgattttctaaccttagttttcatattgcctcttagtgtacccatgatctaaatctaagggcttaaacattattattgttgttgtattagcatcaatgggccatttccattcagtttctataaatgggatctcataccacctctctgccccgaattctctctctctctctgcgtgtgtgtgtctctctgtcacacacacacacatccaacacactagtgaaaactgcagtgtcatttgctgcaccctggagattactttgtctttgagagtccaaagaaaagcccatcagctgtcaagggttttaattatttatttttaatcacaa

SEQ ID NO: 136730 - DNA, 268 bp, Homo sapiens
gtgataaataacagtgccttctgggttctgtttttttaaaggagtctttgctaagccattaatattgaggtgaagagagaggagaagaaatggattatgcctgaccgctggagattagcagcctgctcaggtgaagggtggccacacttattaatgcactaatgagcaagcagggtcattctgatgattagtaattttggcaacataacttctgccccagatttgattaagccttcatacagacttcctcttccaggagattatcttt

SEQ ID NO: 136731 - DNA, 449 bp, Homo sapiens
tctggaagtctgccttgcctgatattaacagaagcacttcaactttctttctttttttcttttaaacaactgctattctgttaataaaatagttgcttgaaacatctgcagtggtgactttaaccttgaatctcagctcagtacagatggacgtaatctgcttagcaatctcgggaggaccatccaggtcagtgagtcacttgcggatcctcatctggaaacgatcccttgtcctagaaccttcatcacgaggcgtttttcttatagtgattctcagagtcttgataggcatctgaactgatccttcactttgagattcttttcctttgcacctctgatcaagtcagcacacaccttctccagagatttgatgttgcggcaggctagggtaattctgatttaataaattgccacctctagttccacggatggctttgaaagccatagct

SEQ ID NO: 136732 - DNA, 268 bp, Homo sapiens
actgcacacacctccagaggattccgatgctcccaaagtttgagaatcgtccttctttttctaccactgttcccaaggtccttaaattctttcaatccctttgtaccacccactaagtcatctcctgcagcctcccttttacaggttgtgttgtctgtagtaagtcattgcagaaattctctactggaaccatatgctaactgtgggtaggagaagaacaacatatgctcaggtggtagagtaactaaaagcaccccaagattttcct

SEQ ID NO: 136733 - DNA, 567 bp, Homo sapiens
aacaatccagggctgacagtgacgttcataaaaagtgattttctccccctgctgctaagcttagcatgtggttctgtatatggtgggaagacgagggatctggattcagggtttaaaatgcatttcagctggagccttgatgccttagtgtccgtgtggggtgagaaacacaagggatgacagacttccctggttcaagagagcatggggaaaccgcaagccagaatgtgtccaccgcccagactggcctacgtgggcctcggctctcagaccctcccatctcaccagccaggcctttgaggcctctcctgcaagcatctccccaaggtcccacagaggtccaagagcccagcatggcagcgatgcttacgtgaaatcacacttattacatgatctgccacagatctcttcctaggaggctacaaacttctacagacatgagctctggtatatcatcctagggatacaggaagccagccagccacagccctctatttcctgagcactgaaaggtaacccaactgcacacagcccgcttctgaacaagggctatcctaagcccccaaa

SEQ ID NO: 136734 - DNA, 216 bp, Homo sapiens
tccaaacttctcagacctataaatcaggaaatcattgttggctaaactatttatcttttagattcatcaagttcatgtttataatctgtttagaccacccatgatgaggaacaaagaaagcaaatttcttcaaattatatattcttattcggtaactcaagtttatgccatttttctaccaaacttgtaacttttttttttttttttttttttttg

SEQ ID NO: 136735 - DNA, 716 bp, Homo sapiens
cccaaaatcattaatccttcacattccattaattttcttctacaatgaaagctgttaccacaaaataatcactactatttttcagctacatttacagtgtgtcaagagctgtgctttacatattatcccgttcaatcaaatcctcacaacagttctttcaggtaggcattattatgcttgttttacaaatgaattaaaccaaagtttaaggctcatccaaggtcagagagagagctggttagtgggagactaaggatttaatatcaggcactcttttaaccaatataaaagtaacctgccttggctggtcatggtggctcatgcctgtaaccccagcactttgggaggccaaggtgggcggatccaaggtggccaggagtttgagaccagctggccaacatggcaaaaccccgtctctatcaaaaatacaaaaattaaccaggcatggtggcacacgcccgtaatctcacctacaagggaggctgaggcatgagaatcacttgaacccgggaggcgaaggttgcactgagtcgagatcatgccactgcgctccagtatgggcaatagagcaaggcgctgtctcaaaacaaacaaaaacccctgcctcattagagaatgctttctaaaaattgagggaagggagagaaacaggtataatttgaacactctaataactaagttacaaattcattatttaacatatagtttcagtcaag

SEQ ID NO: 136736 - DNA, 229 bp, Homo sapiens
attcagtggtgccatacctggggcccacatctgttgatttcaagtcaaatactgtttccatgttactgtggaaatacacttccataaatctactgttattttttaaacgttaactttaaaaagcactaaatcccaagattacaagatcacatcactaaagcacaagtcttccagctttataaattttcttgatgacttgtttcttaaattacagaataaaatgcagcag

SEQ ID NO: 136737 - DNA, 574 bp, Homo sapiens
tttttttttgagacagagtcttgctttgttgcccaggctggagtacagtggcaccatctcagctcactgcaacctctgcctctctggttcaatcgattcttgtgcctcagcctcccgagtacctgggactacaggcgcatgccaccacgcccagctaatttttgtatttttagtagagatggagttttgccatgttggctaggctggtcttgaactcctggcctcaagcaatccacctgcctcggcctctcaaagtgctgggttacaggtgtgagccactatgcctggctcagatgatgtttgtctcatgcattcaaatcttcagtgatttccctttacctagagtggtctttcccaaagtacagcatctggacccctgctggcacacatgataatttttacatgatacataatagttctttttatttttattttttattttttgagatggaatttcactcttgtagcccaggctggagtgcagtggcacaatcttggctcactgcaacctccacctcctgggttcaagcgattctcatacctaagcctcccgagtagctgggactacaggcgc

SEQ ID NO: 136738 - DNA, 407 bp, Homo sapiens
tggatgttattgtaagtggaactgttttctaattttcttttcagattgttctttgttagtgtatagaaacatattagctgatttttctgtgttgattttgcatcctgatactttgctaaatttattatttgtaacaattatttttgtggaatttttagggggttctatgtataatattatattatctgtgaacatagataattttattccattcgcaatttaaataaatttaatttctcatttctaatttatctggctaatattttcaatattgtgttgaatagaaatggcaaaagcaggcatccttgtgttttttcttatcttaaaggaacagctttcatacttataccattgagaatgatgttatctgtgtgtttgtttgttttcataatggcttctattatgtt

SEQ ID NO: 136739 - DNA, 927 bp, Homo sapiens
gttttttttactttcacctgttaaagatgttgttccgccgtcttctacaagaggttcttctccatggtttctgatgcaaagtctgcaatcattcagtcatttttatttagagtgtgaataatgtaaataatttctctggctgctttaagattctcaccttgtctttggctttgagcagaattgactataatgtccctatataattttttaaatacttatctttttggggattcacaggcttcttgaatctataaatttatgtccttcacctaattggggaattccttgggtaccattttttcaagtattttttatgactcattttctctgtcttctttgactctaattttccccccttctgagactctcgttcacgttatgttagaccttttgatccttaatactctctgttctactttttaaaatctttttttctctcttctttggattggatatgttctcttggcatgtcttcaaattcactaataattagctctgtcatatccatgctgatgttaagcccagctgatgcatttctaacaattccatataattctttttaaaatttccttgggatttcctgtcttttattcattataagcctattttcctttacctagttgggtattgttacagtagctgttttttaaagtccttctctgataattccaacatctgggtcatctctgggtttgctaaataagtttgagttgtatcccaaatttcgtgaatgttatgctttggcaactctggattatattacattcctttgatgggtgttaatgtttttgttttagctgataatgagtttggttaaactcaaattgcaacctttgtctgccctgcagtggcagcagctcaaatttcagccttatcatagcaagcctatttgagtcttccttacacacacagctcagctcagacatc

SEQ ID NO: 136740 - DNA, 289 bp, Homo sapiens
agctgggactacaggcgtgccccaccacacccagctaatttttgtattttttagtagagacagggtttcactatatgttgtccaggctagtctcaaaactcctaacctcaggctgtctgcctgctttggcctcccaaagtgctgggattataggtgtgagacactgcacccggccaagaaagattagttctaaatcttacaaactgaaggtactgacatgtcggatgcttaatgaaaagtcccttgcttcaaattaaaatgggcttgtgaaattaaaaaatctttcatg

SEQ ID NO: 136741 - DNA, 409 bp, Homo sapiens
gcccaggatgtgggtgatggtatttgttgcccctggtgatggagcagatttgatctgcctatgtgggaagggtttaactcagcgggtgtggattgctcaaaccctgcacgttcccaggaggggcccttggctggctcctgggagctgagctcctgcagtgttctgactgatgagagagactggagccatgttgcactactttgcctggtagttgaccaacaagtgatggatggcaaacacctgctttcgctgtgggtggctggaacttccctgactgacccccaggttcaggagagcctccctggtccgcaccacggcactagctgtcccagcttcttgctggaggaatccggtgcaccctgtgtgactccgctgggagggactctggaagcgcctggcttccctggca

SEQ ID NO: 136742 - DNA, 421 bp, Homo sapiens
aaaatgaatgggcccaatcaggtaatttgtgtgtctcacaataactaccaggaggtatctaccaaaatggagcatgtcaacatgtgtgttgtctaatatcaacaatgaggtgaataggatactttattctatggctgtcagccagccttccacttgggccaccacagagttgacgtagtgagcccataatagagtggccaaggtgcttcctctcaccaatgttgaaaagctattgtaaatgcgtaaactgccaatgaaagagactgatgacaaccactcaatatgacatcattactcaaggaaaccgatcacttggcataagattacatgggagtggggaggtagagggagtaaaagagttggtggcagggtggcaatgatttgtctttacagaattaatacctaatctgaacatggattt

SEQ ID NO: 136743 - DNA, 769 bp, Homo sapiens
ggaaaatgttggtcaaagggtacaaaagttcagttaaacaggaggaataagttctggatatctattgtactatgtaatgactgtagttaataatactgtgttgcatattcaaaaattgctatgtgtcgattttaaatgttctcaccaccaaaatataaatatctgaggtgaaggagatattaattagtttgatttaatcatttcacaatgcaaatattaagttgcacactgtaaatatatacaatttttaattgtcaattaaatataattgaaaaatagaacataataaaatattggattattaactctatcaggaaatgaagctttgagtaacattttactgtttatatttatggttttagccaccaagcaaacatggtggtcaagaacttggactcacattcaggttgccatagtccaaattcaggcttccctactcactaatgtgttcttaagcaagaaataaacttattttggcttcctttggtaaaatgggattaataattgttcctatcctacattttattgtgaagattgaattaatgaaatatacacgtaaaacacttaagacaattcctggccttagtaagatttcaacaaaaatggtcattattatgatgctttattctgttacatttatggattattagacagataaaattggacctcatatgtgaccattctattttcctttattcaaatggaaaaagaatgtcaattcaacatagggaaatactatatatgtataaattattacttaaatttatgt

SEQ ID NO: 136744 - DNA, 470 bp, Homo sapiens
cctgactaagattcatcaaatgctaacttgagatcagcaatttcactgtatggtaattttaagcaaaaaaactcagaagtgtaaacagatcttaaactctagctaatgatttacttggaagtgggtgcatgaaagaatactaatatatttcgaaggaagtttcagatatcaaaaaaactaggttcagtggctcaggcctgtaatcccagtattttgggattacaggcatgagccaccacacccagccaggatacagtattttttaaaaagcacgcccagccttgaatggaaaaccactggacgagagtatgccaccttatcgggctctgtaaatgccttatatctgcacaaggctggaactttgagtggagtccttggctaaagctttcattactgcctggtgacctctcttccctctgctgctaaagcttgtgtttcagaatttagacccggatgcatccatgttgaaa

SEQ ID NO: 136745 - DNA, 200 bp, Homo sapiens
cctgctttgctgcctgccacaacagcatgctattcttcctttcatcttcacatgagggtcttcaactaaaaataaaaactaatactaagtaatagcattaatcagtatctatagatattttttcttcttttctgtgctaattatccacttaagaaatagcttcttaattcaccttcttattttaaatataagctttctgt

SEQ ID NO: 136746 - DNA, 484 bp, Homo sapiens
attgtgttggtgacagtagggatgaagaagaagtgattaatttgagatatatttaggaggtagaaatcaatataacttcttaacagactagtatagaaattaaagataaccaaaacttttagtttggtaaataaatggtataacattaactgaaaaaggaaaagatggtttgagaagatgataattattataactaacactaagcactattctaaatcctttaaagcactaactcatttagtcttcacaacaaccgtataaggtccctaaatctacagatgaaaaaattcatagccatattcttcttgtgagccctaggtctgttttccaaatgcaaattaaacacaactcccttgatgtccctcagacatgagagatgtttaactggttgtgtaccgtacagtgtaatgtggtagttgagagtgtgtctgagatcacatctgggttctgccatttctggctgtgtgaccttgggcaactttat

SEQ ID NO: 136747 - DNA, 369 bp, Homo sapiens
actttacaaactttattatttaattaaaacacacaccaatgctttacgtattattttccccaactttatgaaaatacaaatattcatattcaaagcacacgagcactgatgtccaacttcaatggaatcaaagtgtaccagcctaggcaaacctggatgttgactcattgaacgtcttcacttaagagcctgacactcacaaactaatggctaaaaaacaagtactttctaacagtgaatatggaagtcccaaatcaatgtacacctcttcttagagccttcaaacattttggggctgggtgcagtggctcatgcctataataatcccacagcactttcgggggctgaggcaggcagatcacttaagcc

SEQ ID NO: 136748 - DNA, 604 bp, Homo sapiens
ggtagaaccgggagtggatgcgaagtcttgattttcaagggttgtgtgctcagtggaattacaggctttagagccaagttctaagatgagttagtatttactcaaggaatggcctttgcagttaaaacttacctgtagaatgtgtgattagtgggaaacatgaaatattgggtggaaaatgcttatcatattgcctgacacttggtaaatgcttctaaatggatgtcatcattactgcattttactgaatttaagcaactcacgactctaagatgcatcattactttatgtgcctctaagaaagaaagaaaaactactgccagttaaactatgacactatttgcttgcgaagtgcatccagatttcagagatgtcagtacgtgaaagaatgggcagtgtggtatttcacttctcttttctcaactctatgaagattcttactttactgaattagacacttaacagtacatgaaaattcctgaaggagaagtatacttagtgtgtttgaggaacaacaaggaggccagtgtggctgatggggaaagtggggtaaggacaaggtccaagacagccaggggatgtctgattccatgtcttcactatt

SEQ ID NO: 136749 - DNA, 249 bp, Homo sapiens
tgagattggatgtatgtttgtgtccatgagaaactgccagactttttcccaaaatacttacactattttatactcccatcatcagcatatgtgactcccagttgttctgcatccttgtcagtatttggtgttgtgagtctttaattttagccattctagtaggtatattttgatttcttgttattaatatagtttgcatttccctgatgactaatgatattgagcactttgtgtgtgtttattggctat

SEQ ID NO: 136750 - DNA, 352 bp, Homo sapiens
tggtccaaaataaaatttcccaatacattaataagagttaccataagtatagatataatcaagatctattatttcacctcaactaggtgagttattcatgaataatctgaagtggactgctttaaacgaaactgtgatatgtattaataccatgattcctttaagttttttgcaattttgatttttacaacacatttctcttagaatctttcaagatacagaaactacgttttctgattgtgtattttcctacctcttcctaaaagaagtcttgcctacagtcaattgtctactactaagttagtatgaagaggggcaatatattgaagtaagccaacacaacttactgaga

SEQ ID NO: 136751 - DNA, 540 bp, Homo sapiens
  misc_feature (42)..(42): n is a, c, g, or t
  misc_feature (54)..(55): n is a, c, g, or t
  misc_feature (57)..(57): n is a, c, g, or t
  misc_feature (111)..(111): n is a, c, g, or t
acttgattcagcagccgctatgttatataatgaatttttttnctttgaaggcanngnataatatttgtttccccattcccaaaaacagaatgattttttcttccaaatggnaaaaaagattccttcacagtagccttttaattctatcaaatggatttcttaaatatccaccagttggtaatatgatgtggcacacacatagacttccaatgtgtatgggccacacacgtggtgggccgtcggctagactcattgacacagcggtctcacccctgtggctgcactcttgtgggaaggctggggttggctctgtgaccagtcaggtgggcctaacaccagtgggcagggaaccagagacctttccctgtgtgggaaccctgctcacagggtctcacaaaccgcgctgtccacacgcagcatcgacgccaagggcccccagaaggaaatttgtgattttttgaaaaccgccctataaggcttatggaaatacaatttggaatccattagcttcaggtgtttctccttttggtgatagggaaa

SEQ ID NO: 136752 - DNA, 287 bp, Homo sapiens
agacagggcttttatgatgcgttgagtgcctccttgttaggcttaaattgtgtgctttcaggaagccaaaacagcaatgaagactgtgatttgcaaacattgcatcattgggttacaaattcagagcttttctggagagatcaaaactatacattttcaccacctgatggggtctgactgttgggaaatgacattcctgttcttgcattatttctggtcatttggtgagtgatctcagagtgcagggctgtctttgttcagaacccagctatcaggagtgagatgaa

SEQ ID NO: 136753 - DNA, 297 bp, Homo sapiens
tttgtaactaacctggcattataaaatcactcccacatagtagctgggacaactttatatgtctgcagatttggcacttattccttcaaaaggtagattttaatcgttttatccttgaatatggcctcatttctaacaagtagaatgtggcaaaagtgatggtgtgggacttccaaagctgggttataaaaagcactgcagcaggacaggggagagagaatatcaggaagaagagctaatggatgctgggcttaatagctaggtgatgggatgatctgtgcagcaaactaccatggt

SEQ ID NO: 136754 - DNA, 108 bp, Homo sapiens
aatctagcttttacctagtgcagctgaaaatctctctatataatgcaaaacttcaaaccaccttaccaaagagaggacagcactgagacctagttatctcttaggaaa

SEQ ID NO: 136755 - DNA, 469 bp, Homo sapiens
aaataacgtcatattcatggatactggggataaggacttccatatcttttggggagatacaattcaactcataacaccaattatattggaaccctatttgccatctgtgcacctctgcctgcgtccggcagcttctcaggagaagtccctctgcctggtctgccattcttgtttgccatgcagatttcagcgaagaagtcacctgctggagaggccttccctggccaccctcaatatagagtgattgaatgagtgaaatagattgcagagtaaaattaaaatgtgattgagaattatgctgagcataatttacccttaaaagtgtgagagaactcctctccaccccacatcaatgttacttgtaacttttttgtatatgttggctgtgtccccatcacagatgctatttaaatatcattttgtgcctgtgaattgagatgtcgggcaccttctgaatgtcatgatgttt

SEQ ID NO: 136756 - DNA, 393 bp, Homo sapiens
ctatctaatattaccatagagatctcagatcttccacatctgcagggaaagagaaggggtgtgataattagcttttgtatgaggggtgttgagtagtctttcctgagatgatatctgtaaatacggcttgaagttgatgatgtattaggttggtgcaaaagtaattgcggttcttaccatcacctttgatggcaaaaccacaattacttttggatcaccctaataggaaaggagcagagtaggataggcatgttgggagaagtggaggacagggacgcatagaatgtctgctgtgagatgaccagtgacattcagccatttccagttgctcgaatggtgcagcagtgactttgaagtgtccagatgggagtggagtgagtgtctccacttgca

SEQ ID NO: 136757 - DNA, 443 bp, Homo sapiens
ttcactgggagaaaagaggtttatagcttttgccacatgatgccaattactttccacacatatggaaccaattcacagtgccagcagcaagaccctggtgtgtccgttgctctgtgctctgccaaatgtcttactcattgtgtatatttatttttgctagtttaataggtgtgtgacagtacttgcaagctgtttgaatttgaatttctgtaattgccagtgatgttgtgtatgtttccatgccatgatttactgccagtgttttcttatatgtaaattaactgttcattctctcaaatttttacttgctggaatctgtgagcactgtgacagccagggcaaaggtctggccatcactgctgggtcccaagcatctggcaggagatcgataaactttggctaaattaaattcgatcatcagctgacatggagttgcaccaatg

SEQ ID NO: 136758 - DNA, 315 bp, Homo sapiens
cttttgcttcattagagatacactaagacaggtcccttcctaatccattatggcagattccctaaagaatgttagttagagattttgcatatattgttcattacttcgcagtgcagatatgcaaaaatgcagatgacctgccattaacttgcttaaagaccaggaaggggtgtcctcttcctgactgatctggctggcttctgttgcagagacctctgtcttggaactgcccatggcaagatatgtgcctgctgacgggaagcctggtagtaataccatcaagccttatgtccagaagagcacaaaatgtttctc

SEQ ID NO: 136759 - DNA, 219 bp, Homo sapiens
tctcccacagagggtattgccaaacctttgggctcttgccaactaaagagttggaaaatgcagccaggcgtggtggctcacgcctgtaatcccagcactttgggaggccaaggtgggcggatcacaaggtcagcagatcgagaccatcctggctaacatgctgaaaccccgcctctactaaaaatacaaaaaattagccgggtgtgatggcaggcgcct

SEQ ID NO: 136760 - DNA, 184 bp, Homo sapiens
tctcaacaaactagtccctttgactcccattatagccttctattatacaaatagaggcacgtgtggtttgtggttgaggaaaagaatgctcatcgctagttcttacttgcagtgacttatctgtgaatttctaaagtgcctaaaccccttctgaaggatataatgaaccacggaaatggaaaca

SEQ ID NO: 136761 - DNA, 359 bp, Homo sapiens
caagatgttgccctcttcttcagctttatgctgaagccacacaaattactaggcaagaagcaggtagggaagattctagataagggctgctgtgaaatacaagaaaacaacaagaacaacaaacctggcattacagtacagttttcattcccaatgcatgctttttattttattttttgaatctagaatgctaaagtgaaaatcggttatctcgtctcctcactttgcagactgcttaaggcccagagaggttatctgctcttcctgagctcacacgctaggattacaccaaaagtagaacaacctgtcacttaagttctttatctttcattatatactatcccaggaacagaagatgt

SEQ ID NO: 136762 - DNA, 317 bp, Homo sapiens
tagtgagagaaaggagacctaggggaggaaaacacagagtgcgctaatcttatgatacaagtcatatgagtcctctacctgctatctctccccaccaggtttctgctccctttgcagaacactagtaatgcccataaatgtcgatttaaaaaaaattcactggataacatcttgctataacaaatataactttagattacacacattcagtagaggatagctgagtgtagtctgtcaaatactgtgatttcaacctcaagcttgaatcagtcttaaaccaaagataatacatttgcataaagttgtagcaggtaggg

SEQ ID NO: 136763 - DNA, 314 bp, Homo sapiens
tgttgggattacaggcgtaagccactgcacctggcctaatatttggattaagtccccctgttgaaggtctatgtaccattggagagtttggtaaaaggtcttcttgagggggaaaaagggtttttgagccattatttacattttaactctgggaatagaaggcctttgcttttaagatgtcattctttaatagctttagctgttagaaacaagttttgggggatgtgcacaattgaagattttccgcccttttttggcctaatttactaataaagagctaatcttattgcccagctattctttattaaggccag

SEQ ID NO: 136764 - DNA, 581 bp, Homo sapiens
cagcattaaaaagaaaattctgacacatgccaaaacacagatgaaccttgagacataatacaaagtgaagctagtcacaaaaaagataaatactgtatgatttcccttatatgaggtaccaaagtagtcaaactcacagacacaagaaaatagaatggtagttgctaggggctgagagaaaggagaaatagggcgctgttgtttaatgggtatagagtttcagttctgcaagatgaaaatgttctggagactggctgcacaacaatgtgaccacacaacattactaaactgtgcacttaaaaatggttaagatagtaaattttatgttatgtgtctttttttaaaaaaatttaattaaaaaattccctacactcaagtcagtattattcaatattgtagactgtattcagtaatatttttgggtcatgttttgaattttctgactacaggattcttcatctattaaaaagccttgtgggtgaactacacgtttacctaacattaccaactggtattgtgagcctgcattaattaaatgttctgagaaatccactttgacttcttttaatcctttatcaaaa

SEQ ID NO: 136765 - DNA, 455 bp, Homo sapiens
ttacagtcaacctatttagacatttggcaaaagattcttgctgtcagtatataaaatgtgcttgtcattcataccaactgacctttcccaaaatcaggcagtactgagttaggacttgtttaaatctattcccatgccagaatcttatcgatacataagaaatttaggaagattaggtgccaaaacacccagcaccatacttgtatgtttttagcaccatacagagctaaaatctcaggaactatgaacactctagaccttatgtggtttattccttcagtcatttcaaacattgaaagtagggcttacatggtgatttgtctgctcactttatgtttacgtctcccacattcatactagtatacatcaggtttgcttagccattgatatttttttaaccaagccttacagtgattatttcatgtgtttctataaatctcactttgtgcttttat

SEQ ID NO: 136766 - DNA, 483 bp, Homo sapiens
agttttcataagtatcacagggctaagggatgagcaagtgatactaggttaaccaggactccctgaagacattgttagattatatgctttaggagtgattgtgtttttgatgattttcaattccttcaaatatgccactatattctagtatttcactgtttttatttcatagcagagtccccttctgaatcatggtgtatattcatgatgtatgttcctaggctagtattttacccaaaataggaaagttttagagatcattttgtatctgaaaagtattcccttatttataatgttgatatctaatataagtaatgtgataatttcttttaatttttgtatttctgattttttcagcatttcttattggtcttctgaattgtataaagaacaggtttttaaaaatacattcaccagcctccctaagaattgcatgagagtacctcttaccactgttaaataaataactcctgctccctttgt

SEQ ID NO: 136767 - DNA, 496 bp, Homo sapiens
actgctctggagattgattagataaccgtggcaaagtgctttgaagacaagggatgtaggaaatgttctgtgtgggtggattcccagggcgcttcagacgagattaaggcccacgaatgggtctgctcggctggccgggatgctttgtgtggaaaaggagtctttcccaaaacatttctcctagaggggctgccaaaatccgcccagctctgctccacacccaagcgtgtcttccttcagcgtggctgtcacatgacgaaaaggaaacttctacactcagttcaattgtggactggtccatgtgatgttgacatgcacttagatatcaaagtgtgtctttgatgagaaacaactactgaatgttttatttgtgcctgtattttttaaagtattttatttgtagaaaaaaataaatagagattaggagtggtggctcacgcctgtaatctcagcactttgggaggccgaggcaggctgatcacgatgtcaggagttc

SEQ ID NO: 136768 - DNA, 427 bp, Homo sapiens
gtagagtactggattattctctatccattcatcaggacccaaatgtaccaattcttaccaagaaaatgtaacagaaatgtccaaatgagctatcaatagttaaaaacatttatttgaaaaatgaggcccctcaattacaatatttaaaacccaatttaaattttaaaaaattagggtgtggtagggcacatctgtagtcccagttactttggaggttgagatgggaggactgcctgaacccaggaggtagaggctgtggtgagctgtgatcacaccactgcctgggctccagggtgagactccatctcaaataaatcaataaatgaataaataaatccaattaaaaaaactacagtgaacagcagctgaataaaacccaatttaaaagtgaatgactagtatgcacagtggctcacgcctataatcc

SEQ ID NO: 136769 - DNA, 938 bp, Homo sapiens
ctcttgaataactccagtgtcttgaaatctactatcttcaccctcatgaaaacgtcaagagtttgaggaccacctctttctacatctactagcctaaacattttccctccctttagctagtcctccttgacatagtgtggactcctggcatcaccttgtctactctctggatgagctcaaatgtgtcagtgtgcctgtctaactttggtccagatgtggcctcaccaagccaaatagaactaaaccattacctgcttgcttgtagacctggaccgtaggagagcccaaggcccccttaggttttctttactacttatgctactgactcatatcaaactgacacctaagctggacatggtggtgcacacttgtagtcttagctgctctagaggctgaggcagaaggtagcttgagctccaagagtttgaaaccggcctgggcaacatagcaagatgcccatctgacaactgacaaaaacctacaggtgttattttcggggtaaggtagggttgttttgatttcataataataaattaatgcattaattttatacaacatataacattaaaaaccttcattcaaaaaaaaaacaaaactacaggttggacatggtggctcacgcctgtagtcctagcactttaggaggccaaggtgagcggattgcctgagcttaggagtttgagaccagcctgggcaacatggtgaaaccccatctctactaaaatacaaaaaattagctgggcatggtgtactcctatagtcccagctactcggcaggctgaggcgggagaatggcttgaacccaggaggtggaggttgcagtgagccgagatcatgctactgcacttcagcctggatgacagagcaagactccaactcaaaaacaaaaaacaacaacaacaaaaaaagccggtcgcatggcacatgtatacatatgt

SEQ ID NO: 136770 - DNA, 930 bp, Homo sapiens
ggagggaaaatccccatctgagccacagatccaaaccagaaggaactgaatgagatgctccgagggataaggcctgtcttagagacatcctcgcatctaggagagggggcggcagatgggcagccgtggagcccagccctgaccagctgctgtttgcaggggagagctgcctgtgtgcccctgtggtgagtgcgtggtgacagtgggattaagtgtacccagcaacctcagggaccactgggtggaggagacgcacggcgggcccttctgcctggcccttcccgcaactctgagtcctggatgcttggggcttgctaatctccatccccacggcagcgggatgcgacacaaccattactaaggccatggaatctcccacctctcgatggccaggcggttcacccagcaagtgtctcctaatctgaagagctgggagagcgaaagattttataagttatcagagaaccccctgtaacctcccttctagaaaggaagatgtaaaccaggacaatgggcctgtagctggcacctgaagtcagtgatctctctcctcccctcctctaaattctccttcttccgtgttttctacatcccccgtgatttgagtctgctgatttcatttgttatgtctgccttctgtttcctgcctcatttcacaaagaattagatgctgctctcaacaatacattcaaaataatacaaccataaagtaaatatttgagtaatttggagccagaggaatatatggtaacaccctgaggtggatgaaatgccgggatttcttagtgaccccttttcagaatactgcttctggaaccattctagtgtgtctcagaatgacatgtgggacatattatctttttttttatgttatataagcaatttattcaatgcatgtttattaaagcacctatgttttgaaaagaaaaa

SEQ ID NO: 136771 - DNA, 588 bp, Homo sapiens
agacagcagtttgaagtgtcaggcaggatgcccctttcccaagtatgccgccctgggatcctgtccggggttggggaggcatgctgtcagcacatgtgagggccttcgcaaagggaatttcacctctgcaagaggcctgacaggccacgtctccctgggaaccaacctcctggggtacgaggtgaggagctgcagatgtgcggtggttagcccctgccctttgcgtgtcatccctatcaagtgtgagaaaggacaggcaggctgcagctaactagtgttcctgaggaaaggggtcagagaaacaatgcagatgctcaagacctaaggctacgtgggagctgcacatagatggatatacttgcaagtgtggggacaatggctgtgcaccccaccatgcctgggtgagggcgtgcagtggcccagattccttggggagtgggacctgtgggcccccataggaaggctggaaaagtcaggccctgctgtctgcacagactctagcctgggaggacacagagtgagggaacatgatggggcctaggggctcctccagcacgtgcctgccctgccctgggcttgcaattgtga

SEQ ID NO: 136772 - DNA, 954 bp, Homo sapiens
atagtgctatacttccactaagactttgactatgttctagcaacagagcccaagtatgtagtcctgaccatggcagagttatatggaacagttacactgtcagtttcttaatgtacattttatgttccttatgcaaaaataataataacctatttgtcttttattagccataatctctttctatttttagaagatagcaaaatgacttgctcatctcaaattagcagaaaattgttttacatattttcttcaaagaaacaagaacgaaaacaaacttagctgtaaattatctcccatgagctgtcttcatttgttcaaagggtagagaaggaaatgacagtgagaaagctagcatgtatgaagcatttattatgtgccagcgactgtgttaggtaattagtattcaaagtggttcctttcagggtcaccacatctcatataacagtgctccagacaaattctacaatatcacatactgtggattaaaagagtgagcttcataaacttttttttgtgctaagaactcttaaaatctgctctcagcatttttcaagaatataatatattgttattaactatagtctctgttgtacaatagatctcttgaacttattcctcttaaaagaaacaataggcttcacaggatcaagagaagagggctttcagattcccagtctgggctttgtccccagatagaggcgggctggagctcaggccccctcattgatatgtggtgtgtttattcattccctagacgtaccctgtctcttcctcttgttctgtcttcctgtaggataagcatgataaagcatactgtctgaggaggggtatgtaggcttctgggacccagataatctggattcagtgctgtaggtttagaggagttatgtgagaaaatcaactgcctagtaccagtggatcatggtaactgtattattatatttaaaaccttgc

SEQ ID NO: 136773 - DNA, 801 bp, Homo sapiens
actcagttaaacttccctaatagatgacatcttccatgtgttatggtaatttattgctgaaagaattaagcacatcctgggtgactccatggggagaagactcttagaaatttgtttggtttcctccaaactttgcccatgcgcaactttcagctttgcttattttgctttgtgttttttcgctgcaataaattttagttatgaagcagactgcatgctgagtcccatgagtcctcctagcaaatcactgaacctaggggtggtcttgggggacactgacacagggagttgattgtttggcaacacaagttgtttcagagcaaatgaattctttttccacaagctagcatattagtaaactatcagggagcataaaatcagttgactgagttctgtcgggaaacaaagggaaaatttttcttcaaaaagacatgatatcctccctgttaagcaaagcagtactttccctgtggataagtgtattcagttggaatgtgcttggctgcaagaaactgaaaactattatattacaatgctttaaagaggctagtgacttgtttctgagggaaagatatctaggagtggtacagtcactcagtgatgattttttctttttgctccaccatccttagtgtatagtttttgtcttcatggtcacaaggcagctgctacagtgccatgtattgtttgatgtccaagtgatcaggaataggagaatgtgaagggcaaaacccaactctgccctctctagggacttcaatttctatataattgactagcactgtcccacaggagctgaaa

SEQ ID NO: 136774 - DNA, 1303 bp, Homo sapiens
cactttctgtacttctgaaccaaaatttggatgcatgtttttctttatcatgagtcacacctgattaggatttccttagcttttgttggggtcagacaggattgtgaccaaaggcaagatttctctgtcatctcttttgacagaatttccacaatcatggattttgtaatagtcctggacattcatcagaaagtaacctgtagtggggctgcctacataggattcttcctttgaaaagccttaaacatttttctaatggttggtctctcttaactaacaataaaaaacagcaacaatgcagctgggcacagtggcttttgcctgtaatcccagcactttgggaggcccaggcaggtggatcaactgaggtcaggagtttaagaccagcctggccaacatgtgaaaccctgtctctacgaaaaatacaaaaattagccggatgttgtgttgcacacccgtagtcccacctactggggaggctgaggcaggagaattgcttaaacccaggaggcagagcttgcattgagctgaaatcgtaccacagcactccagcctgggcaacagagtgagactccatatccaaaaaaaaaaaaaaaaaaacaaaaacaaacaaacaaacaaaaaaaccagcaacagggatagtcagcataactaatttaaccagcacatccatttcgtaaaagacatcacacattgtcatttgtaagcctgggactttaactatttctcaacttttttagctgaataatttttctttttaaaacaaaactgaaatctgttgtatccattttagaatttatctcagtagtttgtatattcatatatatgtggtgagtttaagaagacgtatttagaacatttttatcttgttagcaatttgacatagaaaaatgaaacattaatgtttttattgtgagtcatgtcactggcacagttttcctctagtatcatgtgtggtgttaccttctatgtaaatttgccaatgaataaatgtttagtaaacaaacattttgtatttcattgtttcactcctctacaagatactgactagtttacttagtttgtaggtcactagttaactagttgaagatagaggaaagtttacctatcagaaataaattgaagccttctcaagtcatagaaggtttcacatttatgatgtaccaactactagcaaacataattaagggatcattgtattgtctaggtgcagcttagtagaatatgtaaagttttttagctgtccattaccctggtataatcttggagccataacccaaaactatattcctggcaagcatgt

SEQ ID NO: 136775 - DNA, 220 bp, Homo sapiens
accgctgaagcggcagcttctccttccaacagttctaaaaagggcaggaattgagtccctgtgagcaagctgggcacagccccccacctttccgcagcggagctgtggctgggagacacagtgcctgggtgtgggcctggccagacgccaccctggatttgggaggctcttgagacaaggcaggcagagctttgagccacccccgtgatgggtgtgctgg

SEQ ID NO: 136776 - DNA, 314 bp, Homo sapiens
tggtgtagggcagccgttcctggtaatgagagaggcagagaaagcgggtatcttgcctgggactggtctgttgccacttcctagaaaacgagggtagagtaagcaaggaagaagggaagacgggtgtcgggtgtctgccagtgccctagagcgcagagaccgtacattaattttttcaaaatttccagaatcggaaggctctaatgattttgtgttgtagccttccagtcttttttctatgcacgtatgtttttacttttttcagacattgtaacatactttaattattgttattaatctctttttgcacttga

SEQ ID NO: 136777 - DNA, 435 bp, Homo sapiens
ggatcaggagggagcattctgggttttctgcccaggtaggcactttcccagatattttcctccaactacacttgaggccagagaaagtctatgataaacctcttcccagaccctctgagtatttgagacactgcttttgtctctagcctccatcctctgaccctgacctgttccttatctactttccaaaatctctggatggccccagaggcctgaatggatttggcatgtgttgcatcttagacagggttggggaatcagatatagacaaagaaaggagcatttgaaaggtcaagggaacaaagaggacatgagacatgtggggtgggcatgaggaaatatctgtggcttgagtgtgggtagtagggtgcttatggagaagaggtaggaaatggagttgaccagaaaagcagggtccagattctgaaagaccat

SEQ ID NO: 136778 - DNA, 514 bp, Homo sapiens
accatttcaatgctgtagacgtttgacatgacctttgttttaaaagctttctcctttggcttttgtgtcacttctctctggaatccctcatacctttcaacattttttcctgtaggtttctcctcttctttaaatgttagatttatatctttagtccagtcctctttgaacatcttactctcataatttcaaatatgacatatatggctaacatgtaaaactcctttctttcatgcttggtaatccagttgcccactggacacacttctattgtatgtcccacccataagtacttctaacacagactctctctctctcaccccccacatatgtgtgtgtatgtgtgtgtgtgtgtgtatttgtatgtgagatgtcttaaacattttatttatttaatgaaaaaactgataactgttgagctcagaaaccaataccccaacatacagtactttgacatactgaactgaagaaacctcaagatctcttctggctccatcatgtccccacctccccc

SEQ ID NO: 136779 - DNA, 1102 bp, Homo sapiens
taaagataatgacatggggaaatgcttactatctatgaaaaaagtaaaatatgaaactgcatatattgtctcagtcttatatgtttggagctattttaaatagtgttgctttgaacattcttatacatgtcttgtggtaagcatatatatgcctttctgttggggaaatatctaggaaaggaattgctgggtcgtatagatacacatttgtccagccttagtagctattgccaattagttttctagttttaccagtttgcccattcctagcgcatgaactcccattgctgcatatcattatcgatgcttgacatgtctgttttgtgttttcattttagccattctggtggatggcagagacactctttgtggttataatttgcatttccctgacaagtaattaacttgaacacttttctatatgtttattggttatttgactgtcttctttggtaaaatgctttgaagaggaacattttcaattatcagaagaaaaacattttatttttctaataacattccaaacaattatgatgacgctattctaaggaccatactttgagtagtgaggctttattgtagaagagctaagtgaaatgatatttgaaagaacctgcagaatttgattgtggcgtagcttttggcagtcttagagggtttgaggtgagtaggagaaatctcaaaaaaaaaaaaaaagacagtgaagagattttggtaacttaaactttttattatataaatatcagatatattcaatagtagaaaagtagtaaaaataaaccctgcaggtatttgtttatccagctttcataattgtcaactgaacatttgccaattctgtttcttctgtactcccacttacactcccctcccttcaccccattgcaataactaatttttctttagtttacaaactagagattgcagagggtaataccaatactaatgtaaacagaataactctttttttaatgtggcgtgtttctgggtatgaaatttaaggaaataggacagaaagttaaaaggtatatataaatgaagacattcataattgttgatacttgtgaaaaacagtttaaagcaaataaaaatatctaataaa

SEQ ID NO: 136780 - DNA, 545 bp, Homo sapiens
ggagaatttacatggccctaaaacaataatttgctaccttggccacacattagaatcatctggggaactttaaaaaatccacatgctcaaccaagttgcatcccagaccaattaagttggaatctcatagggtgggattcaatagttggtataacttaaagctccctgtgattccactttgcagcaaggctgagaaagactggtttaaagcaagaaggaatgcttacctgggtacttttggcctggtttatccacttaggtatcatactcattatattcatagttagaataattcactgttctataagtataaccactattatacttaagtataaatatacttaaattgcacttacactgtttgtctacacaggcacttaaagggtcctgcttactagggttcaattcacatcatcaaagactgaaacttctataaagttttagtccccctaatttaacaaaccagtgtagaatagcaagacattcatcctaaagagacttgtacattgaagtcgatgtagatttgggactcaattcaatgaact

SEQ ID NO: 136781 - DNA, 256 bp, Homo sapiens
tagctgggattacaggtgcccaccactatgccagctaattttttgtatttttagtagaactggggtttcaccatgttggtcaggctggtcttgaactcctgacctcaagtgatccacttacctcagcctcccaaagtgctgggattacaggtgtgagcctccttgcctagactaaggcacataatttgcaaaagaaattgaggctcttatgcacaaatccagtccaccattgagactgacccctgtacttagaccc

SEQ ID NO: 136782 - DNA, 100 bp, Homo sapiens
attggcgcagtccctgcttactgtagccttgacctccagctcatgtgatcctcctacctcaaactcctgagtagcctatagtcccagccaatcaggaggt

SEQ ID NO: 136783 - DNA, 316 bp, Homo sapiens
agaattacatcatttctggtcacagctgtctaagcgggctatgattttgcttcataaagtcttattgattttgattattcttaccttaaatgttttttgtagagatggagtcttgctgtgttgtcagggctggtctggaactcctgggctcaaatgatcctactgtgttagcttccctagtagctgggattacaggcatgcaccatcacacctagttcagattgggaaatctttacagagaaaattaagttctgttttcttaggaaagtagcatatttatattctttgtgggtcatgtgatgagatctcaaatacc

SEQ ID NO: 136784 - DNA, 1182 bp, Homo sapiens
ggtcttgctctgttgcccaggctggagtgcagtggcatgatcactgctcactgcagccttgatctcctgggctcagaggatcctcccacctcagcctcccaaatagctaggactagaggtgcccaccagcatgctcagcagatttttaaatctttttgtagagatgaggttttgctatgttgcccaggctggtctcgaactcctggcctcgagcgatcctcccaccttggcctcccaaagcactgggattacagacgtgagccactgcgcccagcagatttctctttaacacctagatttcagcctgagccaggcaggcattcctgaatgaaccagtagtactgctcccagaagaagaggtcctcctccgtgtgacacagtccccacttggcccttgcagggattggatctgggatccctggatttaaactcagggccatcctcataacagcctcacaaggctgggattagcttcccagttcacaagggaagaaaccaagacttgagaaggtcaaggtctggccagacccacacatcttggaccctcataccgcctcgaggccccatgctgccctctgcctgctccagatgtgaatactgctggccctggctggccccggctggccccgagggtcctagggatgaacagcccagcccagggagagctcagccccttgtgcctctgccccttcccacctcctgtggaggccagtcgactcacccacaaagggccaggcactgtggggatagatcagctaacaaaacagttgatgcttcctgcccttctgggccttacattttggctggaagaagaggggagaggcagactgtaagcaataagcgcaataagtaggttgcctggaagtaatgttagatcacgttacggaaaacaggaaagagcagagcgacaagtgctggggtgcgtggtgcagggaaggcagctggctgctgctggtgtggtcagagtgggccctcatggagaagactgcattcgagcagaaacttgaagggggtgaggggtgagcctagagatatctggggcagagcagtccaggcagaggggacagccggtgtcaagcccaggacaggagtgtgcctggtgtgccagtttcaggcaagaggccagtgtgcagaggcaaggtgagaacgcaagggagagcagtggcggagacgggtgggaac

SEQ ID NO: 136785 - DNA, 286 bp, Homo sapiens
atgatggagaatttcatagggagctatattgtctggagattagggctgatgggatcttcttgatctgcctcttctgttttgctgagtaaggatgttggaaacagatatctttagctgctgtgaaaaaaataggttgtattttttgtcttcttaagtttatttgggataaatgcagaaaaataatatcttgcaggttagggtttccaaaaacagtacttgtggcaaaaatctcatttggttaaagttattcttcagaaccctttaaagcactcacagagtatagtga

SEQ ID NO: 136786 - DNA, 404 bp, Homo sapiens
acctctctaccactctcaaccagagtcgtctggccaagcacaacgaacacagagaagatatgccacaggaatctgtttgggacagaagtagaacctggaagcactcctggcctggctccagcagtcacacagatggaacacaacagacctacctactcaattttttaaagttctctggttgaatctggtgtgcatcaggtttggaaatcacagacctaaaacctaggtcttagaagatctaagactgttcttcaactcttccagcagagatcagaggctcacccctgtaaacccagcactttgggaaactgaggtgggcagatcacttgggtccaggagctcaagaccagcctgggaaacatggcaaaaccctatcgctataaaaaacacaaacgaattagcca

SEQ ID NO: 136787 - DNA, 150 bp, Homo sapiens
taccagttaacttgaatgacctaagctctggttttagtttttggactgctgtacagtgtgctgtttatcagcttagagccaactactgccttagcaacaagatatatataggaagagcttctatcctgtgtcacctattattcctgaccc

SEQ ID NO: 136788 - DNA, 146 bp, Homo sapiens
ttattcccttttacaaaaggttggagctacaacagagattacaggttattcagttgagtgtcctcatttatagatgcagtcagcatgcctaggatctagcctaaaggtcacactgttagtcatcattcttttttttttaaacattg

SEQ ID NO: 136789 - DNA, 903 bp, Homo sapiens
gtaattgctgtttcattttaatgtctctctgggcctgttaattaaaatagcttgcattcctcagatgaaagttattttcttctctcatttcccccttttgatcaaaaatctttcttcttaacagcattgatgatcaaaatttgagtttcaaggtgtccatcatcaggaaggctcattcccaagtagttctgtcaaagtcattgatttatggctgctgttgcttgttgaatcgtagctagacttcagagtatcgtcaatttagtttcatcagaagaaggaaaacaacaagagatagtggaaatataatccatgtaaggattataactaaaaataaaatttgaatgccagaacagcaacaaagacagaactattccattaggcagtcaactaaaaatatcatgaagaaaattaaatccaggttcttctttagagactcatagctgggaagtaattcaagatttaatccaaattgtaggcaaataataaaactcaaaaacaatggacaagactagaatctaataaccggcatactatagtttttttctgaaacattttttctttatccagttctccatttttaccaaagacaaatcttagttgaaccaatttatttgcaaaataagttttagtgttatgatgctttgcctacttatttgcataaagtgcaagaagaatagtgaatggccatatagtctcttttaagttggctttaccgggacttccacagtagctttagattcagcttttaaaagccccaaggccagccaatccaaggatttgccctcagactgtctgcagtacttgtaaaaaatgggtgaactctgctcttcttgagatcccaaaataacctgagttcctggtcctgtcagaaagtgacattctttagttaccatgaggacagaa

SEQ ID NO: 136790 - DNA, 163 bp, Homo sapiens
tgtctaacaatattttctatagtttgtataattaaaacattccaaataccaaatgctcaaaacagaaactcactcctagattctaatactgtccagcccatcagtacccccaaaccccagactccaggttaataatcacgtgctaagtgatgaaaagaagaga

SEQ ID NO: 136791 - DNA, 542 bp, Homo sapiens
ttatgatgaaagtcgtagaaatagtgtaagactgttggaaatttcagaaagttgccaggaagtaggaaaagtcactacccctgccaccactcaaagataaccactgcaatgttttcatgaatcccttagtctcttttctgtatacatttagcataattgagatactattatacataaattctatactctactattgttaactagtattaaaataggcaacttatcatgtttctgctttgttactctaatggctgcaaaatatttcaacatatagaatatacatacatatatgtaccacaacttatgttgactcagtcttaaaattatcccaaactttgctgttgaaaatgatcatgaagggtgaggggcaaggggaatgagagcattaggacaaatacttaatgcatgaggggcctaaaacctagatgacaggttgataggtgcagcaaatcaccatggcatatgtgtatctatgtaacaaacctgcacgttctgcacctgtatcccagaacttaaagtaaaatttgaaaaaattttaaaaa

SEQ ID NO: 136792 - DNA, 141 bp, Homo sapiens
aggcctgtccctccctgctccaccccacactgtgacataggaaaatagccagacgccttgcagcagacacccatatgaactcccatctgctcacaggggacccagacgcctaaccccactcacccctgcacacacacacac

SEQ ID NO: 136793 - DNA, 622 bp, Homo sapiens
aaacaactttaatcaaaacttcattttttaaaaaagatactattagagcagttaaaactttgtgttgatcatcttaacatttttaaaggtagtacaattattcttagtccgtatttgtgtactctagtttcctagccctgtttctcagtgctgttttgctaatatctctaatagtcttacttaatcttgttgaaagtagcacttttgaggttaataaggtttaaattaataacccccattgactgtagtctataatactataattttttaaatggcaaaatgccctctgggagctaaggtgtcttaaaagcttagagcaaatcctgttaaatgggacaaagtctcaattcttttttaataagacaaaaacactttatgtagtctcttttctttttcagtgtttctcgaaatttcaattttattccatgctgctacagaatacaaacttacccaataaaaatagcagctccattgaaagagctttcccacaaattgaaatatttaaagcacagttacaggcttgtgtactgttggtgcatacattgtttgatttgttcagttcctcagttttgcagggaaagatgtcaacattatctgatttttcaagctatctattcaatga

SEQ ID NO: 136794 - DNA, 197 bp, Homo sapiens
cctgagcttcttggtgggtctgtgaagtaaagggctgtaccacaagtcatctgtatttattttcataacacacctcttcaaattgacttgcttttatcatttaatttgtcccaagctataataattgatgtgatattttttgtaatattcattaaaataactccataattatggcacttgaaaaaagttatatgaaa

SEQ ID NO: 136795 - DNA, 805 bp, Homo sapiens
acaaaaacaaattgcttatttcttatatccatgctggaagattatctggctgaccttatcagctgtgatgtcaggaatgtcagccagttatcctgtggtgcattcagctgggtcattgtaccccatcagtgaggcaattgcaaagttccatctggacagaggtagaaaaaattatattcactttgagttttggatttttttctcttaattttcaaagataaagacaattgcttttggcttttaagagacacatctggtatgccttgggctggatgccagatatttctgctgttgagtttttataacattatataggcctcaatattttagaactagtatacatttgataaaagtgacttttctaaagttttagggagaatcttttgcttaggtgcagctgagtatttttagttcagtactacagatggcataccaaatttaagaggagttgagtgactgcttcaaggttgcacagctagttcttggtagatctggaaaaggaccaacatctcttggccctttgtcagatattctttctttgatttcacactgtttttaaagatgcttaatacattttaaattaaaatggttatttgaatctgcttaaactagacaatactaattgtcaaacatccattacctgctttttctctagtaacagattggtgcaaaaagaattgcggtttttgccattacttttaatggcattaattacttttaatggcaaaaaccttagttccttttgcaccagcctaataataaaacccctaattttaacttggcacgtggccaaccagaatagaaa

SEQ ID NO: 136796 - DNA, 356 bp, Homo sapiens
tatattgctttaaataatatctatatactggtgcttggcaaattattatctccaactccaatctcttccttgagactaacatatccaactggctaactgacatctccttttgtgtatcaacttatttcaagctcagtatgtccaaaatcaaactcttaattcctcccccatccaaatcaatcctttcccagtcttttccatgtcagtaaatggtaccaccattcatccagttggtctctcatcccacatctaatctaccatcaagacttcttggcttatatacaaaaagtattcttaatctaaccaatttttcccacttgttactgctcttgtccaagccacggtcataattcatc

SEQ ID NO: 136797 - DNA, 532 bp, Homo sapiens
tgatgtcaaatttatcaaagccatttcaacaacctgcatacccaattatactgataggaatctgcccacgatatttgtttacctggaaggagatatcaaggctcagtttattggtcctctgagtgtttggcggcatgaacctgacaagagatgagttggaatggaaactgtctgaatctggagcaattacgacagacctggaggaaaaccctaagaagccgattgaagacgtgttgctctcctcagtgcggcgctctgtcctcatgaagagggacagcgattccaagggtgactgaggctacagctgctatcccatgccgaactttcttgtgacaaattgtctggattttttaaaaaaggaaaaagcaagaatgaatccttgtggtttttagttttgtataaattatgtttcaaatctttacattttggaaataatcattgctggagattctgttaaatattttggaactcttttttttttaaattatagtatttcctctaaaaaaaattaaaaccagccatttgtatggca

SEQ ID NO: 136798 - DNA, 348 bp, Homo sapiens
cagagagagaaggtttagactaaagggacggaggagaataaaggcagaacatctcagaaagccaagttgacatatttttgagccctagacacaaccaatagaagggagctctgtgaagtttgaaaggcttttcacacctctttcagaaaattcagaaaccttcacatctctttctgaaagttcagaaaaactaacgacataaaaaataaaagtccttcctactacacatagaaatctttggaaacaaaacaataaacaagcatagcaaaactctgaaaagatacatggaagaagatgggctgtccagagacatcaagagttgatgaactgcagggtgatgagttctct

SEQ ID NO: 136799 - DNA, 235 bp, Homo sapiens
gtacaactattcctatttgacatgtgagaaaactgaggctgagaaaggtgtataaactcatccaaaaacagatctgatcccaatttccagagtctttctatttgccctatacaacattgctccatcactacttctcacaaggctatccacatggttgtctaaaatttccagtttctccagtgggaaatgccttcttcttcttaccaaatatcatgaaatgagaaatactccaaat

SEQ ID NO: 136800 - DNA, 202 bp, Homo sapiens
aattgataacagagtttatatacctcctgtccccatctgtacacttaaaaatgtatgtgctgttctaatgctacttattattattcccttcctttgtagaatgtatcaacactaaaagtgtttaatcctgactataacaattatttgttaactattaaaggggtaattatactctaagcttccagttttcagttaaaacaaa

SEQ ID NO: 136801 - DNA, 189 bp, Homo sapiens
tctttctactatgcttttgcttatagtcactcagcaggtatttgttaaaaagaaaagtcagttaacactattcccttcccttctctaccataaaacatatttaaggccgggtgcggtggctcatgcctgtaatcccagcagtttgggaggctgaggcaggcaaatcacctgaagtcgggagttcaagac

SEQ ID NO: 136802 - DNA, 287 bp, Homo sapiens
gaagtaaaagtctaagctgagaccttaagtgtgaaaaggagttagctggaagaagggtgtggagtgtggagcggtaaggaaaaggagaagattctaggcaggggaactctataggtgaaggctctgtaaagaaagaaggtatgatgtatctggagggcaaaagtattactgtctggcgggaccacagcaggttggggagatgaagctggagaaataggcaggggcctgagatgatggacttgttcctgaatctgtctggaatatcagcacccttggctatcagaatg

SEQ ID NO: 136803 - DNA, 268 bp, Homo sapiens
taagaaacttagcaatccaatgagggcttctaactctaaccttgatggccacatttcacactaaggccgtcaatgtacttccccagtcttcatctatcatgagagaaaaagacctaaattctcagaagacgctcagtcttactaaatactccagacccaagtctttaactacctagagacagaatacagaaacaattagtgcttctaggaggagattgagaccaatttttatctctctcagttgctggaattttaatagtgaacatcc

SEQ ID NO: 136804 - DNA, 386 bp, Homo sapiens
cacagcgatgggattaggagcccagactctagattcaaactgtccaagattgcatccggactctcccactttctaactgtgtgaccttagcaagttgcttaccctctcagaacattggtttcctcttctataaaatgagagaataatactatccatttcattggcttgtggggaaaattaaatgaattaataatacaaagcacttacatcagtgtctggcatccagagcagactctgtaagcatgatctgttattattaccatcgtcttcattgtgtgacctcctcctctctgcctgtctctttccctctagaatgaaggtccttgagacaaaagacctgtcctcttaggttctgcattgctggcacctcccgcttgcctgttatg

SEQ ID NO: 136805 - DNA, 388 bp, Homo sapiens
tagatgacagagatggcacaaggaaataaacatgcaaagacgcaacactggttttaaaagtgtgataaaacacattgtttcttcaactactctaaatatctacagagtaatatgtatagtatacaaggtggcaggagaggccagaccagatttaagtatactctgttgccataaaggaatcctcattctctctctccctctctctcccataggctaatatttttaaaaagtcagaatagcttacattggagaaccacactaatgaaagatcaaatgcaagtaggcctgagatggatgaagtggaacgtttccagccgctgctggatggattaaaaagtggaaccactattgcactgaaggtgaatgcctacagctgatcaatgctctc

SEQ ID NO: 136806 - DNA, 540 bp, Homo sapiens
gtagtagtcttgttggggacatccacagtatgtcaatgaatcaaagacttaagaagaatctcaaagaaagaataatatctctctctcaacccttatacacataatagacttatttacccttattgaaaaagtccttctagaattttaaatttacactttattcatataaaaatgaaagcaatattgaaattaattcataaattcacacgtatcttggtattctgattatgattgttctgaattaggtgttgacactttttcaaagtgatgattgatatagttggatgaatatccaccatgcttgttactatcttttagtttttgcgctgcctctgtttccatttttgtcttccattcattttcctttttttgtggtttttattcagcatttaaaaaattcaatcttctttcttagcatctcagactttttaatacttttttattggtttctcaagataataaaaacttttaatttccatattcttaattgatcttacatataacagcttatttaaaataattatattcaatagcagacag

SEQ ID NO: 136807 - DNA, 419 bp, Homo sapiens
agccattatctggaggttcacctgtcacaatggcaggggaaatggagaatgtggcaaaggtggctgttcatgtctctacctggaagggtcacatcatactgatcacatctcattggccaaagcaagtcacattatcaagccatcaggaagtcagggacatatgttcctatgtgcctcacatagagagagaaaaaggacatgttagtgaacagtaacattatcgaccacaaacactatgatgaaggcaagatttttaaattgataaaaatccatgtcattactttctccaaccctaagacaaaccttacatgaaaaggaacagaagatgggtcagatggacaactatcgcggacgcatccacgaccacggtttatatagacctgaagagcctgtctcagattgggattaacataaaagag

SEQ ID NO: 136808 - DNA, 568 bp, Homo sapiens
caaagcggtgaggtaaagagaatactgaatgaggctcgggatcctgagttttagtttttaggctgctacaaactagctctgcaatcttgagaaaaatcacttcagctctctgtaccttggtttcccatctgtagaaggaaagagcagaattccactccctcttgcttttacttgtgttgctttctctgctaagccagcaactccagttcccttcctttgcctatccccaccttattttcacctactgcaagctggaaaatgagatgcctcagtttgttagacctgggtggggtgtgatgcagaactggaggggttcctttctaattgctgtcctctggggttcttatccatttttgttatttaggggctttctttgctttctggctcaccactgagatggttgaaattgccacataaatgacccctggctcaagctagcacattgtccaccaggcatggtggctcacacctgtaatcccagcattttgggaggctgaggcaggcggatcgcttgagctcaggagtttgagccagcctgggcaacatggagagaccctgtctctacttg

SEQ ID NO: 136809 - DNA, 943 bp, Homo sapiens
ctgagagtatcttggtttatttactttatcttgttaacaactgcaatgataacactgcgggttagggagcaactttcatgtttagtctcaaacgttttctcaagagtcggtgccggggcctcccagcattgcagtgagctcgggacattcttagctgcttcaaacaagaagatatagcctgtttaacttgccaggattcatgtaacagaggcctggtcccatctgggcatgtacaagacttgcttcatttacctggaaattgcaggtatctcttcctcataatgaggtttctgaaatattccttgtttttcagagactcaagctattagccaagtaggagctagcaatagctcttaaccaatggcaaaagggtcagatatttcctgtgctgtttttactgtttatagcagggctgacacaatttgctgtgggaagaaagacttgaactgtcattatagattttctctccttgtgtgtgacttagcaggacactgacattgggtcctccctgaaggtcatcttgaaccgaatatgcgcccctaactttccttccaaccaggcaacaacggcacaatttcttggctatatcttgtttgcttttcagcaacggcaagccaaaagccatcccagcacagaaataactgggatgccttttgtttctttggcaactgttatatcactcttgcctttccttatttgatgagaaggtagtagagaaaaaaatgatagtgataatctcacacaatatgtaggtatttttacaaaccagtcttatacttgaaaataattttataatacatcaggaaaatatcaaagaaaaatataaggaaaagggaagaataggattattgttagaaaatataaaataccatacttgcctttagagaaaaatttacagtgtaattaaatgagccaatatcaaggtgttttaataatctaaaat

SEQ ID NO: 136810 - DNA, 302 bp, Homo sapiens
tgtacaaaagacaggaaacactatttgagggccctggagtgcatcaacacggggtggattctgggagctacaattcttgaaagaaaagaaggctatgcattgagcatcacattcattctggaatttttctgagggcatttcccacatcatctgcacataggtcaatttcaacaagaagctgaaatttatcaagaagaatcaaacaaatcccaggtaagataaacacaaagaaaaccacacctaagcacgtcatagacaagatgctaaaaaccaaaggtaaagggaaaatcagctagaggggg

SEQ ID NO: 136811 - DNA, 260 bp, Homo sapiens
actcaccacctctagccacagtgaactgcctccagcatacacacacgctgctattttgttgcatctgagtgggctggctccacacgggatctgtagtttccttttgatattttctttcaatgtgccagatgctaccactgagtaatctagattttgctgccaaactctacccccgttagcacagagggaagacagtatgccagtgctcttgctgagtgtgcgtgactggcagaaagcagtcatgggtgtgatggttggaa

SEQ ID NO: 136812 - DNA, 455 bp, Homo sapiens
gaatgggaagcaaggcagttgaagaagctgaagtagacaactctttcaagtttagttttgaagggaagcagaaaagtgaaatgagagctggaggaaactattactgaagaggagataccagagaatatttgtgcattgatgggaatgctctagtatagacaaaaagatcgatgattccgggaaagagggaccgtcaattaagaagtcaaagagaggagcatagtatattaggatgttctcaaaagaatgtgacaccgactcacaccagtcagaatggctactattccccccaccccaccccaccctgagacggagtcttgctctgtcgcccaggctggagtgcagtggcatgatctcggctcacggcaacctccgcctcctgggttcaagcgattctcttgcctcagcctcccaagtagcgggattatagatgcctgccaccacgccttgctaat

SEQ ID NO: 136813 - DNA, 156 bp, Homo sapiens
cacttttactaatcattcattttgaataatctcacttatttactcagtaaatatatgttgcttgcttaccatatatttatttcagtaagtatatgtcgcttgctgggtcctggtaatgacagtggtgagtttccttcccttgttagtgggatctac

SEQ ID NO: 136814 - DNA, 333 bp, Homo sapiens
gcatgtccccgcacagccccggtcttcccttctccactcttcgggcccgggggtcggggcccgcggtgggcacctggagaggggcgaggcaggatgaggccggcgggcggatagttcggggcgcgcggggagccggaccgcagacctgcctccagccgccgcgcccgggagccaggagatcctgctatagatagtaacagggaagcggctgtttacagcaacacagcgccgccagggccgtctccaggcaacgccgcgcggccgggcgcgccgtcggcctggcgaggccaccctccctcccagctcccctgggccgcggcctccccggcccgg

SEQ ID NO: 136815 - DNA, 945 bp, Homo sapiens
caaagcgacctggttcgaatctctactcagctgtgctatcttgggcaacttaatctctctgagtctgttatatctttaaaatgaaggtactacctcaaaggagttttctgaaggattaaatgagataatatatctgaaggacttagcacagtatctagcctgtagtaaatgctcaatacctggttattactatgattcccatatggaatggtaaagttcaacaggagcaattaactatccaatgactgaagataatgccctgcctttttctggctgacatacaaatacatgatttcaaggaagcaccactcaaagttcatgtcctcctaatgatgggatagcagtatcattcttcatacatggaaggacagcatacctttgtgaaaattatcagtgaaaatgcacatagtgcaaattgtgtaaccttcatgcttttataacaccaatcttttccaactctatgcaacaggcagtttttccagtttcatattttctattaagcaactaacaacatgttcaagtttattttaattaccagggattttaagagtatagtatttcctaggatgttgacatggacaagtgattgttttttaagatgattaaagttagctaccttcacgttattgtacttgcatatatttttaccttatagattcagaataattccagtacattcttaattcagtaaacaatttgattgaagccaacacacggaggcactgttccagtcacagattcagcagcaaatgagacaaactctctgccttgtgaagcttatattctactgggagcatagacagtaaacatgaaaaataaaacatggtatattagtaaaagtactcaggaaaaaaataacgcaagtaagggatagaaagtgtggggagtacaattttaaaagaagttggctggagaaatgcctcactgagaaggtgttctttgagt

SEQ ID NO: 136816 - DNA, 241 bp, Homo sapiens
agggttgacggcaaaggggcccaccatggggcatcatcgggggaattcagggagaagatggggagccagaatagatgccctccgcaccagagattccaccgctttacctctgaaactgactctcatatttcaaagaggaagatagaaaagcgtcacaccggcaatttccacaaatctagggcatagtcgtaggcatgcaaaagctctgaggccccggtcaggcgccatgaaggggaacgag

SEQ ID NO: 136817 - DNA, 267 bp, Homo sapiens
cagtgattctgtatcagcccgttcccctaaattactcagaaagttttctgcactctgaagctccaagtgtgcacactcagcatttccccgggtaataaagtttcacaggcaggagtagcaccgatgaactgattatgcaaggggccgtgacaaactcgcagatcccaagaacagaaccagggcagcctttggactccttgtgaatttctgcagcatcagctcctgcatgctcagttcttgacaaatgtaagacgcggcagagtgtca

SEQ ID NO: 136818 - DNA, 211 bp, Homo sapiens
tgtctgggtggggttgtctggcagttagttggatgtctgagcctaagtggaggtcagcactgggctagggtttggggagctgttagtttaacaggactgggcagaagagactggaggtggaaaggtgagagaaggttctaaaaacagaactttggggcatccttctgcagggaaccagtagggaaaagaggagccagtgaagatcgagaag

SEQ ID NO: 136819 - DNA, 314 bp, Homo sapiens
tcccatgggcttataccagcaaatctactaatctatttgtatctcttctcatatactctttcttcctggaagagagatgaggatgaactatctgtacttctataatacaaaccctcctagccgtacatggaatcctatgttctggacaattaacagcttctctcctgtaattttcttctctctcttctcaatcatcgattttccccattagtgtaaaaatacacttcaatatctcaactaaaaaaaaaaaaaactgcttatgtatgaccacagaccatgatccagtctcaaccctaacttccctgcttcctttt

SEQ ID NO: 136820 - DNA, 336 bp, Homo sapiens
tgttgctggtgttgggaggtggtctattgactgagaaggggcacacacaactttccggagctaagttctgtgtcttgatgtgctaagcgtttctcaagactgatcaaactgtacatgagatcagtgcatttcaccatactttttttcaagtactactcattgctgagaggataagccacaaattcaccataagggctaaactgttaacaccagatactgacaaggcatggaataactcacacatcattggctaagtgtttccacagtattactttggaaaaaatgcctagccatctctcaaaaaatgtacatctatcctgattcagcaattccaca

SEQ ID NO: 136821 - DNA, 411 bp, Homo sapiens
agaaccaactcataccataggcactttatgtttaatcccatggaggacagaggacagttctccacctgtcactggtattctagtctttgaagatttttctatcctaagggctctcagaaaggatcaggagccctataagtgagaaatatctcttctgtcatcaatctcatggagtactaccatgaggtccccctataaggacttcacataactgcttcattatgtgtatctgagcctgcctggagtgatctgcccaagaccacgcaggcagctggtgcccccaatattttcccctgcatcgctaagtggtcagcatcagcagactcttacccactttgaattcatcagaagtttgtatttttgagaggtacctgggtctaaccaggtggttctggaataggccctcacttt

SEQ ID NO: 136822 - DNA, 324 bp, Homo sapiens
catgccaaggagcttgggctttatcctgcaggggaggtgaaagggagtcactgaaagttttaagcgagggatgaacacagtgagttaaaggctctaactccactggctgctgtgctgatctagtggtcagcagtctggagtcaggcggcgcctttcaaaggctattgcaagatttgagtgagaggggatggcggcagtagcggtagggatgcagaggagggatggattacaaagagatgtttagggttttttttttttttaaaggccccacctatcacatcttccagatttctggttagagcctgtaacaccccccaacccaaa

SEQ ID NO: 136823 - DNA, 498 bp, Homo sapiens
gagggcataagcagatacctgggaaaagtctctcacaggctcacagtggatgatggggcagtcgggcaagggagcaccacagcctgtgacggtgcggggaggggcaaaggcggtctgcacctgccaggcggagcaggggcgccccagagggtgaagagcacgcaggacacgaccactctgctccctctggctccctaagaggccttcttattcaggcacgctatgaacagacagtccagttgggcctgtgctaacgtctgacgcttccaaagcaaagactttccaaaccagtttggtatgagttagaagaaaaacaaaagtcatttcattgtcttaaagagttccgtccttgcagaatttataaaccaggcttttatctgctgccccatattgtcactgatatcagtggcatccaacactcaaaaacactcctcatgaatcccaaatttttcatgttgatgacagcttttaaaaataaaattactttaggccgggcac

SEQ ID NO: 136824 - DNA, 538 bp, Homo sapiens
ctggtggtatgagtggcatgtgatcgagctctcacgtcttggggactagaagttgtctgcaggatgtacattcaagtgtcaacccaagtgtctactgatttgtgtgacaaaatcattaaggagatgaaaatcagggtgacagcaatatgtcaaaatatttcaagatgccagagtttgaagtatgagcagcagcagctcatgtggaatgacaaagatgaggtcagggcagtagcaatcaggcacctgctgaaccttatgtcaacagtgtgatggaagcatctcatttcctcttctgaggtacaagcctttgtttctggtgatggcagcccttggggagcatatgcttgttgaaaatttatcctgccctaaggggctgtacatcatactttagaggccattttctgggcagttggcctcttgcttaattttaagcctacatcgcacaacactgtgatgatgtgtcacattttgcactggtctgagcagcaggtgaacatctggagtctccagcaggctgagttcagagacgacaaatgct

SEQ ID NO: 136825 - DNA, 294 bp, Homo sapiens
tcccccctggcttgccaggtctgtagcgatggggtttcgcctggcttgctcaggtctggggtgaaaccccttttctggtaagagtactgttacatgggatccacactatgggctcagagttggtccctttccagcgttaatccagaaacactctaaaacaaggagtttcttactcaaaagagggcaaaagaccagtcagggatggattggcagaggaagaacggaaggaaatgctgatcttcctgtaggtacaaaacttgtcactgcagccaagccaagtttcaggagggttga

SEQ ID NO: 136826 - DNA, 259 bp, Homo sapiens
agttttataaccttaggcaagttgatccatcttctacatctttaaaatgaggatcataattcctaccttatagggtttctgtgagaattaaaataattcatatatgtaaagcactttggaaaacgatctgcatatactctgcacataataaatgttattatgattattaaggaagaagggagatagatgatagctagaggaagagttggagttgatttgtttattgtttggttgtttggttttgggggcaagaaggaat

SEQ ID NO: 136827 - DNA, 395 bp, Homo sapiens
tttgatggcctcacccccatcggaacccaatgagctagacatctccagagatgctaagactttgcagatagattttctagccttatagggaagacattctggttaattgactcaaattatgacgcacaaaaagccattgtgggtgcccagggaagggcgtgactactgagctgcgcctgggagtgttcagtaggagttggacagctggaaaggggagaagacagtgttctatggaaagaggacagtattatcatcacattggcaagggcaatgcaaacacagtaacaaataactggccataaaggacaaaatgtgataaatgtcaaatgagtgtctcacttggtaagtgccagaaaatttggagaagaacgcctgtttgaattggggtgatcagg

SEQ ID NO: 136828 - DNA, 288 bp, Homo sapiens
ctgaagtgcagccctccatttcctaatgtcagaaatcttcagagcaggctttcttctgacccagatacataaaatatttttaacaggcattttttttattgctaaacacaagaatgtgcactcagccaagattaaatcaacaaatttgttgctgcagtgaatgttgttgttgtaacctctgcaatgatttttttggggagttgcagtcttccaaaaataatgtgaatttttctgtacagtttagtttgacctttaattttgtatagataattcttatgttatatatta

SEQ ID NO: 136829 - DNA, 592 bp, Homo sapiens
gcgttgaattcatcaacaactgatactctccttgtgctcagaagctccttgggctgctttagaagacataaaaaggtctatgatgctgttcattgcctttgaagatcttataatctagctgtgggtacatgactaacaatcttaaagccttagagagcagtggaatgctgagctctgtgctacttacatcatatttctgagaagggagagctcagaataaaagctagagtagcttgaaaagttctcttcatgagtcttaagctgggttttgagcaaaggcaatgatgaggatgacgtctagactgtatgagaagagaattgcttaactgagatgtattgtcagtaatagaaaatcaaattaggcaaatgggatgaagtcaaaatgagggtcttgaatgccagatcgagttttgatatcttcctatcaataatggaaaaccatggtacattttcaaaagatatctcttttctattgtcggggtaaaatatacataacataaaatttaccgctttaacaattttcaaccacttttaaccattttaattttatcattgtacatttttaagtgtacaattctgtcgcattaagtac

SEQ ID NO: 136830 - DNA, 273 bp, Homo sapiens
ccactccacagtctcctatactgaatgctgcccaaaaaggacttacttatcatctccccgaggatctgttctttcttcctcattcccagcaactcatgccaacaccatctccccacctacccaagacagaaaccaggaagtcatcctagactcctgcttttccctcatccagtcagccaccaggtcaggttgattctaccttctctttttttttaagatggagtttcgctcttgtcggtcaggctggagtgcagtggtgcgatctcagctcac

SEQ ID NO: 136831 - DNA, 368 bp, Homo sapiens
agcctggtagagaagatctaggaaagactcagactcattaaatactagagctggaaagaaacttagagagtatctaagggatttcctttatcagatagaaagttggacaaaatgacctctgaggctttagcggtctgcaaaattctttttctatttgcagttctgattgatagaaaaggaaattcttgttcaatttttttgcattctcaactgtgaataatagtctagttcagaatctcaaacctcagatactacatttctatgtcttttacaaaaccatagcttaaaaaagcattgtccatcctgttcatatttcttgtccattcagtattcataaattcatcaaacaaaatccagatagacttggg

SEQ ID NO: 136832 - DNA, 311 bp, Homo sapiens
cccctttccggccctgcctgggtccctggatccctgctaggtgcccctggacaagtccagtgctcctccatggggacaggaacaagcacagggcagtggtcaggctcagtatcctctgccccagcagctcctccaccaagtggagcagctcacaggcaagtgagggactctcgctgagttgccgagtctctgaaaggactgtaggcagcaatgcacaggtgcccagacagtgcctgacgtgtgctgggggctggccctgccttctccccatccgctcaccactgaactaccccagtgcagtcaatggtctc

SEQ ID NO: 136833 - DNA, 673 bp, Homo sapiens
gagcccaaggcaggaggattgcttgagcccaggaatttgagaccagcctggccaacatagcaagaccctatctctacaaaaaaaattttaaaaatcagccaagtgctgcctgcagtcccagctacttgggaggctgaggtgggaggatcccttgagcccagtaatcgaaggctgcagtgagctatgactgcacaactgactgcaatccagcctgagctcagagcaagactctgtctcaaacaaaaaagtaagtaaataaataaataaaaagtatccgcttttaatggacagatttgttctttctaatttacttcctgccactttgttaatcaatttggtagtctgaaaaaaatttttttaatcttgtctttatcaatgagaagagaaaatagcttttatccaaggaaggtgagtcctttaaaattatcagacccagagagactttttttgagacactcttgctctgtcacccaggctggagtacagtggtgtgatcttggctcactgcaacctctgcctcctggatgtaagcgattctcctgtctcagcctcccgagtagctgggattacagggatgccaccatgcctggataatttttgtatttttagtagagatggggttttgccatgttggccaggctggtctcacactcctgacctcaggtgatccgcc

SEQ ID NO: 136834 - DNA, 160 bp, Homo sapiens
agaggggttttattcaaataaataacttttggattacagcttggggtcagtttagtttctcgaagctgatctttataatgatgatctccagctttagaaaaaatagtgcgctgctttctaaatcaaagattcactcaagggttgggcacagtggctcaaa

SEQ ID NO: 136835 - DNA, 721 bp, Homo sapiens
caacgggatttgttaaatcatcgtgcctcaatagggaatttgttaaacaaattgtggtgcatacattatagaatgctaaactaagcagcaaatttaaaaagtagatctacggtatataaagtaatatagaaccgtgcctttgaaatactgtcaagcttttaaaaaaatcatatctcagaataatatgtgtactgtgatctcaagtatttgaaaaggaaaacaaactaaatacatatgtaatttattttaaaatttaattgaaaacataattgagattgtattgtataatctattctgtaactttttcaaattagtggttcatcatggacttccattcatgccagtacatatagatctacttcatcttttttgaaagatctgtaaatattaatattacatttgttttaaaatttgtgtatatataatgtatagatgagtaaaaattgaggaaggatatatgtataactgttaacaaaggttatatttggggaggaagaggaatttctttatattagtatattacttaacttttcaactgtaggtatatacttagtaaaaacaataaaaatatttctatttgaggatggaaacataatttttaaaaaatttatgtttgtagaaattataatcctgaaaaatacctcaaaacatcttcaaaacttgaaaaatcaatggctgttgaaattactttaactaaaatgaacaaaagcattggagaaga

SEQ ID NO: 136836 - DNA, 207 bp, Homo sapiens
taggagccaagtgaaggacatatttcaaggagaagggagtattcagctctgttagatgctgctaagtcaagtaagatgtggagtgaggattggccattggcttcagcaaagtgcaggtctttggtgatcttggcaagaacagttcattgggatggtgggggtgaaatgcttgattggagtggtttcaagaatgagcaggaagtgagg

SEQ ID NO: 136837 - DNA, 431 bp, Homo sapiens
ttctaacggggtaaggcgtcacttgacatactgataaatcttttacattctatatagtggaattagacaattttctgaaccttccgtcccaaccttccatcccttaccctggttcttgctactttgttgtttagatcatggtctgttagcggaaatatgactccatgtggtccatgatatgggcaccttacaagttattctaaataatggcacttaggttcaaagggcttgttaataatagtgccattgaggaaaatcatttgggccatcacccccttctcatgttgaaaatagcgttaagtgttcaagagtgtgatcggtgaaacacagcttaattcagctctacaggtgtgagtatttagccctggaaaggaaggaatgattattgcagggttagaaggttcaggagaacagtgcctccctcctagtca

SEQ ID NO: 136838 - DNA, 233 bp, Homo sapiens
gagtgtttacagcaggccatgtactagggattaacataaaaacaacaataacaaatctcatgaaaatttcacaaatggaagtgaaacaatatcacctctattatacagatgtgaaaagagaggcccgatgaggtctagcaacttgccctaaatcatatccctagcagagcagatggagaggcaggattcaaatccagaattccttttttttttttctttgagacagagtcttg

SEQ ID NO: 136839 - DNA, 318 bp, Homo sapiens
gaggttggagagagtcagagaggcgtgtggcgactcagagctgcctgggccctggcctcaggttaggaggggagtgccacagcctttatttgactgcagacgttgctcaggcattcctgcctggcacccccggggactcaggagtcaatatcgatagcgtgtcagcctctgcctgctggccttatctcccatccctccagggagggtgttccagggccttggctatgtggtgggaaccagtgttccagcagcagcccaaggctggtagaccagactgtggagtcagaggtcagctctgcatgggggcaactttgcaag

SEQ ID NO: 136840 - DNA, 178 bp, Homo sapiens
gggactccctggtgcagatgatacatctggcctggccctccctgaggtcttggacaggaatggggagggtggtgagagatattaatgcaaataatgctccaaccaattaattaagactgtggaggccgggtgcaatgactcatgcctgtaatcccagcactatggaaggccaaggcag

SEQ ID NO: 136841 - DNA, 233 bp, Homo sapiens
taggtattcaagaccagcccaggcagcatggcaaaaccccgtctctacagaaaacaaaaaaaaaataaagtagctgggggtggtaacatgcacctgtggtcccagctattgggagggtgaggtaggaggacttattgagcctgggaggtggaggctgcagtgagctgagatggttccactgcactccaacctgggcaatggagcgagactctgtttcagaaaaagagagagga

SEQ ID NO: 136842 - DNA, 744 bp, Homo sapiens
taattgggagccatttgaaacggcaaaattgccaacaaaaagtacaaaaatgcaaaaatcatggcactaaatagactgtgaaaaggatacttgcagtatgagagctgaaagaaggaggcatagcataccttgcttaatttcagctgggaatatgcatgtcaagtgactcaagtttttcaccactctgcacatgtcaccaatgaccaagaaagcattgctagtattgatttgggggttacaaataaattttaggaagtagatgaatttgcaaatgtggaatccgtgattaacgaggttcaactaattatattagagggcttgctatgatggccctcctcttccaccacactgtttttttttcataatgcagatgtttgatatttataaaataaaaacccaaaaaaaaaaaaaaaaaaaaaaaaaaaaaatttggggggggctgtgggacctcgagaaaagagcctttcgagaacaccttcgcgtgggggggcggggggggaccaagaggggatcagtgggacacggggtacaatgaggggttcccaagagaaaaactcgggggcagaacaacaagagggggcgtggggattctccacccactatataaaaagcggcccgggggggggacaaccaggacggcgttctcggaacacaaattccaagaggggaacacggaaggagcaaatagcgagacctcatcaaagggggatgaccaaggagaggttccaaaatcaaattacgccg

SEQ ID NO: 136843 - DNA, 1016 bp, Homo sapiens
ttgggagcccagcccagggcaccctcctcggagcgggtacgggatgctcactcgactccatgttcacttggtgctggtctttggcttgctctgttggtttgtccttagtcaacactgattacttcaagagtgactttcctcatattcaccttttatgagtctcttaaggtaaaagcttgaaataaaaataagacccaatctaccacctatttcttgacttcaaaaccttcctttctctctgtaaagacaaattcagacccagcacctgctcttgcatcacccctccccttggagctctccagaatgttcatgcccagacacccactgagggctgtggtgtggccacagcttcccggctggccctctgacaaactcctctgtggcccgttgctctctctcctcaccgcccactggagtcttctccctgtggagggcctgtctctccacgcctgttcataagggacagctggtggctcctcaccttcccgtgtcagctaaccccacaggatgaccccagcctgcagtcttatgtcaaattcgtttttggaacccaaactgttgggatcctgaggacttcagagatcatctggtgttcacagcgtttaaaatgggaagataaatgggaaaacccaagcctgctcctgttgacaaagcctcctagtctgaggaaatatactttgtagtcctgctgtccaaagagggcttttctgtctgactctgctgtctgcagtccccattctaaaaccaaggtcctcttctaaagttccagaaataaaactataggtccaagtctccttttcctttctctatgttttcagccagagaccagtccatgacagctcagcaggggtgagcagtgaggggctggtgtggagtcagggcaggaagaggaggagtccatgttcatgggaatctgcagtccatgtgcatggggtcccttgtgcattcctgggttgctgacatgcattttctcctgtaatcaccatgttcccctgcagggtaggtcagtggattgt

SEQ ID NO: 136844 - DNA, 276 bp, Homo sapiens
aggtggaaggacagcttgagcccaggagttcaaggccgcagagagctatgatttcatcactgcactccagcctgggtgacagaccaagcccctatcttgaaaaagccaaacagaaaaaaacaaaaactgggggtggtgagaataaataagttaattggggcatggcaattaaaataatacaattagagatactcagcatgaataaatctcagacacatctagcaaagacagccaggtgcagagtaatacccacaatgtaatgccatttaaacgaaa

SEQ ID NO: 136845 - DNA, 214 bp, Homo sapiens
caacaagagtgaaactctgtcaaagaaaaaaaaagctttaatgtaataggcagacttcatgaagatacatttcatgaaggtattgagttgggggagtgtactgatttatatatttaccttcaaagcattcttttgaattattctgtcagcatagaagactacgtacatccacctcacctctacagatgggagcagccacacagccaactgaaca

SEQ ID NO: 136846 - DNA, 481 bp, Homo sapiens
gacttactgtaagcgccgagggagaagctgtaaagtactacctaattcagatctctctccagttcccttgggtattaattatgcagccacagaagccagtgcataatgggaaggtgacacacttcattccccaagtacagagacagggagtgtggcttgctccaatgtgggctgggccaacacagcaggaaagaggacagaggacacccatgagcccctaacagagcacaattttgagcagaacaggccatcaccccaaagccaggagtaggaggcccatgtgggacagtctaaagcactaaccaaccacagtccccaggcttaatatccattccttcatcaaaaggccccaatcttcagagaactccattattaaaaacgagatgtgtgaatcaccactttccctttctgcagattggggttggggtcacctgtgaagctatgttctacagcttccgctgaggtcccccaggcaatgccc

SEQ ID NO: 136847 - DNA, 446 bp, Homo sapiens
atctgcggcagccttgcctctcacctggacgactgccactgcctcctacaggggttccccatttccgttcttgtcccccattgttcattctacccagcaggtggatgtttctttaaatgtaaaccagatcaagtcacccttgctcaccatcttccagtggttccccctcacatttaaattaacgtcaaagtcccatataatctaactactggcaacctctcccatcctcatcttctaacaccctcacacttgctccctacactccagccacaatgattttcctctcgttcctcaatcatattcctgacacaaaacatctgcacttgccattcctgggcctcgaatgttttatctcccaatcatcacttcatggcacgctttctttcatctctttcaaatgtcacctccccagagaggccttctccaatcactgcagctaaaataac

SEQ ID NO: 136848 - DNA, 209 bp, Homo sapiens
gttgcctaggctggtttcaaactcctggcctccagtgatactctcgcttcagcttcccaaagtgctgggatgacaggcccgagccaccatgacccgccaagttgtgtttttagagaaaatatattctctttagaataaggattctaggctgggcgcggtggctcacgcctgtaatcccagaactttgggaggccgaggcgggcggatca

SEQ ID NO: 136849 - DNA, 344 bp, Homo sapiens
ttttaattaatcattatttctaggcacatatagttttaatcactgggacaaactgatgatttctgcctgcttttttttcctctgctttaggtgaactgattgacaggtgattgtttcaggcaaggaacattaaattaaacatgtagaagtgtgcaaatatttgttattttgaattagaatgcttgtgtattctttttcacatttatacttgcttttgactaccaatataggtagaagagctttgtaaattgtaaagtaatatgtcaatattaatttttgcaactttagttgtgacatggaaagaatcttgatcatcttaagaaatattaattttctaaaatact

SEQ ID NO: 136850 - DNA, 265 bp, Homo sapiens
aaaaaacaaaatgggtaatgcattcaaggtgacagggttaatgttggcattactttgttatgttgttgatgggcagaaacccaaggtggggttttgttgagcataaacacaagaagcaattatttgtggcactagacttaacccaaaggacagacccctacatgtatatagtagagaaatcctgtcttttagcactatctcacaggggaagctgaggaatcacattatctttaatataaataaatgaaatgcagcactgtataat

SEQ ID NO: 136851 - DNA, 274 bp, Homo sapiens
aaatgcaaattctcagaccgaaccaggactgaatcggaagatctggggtagggtccctccaggactgaaaacggaaggtctggggtggggtaccccaggactgaatcggaaggtctggggtggggtccccccaggactgaatcggaaggtctggacgagggtccccccaggactgaatcagaagatctggggtagggtctccccaggactgaatcggaaggtctggggtggggtccccccaggactgaattggaaggtctggactagggccccc

SEQ ID NO: 136852 - DNA, 373 bp, Homo sapiens
tgaagaaatcccatcgaaaactcagagaatttaactgagatgttaaaaagaccacattttagaattaaggatcattgcctgaagtaagggcaactctacacccaccctaaaaaggcataaaaccaagcctcagtaggatcaagatgatctgctagtagcttaagtgcgtgctaaaataaaactccatgctcttcaaaggaaaatatagtctaagcgctccaattcagctggtccagtgtataataaaaaattactagatatgaaaaaagctagaaaatgtaattcataatcaggaaaaaaattgtcaatataaatagtcccagagatgacatggatgtaggagttagcagacaaagactttaaaacaactatt

SEQ ID NO: 136853 - DNA, 236 bp, Homo sapiens
cagccttcttaccccttttcttcaagagcccatctcacaggctgcctctcactaagatgagctagttcttaggcactgatttttcccttgggaaaaaaagcagtggagttcagtataaatctttgctgtaaacccacactgtatataacacactgcagggtctttgcacgatacaagaacaacttagtcccggtcctcatcttttgaggatactagggaggcaagcaaatatatct

SEQ ID NO: 136854 - DNA, 123 bp, Homo sapiens
ccccgctcctctccgcgacggccgggcggagggagctgttgaagggcacgcaggcggctgcgggggcggagggagctgaggccccgtgaggacacgcgcggtggtggcggtggcggcgggcgc

SEQ ID NO: 136855 - DNA, 356 bp, Homo sapiens
aagtaaaagataatgaaaaaatatatccctgcataatatgcatagaaaaaattggaaggatgtgccaaatgattaacataaattagctctgggtagatgtattttggccaatttttattttcttctcatacattttttcctaaatgagtatatattactttttaacaatttttttaattttagaaacacggtttcaccttattgcctaggctagtctggaactcctgacctcaagtcatctgcctgcctcggcctcccaaagtgctgggattacaggcgtaagccactgcgcctatccttcgtctatccttttcactctgaggcggtggagtccttcattgcgcaagacgccctgt

SEQ ID NO: 136856 - DNA, 691 bp, Homo sapiens
gggcttgatcttctaaatgcctcagtgtcatagttgtaaaatgtgctctgcccagtgtcccagacttgaccaaacttgacctagaacactccttcccattgtaggtcatggtgagagaaagacttgacccagaagtcacacccagaaggaactgccttcaatcttcagacagtttaaacatttaaggcatttcattttcttgcttgcatagcatgaaaatttctgcctgcaatactgacgactgcctttgtttggatgctcctagagagctcacactgcatctatttaacttatcctgtctatccagccatccccgaaaataagagcttcaaagctgtctttgataatgatgacatgattccctccactcacaatggtctctccacttcttccctgccaatccagcctgcctatcctttcctttccaacccaagccttgcctctttcttgaagttttcctgggttattctggtcccgacttattcctacttggagaactcttggtaacacctaatcaaacacacaatgctttgcattgttctctaatgctttcatcctgcaagtctagggtgcctaattgaattgcaagctccttgaaggcaaaggggttttacacttcttgtgaatgccatctcccattttctacttccttctccactctccattccccaaacccagcacagacacaaag

SEQ ID NO: 136857 - DNA, 416 bp, Homo sapiens
attcttttctatggtctcctagccactctttttctttacagttatctctgccaaaataatctttctaaaacaccaaagtaatctttccaaaacacaaatctcattatggtatggccctatttaaaatccagtttaattactccttaacttggcatgccatagtcagtatttctcgactgatgcactactggcatttcaagacaatttttcgtggttcatcaccgttttataggtctttttggcatccctggcttcccagcagcactctgcactcactgggacaatcaaaaggtcccctcacatttcctcactgccatagggtgttggtattatcccttgctgacgatagttggatatggcctatgcttcatatctcaccagtacctttactgtcactttccttttttttttttttt

SEQ ID NO: 136858 - DNA, 143 bp, Homo sapiens
gtcttcataatacaggaatctcaccatgctggaaatgattcgaggtttttaaataatactaatttttcagacaaggtggtccccctaaagcaaagcccactacttacttggagcttcacagtagaatcagccatcatttccag

SEQ ID NO: 136859 - DNA, 306 bp, Homo sapiens
tatatgatgcctaggcattgttctaggcatttcctgtgtttactcatctaactctcacaactgtagcagatggtatttccaaagacatctgcagcaatgtctcccatcctacaccctcttcttacaaagtgatgctgacaccagtcccatggagagaagtggcgtctctgtccccccacttgaatctgagaaggcttgggagtaatggctgaggtgacactacggcactttcagggacaggtcattgagtgtgaagcagcttctgcctccttcaccaggacactcctactagagccctgcaccacc

SEQ ID NO: 136860 - DNA, 179 bp, Homo sapiens
catatgctgagtgagaataatggagtacatttaagtgaaaatcctttgtgtcttttttgtgttatttcattaccactttacttggcagacagctgatgttccccattttatttggatggctggtactatgcagtgtgctgcagtagaatttaaattaaataaaaggaaataaaaaataa

SEQ ID NO: 136861 - DNA, 225 bp, Homo sapiens
cagactttaagatcatacattaaagcatgagggaaaaatatgtaaacaaataagtaaggaaagcctgttctggagtgagtgcacaatttcttactgttggggacatgtaatcagcaaatttgggagacctctggtttaaagatgtaaccttgcaaattgagtttttagcttttttgcatgctgggcaaagaacaacaatttgagatgttgaaatgtatagtattt

SEQ ID NO: 136862 - DNA, 434 bp, Homo sapiens
tcaaggacagggaaaaacaactccttcaaggaactttgctgtaaacaggagcagagagagcaatgtagggtcaatagagaattcttgatatgtgaaatgtaatagtgtttgctgaagggaataagaattagaaaggaaaaattgatgacatagtccagtggagactaagctggagctccctctcttctgaaacaaagcacttcattcatttcattaaaagatgcagagcattgtgccagataccatggacaccaagatgactatgacacaccccttgctgtggagaagtgaagaagctcctgggctgtgatggtcgaagaagatggacttgcttggaagggaaactaaaatttattaagcagctactataaagcatctttacatctgttatttcatttgatccctgtaatatccctgggaaaagtatattatta

SEQ ID NO: 136863 - DNA, 812 bp, Homo sapiens
caagttattccttcatgtatctgttcaaggaaactaaaatagttaacttttttgtcagatttttctataaaattaacaactaattgactagctgtttcatctgaatgattttgttagttttcctttttggattagattttttttcccatttactttggattttggattctaggttcatcttgagcagtattttccctccatagacctctgtactgtcccttccatatctacatacatacgatatttataatgccagtttgggggttctgttctggcgatgttgggatactgcagatctcgtggataggtagtgagattcagcatctaaggagtcaggctatttctttgtctttcagctttcttaagcctacagatttctataatgccataaactcaatcagtgattctgcaacagctttattttgtttgtttggttatttgcggcagggtctcactcccattgcccaggctggaatacagtggcatgatcatgactcactgcagccttgatctcctggactcaggtgattctcccacctcagcctcttgagtagctgggatgacaggcatgcaccaccaggcctggctaattttttgtatttgtagtagaaacagggttcttccatgttgctcaggctggtcttaaacacctgggctcaagcgatctgcttgcctcagcctcccaaagtgctgggattacaggcatgagccactgctccaggcctgcaacagctttattcagtctctttttattggggagatggagagcctaacctcagaactggattcgaccagcaacaagcctggttata

SEQ ID NO: 136864 - DNA, 341 bp, Homo sapiens
cctcattctgagtgggaggcctgagcccctcttcctcctcactcgggcttgatggctccttctcagccaccttggccagtggtgaccaggaggggtgggcgtggcctgcccacgcccttgcgtgctgtttctccagatttatactcttgctaatgaaagccttgacaagacagtattcattcgttcactcgtttactgatgtgtgcaaattgttatgtttagtttgtttgtttttttggtagagacagggtctcactgtgttttctaggctggtctttaaactcctggcctcaaagcctcccaccttggccgcccaaagtgctggtattacaggcatgagc

SEQ ID NO: 136865 - DNA, 291 bp, Homo sapiens
ttcaagcgggattaggggcggcgtgggaacctagagtgggagagattaagctgaatggaagatcttgtggtaaggggtgatattgtggggttgttagaagaaacatttgtcgtgtagaatgattggtgatggcctggatatgttttgtatgaattgaaaaactaaatggaaaaggtctaagaattgggaggacctaggacatctgattagagtgcctaaggagattcagcatagtcctgccagcaaagattatttatttacttcaagagttaagagtggcagtttggggat

SEQ ID NO: 136866 - DNA, 295 bp, Homo sapiens
aacagcagacctcagacatgctggttgctcccaaaaccagggccagcagcttcttgcaaagtcagaggcacacttgttggcttgtcgataacccttctcatctgctattttgcaaagcacttaaactgccatcatggtctcagtcttacaatgccatcagggaggaagagagaagatggtgtttcctcctctgggaatgtccttctcctcttacctgcctgaggcactcccacttctcttttggaacccaggactagtggttttctttcttggaagacttctcagtcagaattcc

SEQ ID NO: 136867 - DNA, 384 bp, Homo sapiens
gtccccgggcttatgtattgagtggcatgtgggtgggagctaaaggggctgtaacacttttctggttggctcaccgagctgcaggcaagtgacactctcccagactgtgggagtgaagagtgacaacccttctggggttccagacctcaggatttcccaagccagagctgtaaccctatagccttcctgtcttctgccggcactgggcagctgccccacacaatgggaagcagtggtggggctgggccagtccaggagccgcaggctggagcagagtggcagcactgaaagagctgttaacacaaatgggctgaaacatgcccctcaactccccaagctgtgggtgacaagaaggagaaaagagctgtggcccttctgggagcc

SEQ ID NO: 136868 - DNA, 468 bp, Homo sapiens
gctcttaaacccaggaggcggaggttgcagtgagctgagatcacaccattgcactccagcctgggcaacaagatgcaagcagcctggcccggcgcagtggctcatgcctgtaatcccagcactttgggaggcccaggcggacagatcacttgaggtcaggggttcgagtgcaagctgggtaacatggtgaaaatgcgtctctactaaaaatacaaaaattagccaagtatggtggtgcacgcctgtgatcccagctactcaggaggttgaggcacaagaatcgcttgaaaccaggaggcaaaggctgcagtgagctaagatcacaccactacagtccagtctgggcaacagagcaagactccatcacacacacacacacacacacacacacacacacacacacacaaaattggcattcgttacctgttcatcatttaaccctttgaatgacctgaagaagtggatgct

SEQ ID NO: 136869 - DNA, 258 bp, Homo sapiens
aacaaatctgtatccctaaaaagagatggggggaaatcctatttaaggattagcatttccttctaaatgcttaacaatgattccagagaaattcagtcaaatgatgcctgctcccgaatgatgctgaataacagctgtactgggcttatggcttgctttctttggttgtggaaaaatatatttcatcctcttctttgctgttgttgatatggttcatattactcaaagatgtctaattctcatgtcttaaattgagac

SEQ ID NO: 136870 - DNA, 537 bp, Homo sapiens
tcaaaaccgtatcagaacatagtaggtgaaatgttagctattattacaaagatgtgcagtactgtgtaaaatatgctgaggtgcccagtgccagtgcacagcaagtctctgctgaccaccagctgtcactcctgagattgccattgcccaggctggcctcccgtctgctggacaacctcccaactctaacactaactctctgcttcttcaggaaggcgctggccccagcattcagctccagctgcaggaggtgaagacgggcaaggcaagccagttctttgggctgatggggaagcgagtgggaggtgagtgacaatgacaatggagcccagcaagcaggggttctgagtgggttctgcaacataaagcagaggccctaagtcaaagcccagtaactggggtcaggtactccagtccagtaggggtcgctcatgagatggggtggcacagactgtccataggaattatcatccaggctggggggcagtggctcatgtctgtaatcccagcactttggcaggccgaggtgggtacatc

SEQ ID NO: 136871 - DNA, 128 bp, Homo sapiens
tggagtgcagtggtgcaaacatggttcagtgcagcctcaacctcctgggctcaaacaatcctctctccattgcttcttgaatagctggcactacaggtgcatgccactacacctggctaattgtttta

SEQ ID NO: 136872 - DNA, 764 bp, Homo sapiens
ctaagcactggctgtgtcaagcagcaggaaacagatatgtaagcctcctaccttcaaagcactcagcctaaatgacaggtatgtaactaagtagcacatgggagctacttagaaatgctaagacccgggggatgggggactagggggaggtggcagggcttacgcctgtaatcctaatattttgggaagccaaggtgggcagatcacctgaggtcaggagtgcaaaaccagcctggccaacatagtgaaagcccatctcgactaaaaatacaaaaaactagccaggcgtggtggcacgctcctgtaatcccagctacttgggaggctgaggcaggagaatcgcttgaacgtgggaggcagaggttgcagtgagccgagatcgcactgctacactccagcctgggtgacagagcgagaccctgtcttcaataaaaccccacaaaactttagttaccatctgaccctgaccacaatgagaccattccgattaaggggtccagactcaagaaatcacaactagcagacatatgggccacagaaccccctcagtgcacctggccctccatgttgctgcttaggtgagtcccttcacaaggctcatctcactcgaggtgtccactttacttgctggagagtatctgcagcagccagtctaccagctctttctactgctttcttctgaccagtagattctgatttgaccctttgaaatgagcttggtagaggtccctctgaggcttatattttcaatctcagatacatgg

SEQ ID NO: 136873 - DNA, 495 bp, Homo sapiens
ttagtgttttaaattctaagaatttttcggccagaaaatgatcctgcagagcatcccttccccccacctcaccactatttctcaactcctaaaaaaaaaaaaaatcactgaaatcagtgggaaaaacagtcctgcttttgatgcaacagccgtgaagactgctattcttggttcatggcaggagccagtgagtatcatggcacaagggaccagacagtcagggctttcagagtccactttgaggatgatgagtccagcacatgtgagcttaatctctgtactgttaccaggtatctctcatcatctccctttaccagtcccttccttcagtttgaacccagtgagagatgcaacaataaatttaatttaaatgggcaactactgtgactgttgactggctattggcagcctactgtatgtaactttatgcctccctgaaattctgcaaaataaatctctctcaagaaccaatgcaaagctgggcgcggtggctca

SEQ ID NO: 136874 - DNA, 415 bp, Homo sapiens
ggtggctccaacttctatgatacgcccttagaaagaagaggtatactcttttactatttcctgttctcaaatgtatcatggcaggagctggaactaccaccttaggccatgaaatagaagccacatattcacatattgagtagatcagattaaaaagctaaaagtagcttgagtacctaatatccagagctgctctatcagtcctgaaccgattatccttggactatgagagaaaaagaaatttacatcttatgtcattactattttgacctgagagcaagcaaacctataatcccaagtaatatgtgtttttcacattccctcgtatatatatgttcatgtatatatatacatttacaaatataaatatccatatgtgcacacacaaatatgtaaacatctctataggtattgg

SEQ ID NO: 136875 - DNA, 469 bp, Homo sapiens
gttgcaatgagctgagatcgtgccactgcactccagcctgggcaacagagcaaaactccgtctctaaataaataaattaattaaataatacgggaaactagctggcctgcacagggaagactggagtggcctgctctatcagggggtgccatctctcagagtaaagtgggaatgaaatcaggaaagatctcaagagctgtgcattccgaggatttttgctttgcaagcactgcatcagttcagaaacccaagaaccaagtggtaaggagtgatggaacagggtgctctcatagaagaatggaaacatacacgtgacaacctgctggaagccagaaattagactagagcataaaaatactttataagctctagagtttggaagtggatttaccataacagagtgtacagatagtaagaccaagatccaccctttcacttaatctccatgtgggaattgagtctggatggg

SEQ ID NO: 136876 - DNA, 440 bp, Homo sapiens
agtccgtacgactgacgcggaacgctgttaaacaggattatgagctgagcggaaggccgtggaatggattatctatgagctgagcagaagtccgtgtggaatggattatctatgagctgagcggaaggcctgtggaacggattatctatgagttgagcggaaggcctgtggaatggattatctatgagctaagcagaagtcctgatggaatggattatctatgagctgagcggaaggcctgtggacacggattatctatgaattgagcggaaggcctgtggaatggattatctacaaactgagcagaaggcctgtggaacagattcatctatgagctgagcggaaggcctgtggaatggattatctatgagctgagcggaaggcctgtggaatggattatctatgagttgggggagggctctgtggaacgtactgctcca

SEQ ID NO: 136877 - DNA, 345 bp, Homo sapiens
acaggcgtgagccaccaggcctggctgagcattttgctttttacactattttgggactggtttctgccctgcccattagaccaagcttcttaagggtaagtgctttatcttcttatctctgatgcattccatgtttgagcctatagtttttattatgcccaagagggtactttttaagaagaaagagattaaacaatcctttcctctaccccctagccagagaaacctttctgagacatagatgtgatcatatctgtctctagtttaaaacccttcactgcctcccaggacccttgggatcaagtccaaactcctttacgtggctcgcctaatctttcatgatca

SEQ ID NO: 136878 - DNA, 692 bp, Homo sapiens
aagtgttttacatacaatatcacattgacaccctctacaaggtagatgtactagatttaatagtgtcccccaaaatccatgtcagtcgggaaccccagatccttatttgcaaatagggtctttacagatgtaatcaggttaagatggtcagacaggattaggtgggccctaaagccaatgaatagtgctctttataaggagagaaatatttcaagacacagagaagatacagggaagaaggccatgggaagatggaggcagaaattgcagttatgctgtcataagccaaggaattccaaggattgctggtaactgccagaagctatttggttggtacaaaagtaattgctgttttacttttaatggcaaaactagaatctagacacatgagtgtgtttagggatgagggaagacgataacaatacagctcatcgtcctttgattcctctttcacctgggatcgatcctcttcccaaacatgaagagggttttccttgggttatatttgccctcaaatttcctcattcaaaaataatctgtttgctgggtgcagtggctcacgcctgtaatcccagcactttgggaggccgaggcgggtggatcacgaggtcaggagttcaagaccagcctagacaacacggtgaaaccccgtctctacgcaaaaaaatacaaaaattagctgggtgtggtgg

SEQ ID NO: 136879 - DNA, 493 bp, Homo sapiens
cgagagaaggagtctgtggaaaactgcctctgaaattccataagaaatttctcaagaaacctgattctccttttagaaacattaatggtaacttagcattttagcttctactctggctctctctccgcccttggtcctaccaccaccccctcctgaagtctgaccaggtctcctctagttggtaatggcagcagtcagcatgcctctcacctgtccatcagtgatgaggggtgattactccccttgtccctgcaggctcctcagcactaccctgcaaccagccatacccagggacacacaggagggaagggagttaactggctccatccagctaagtgagggcgggtgggggtctgggcagcaggctgtgagaagttcacagtttgtccatgagctttacgcttcctgagaagagaatgcaattaagcaggtaggtgcatttggctttttaacacttctgtagttaatcgctctttctctgccttctttcttc

SEQ ID NO: 136880 - DNA, 1432 bp, Homo sapiens
gaagatcccaggcagctggcactcctaggtgatgttcactaaactggctacatgggcgatgggattgccagaaagcaaaagatcagaaatttgagcctgaatttctgggcaaatgcttgcctcagttgccttcgatgttgagcagagaggaagtggcttgtccacccccagagagggatggcttgaatgaacaaacagaaggcacttctgtagtcagatgtcatgttcgtgtttaaaaatctgtcgccaggaggccctggcctcggcatccaccctcctgggattagggagcaggggcagggccagcgtgattaggacgcttggtttcgccagcgtcatctgcccgccccactcacattcctgtgtgtatgaaagtcgtctgggggggctttagcagcccggagtcatccctcctaggctaaggaaggctgagctctgagtgctggaggctgcccaggcaccctggctgctgagccatccagcccagagccaggccaccagcaacaacagggaggctccattcctgctgggctgtaactggatgccagcatgcagggatgcagaccgaaatatccaagtaacgatagcaactgggatccgtgcgagtggatgcatctcagcaacctaagcaaaaagtgcagcaaggacttctcaatgagacaacctcctccgcctttttggaatgttacaggatctggacccttcaacgaggtctccatgcagtgccctcgtggtctccagggcaactgtaccaccccttctctctcctaaccctccctcagcagacaaccgttttttgtttttgtatttttttgagacggagttttgcgcttgacacccaggctggagtgcagtggcatgatctcggctcactgcagcctctgcctcctgggttcaagtgattctcctgcctcagcctcccaggtagctgggattacaggtgtgtgccactatgccggctaattttgtatttttagtagatacggggtttcgccatgttggtcaggctggtcttaaactcctgacctcaagtgatctgcccgccttggcctcccaaagtgctgggattacaggcgtgagccaccacacctggcccagagaactgttaagaactgttattctaaccacaggcttcctcctcccaattctctctcctgaactgaggaccgggaaccccactttgacagttcctgatctcaagttgaggaatgtgctggcgtcaggaggcagcatctgggctgtggtttctgttttgtcgagtgaataccaaaacagatataatcccaaatacaaaatatgtgcagctggaggataaagattaaaacccaagagccaaaagaacttctttctcaagttccgattctcccagcatgtaggtctgtagacagaagcgggggaatgaggaggcctaatggagggatgccagttctca

SEQ ID NO: 136881 - DNA, 342 bp, Homo sapiens
ccagagccattatgacgccctatttctctctctctcattccttttgtactgtcatcatatcttactactatatgcattacaccttataatgttgtttctgttctaaaaaatcaaccgtctatcatggaaattaagactaaggctttgttccagcattataatttactccaagatgtttttcgtcactcacacttttacagtcttcctatatctctaaaacctctgatggattttgtaattttttttctttacttctttagtgaagtagttccattttgttgctaaaagccgtctttgaaagagggttcaaattccacattgtgtcaagcgagcatccatgtg

SEQ ID NO: 136882 - DNA, 280 bp, Homo sapiens
tgggtgacatgagcgagactccacctcaaaaaaatatttgttctcattttctagaagagatagattcagaaaggttaaatgagtcagggccacatggaggagttagaatttgaacgcaaaactttatgattccaaagcgttgcatatactaaattacctccctcaagaatgaaaacttcttgattttcttggatcactacttttctccagcctttctagttttcctaataatcttttcctcttctcatgtcatgcttttcttcctgggtggttttttttt

SEQ ID NO: 136883 - DNA, 490 bp, Homo sapiens
gggaacgagaattcctccccctacttttctctccctgagtaagcaatgtggctggagtagggagggtggtgcctacagcagcccctatacctcattcacccccatcctgcccgacccatccactccccaccacaagctggcaggtaaggcagtctgggaggttagcagaaccggaaattcaacccagagaggttaggggatgccccagtatgacccagcaagtccccaccctaggactccagggtccacatgcagatgagatatatgggaccccactgctgagccagagtgaggaaggcagggttctgggggcagccagcccctccccaggcaggaacaagccactgccccatctccaggcccctctgtaatccaggcccctctgtaacccaaccccccacacggattgtgcaataattacaggtacagctcattcctccaattccttcttccttattatctcatcgcctctgctcaagctgggcccttc

SEQ ID NO: 136884 - DNA, 816 bp, Homo sapiens
caattgctgtgctctctctcctccggcacacagaaatgctctctgcatcatgctgcttctgtcaggggtggtgccagcaattcaagaccttttttttctgtctcttcagtgcctctttcagtgatatgaagttaaaacgaggtactatactatgagtgctcacctgatttttggttctcatgaaggtgctttttttgtgtagatacttgttaaatttgtgtccttcttgttgtgaagatcggtagagccttctattctaccatcttgctctgcctcctgattctgaagcttgattcctttttctctttgtaacttcaaaaatattgaactttcctcagggctcaattctgggccccttctacctcttctataaacaatcttcccaaggacttcttacacactcatggctttaaacagccctttttttttgccaacaactcttatcggggatcctaccccattattcgtgtaggttctttctattttccctaagcgttggccagcttgagaaataaagggacagagtacaaaagagagaaattttaaagctgggcatccgggggagacatcacatgtcggtaggttctgtgatgtcccacaagccacaaaaaccagcaagtttttattagggagtttcaaaaggggagggagtgtgcgaataggtgtgggtcagacatcaagtactttacaaggtaatagaatatcacaaggcaagtggaggcagggcgagatcacaggaccacaggactgaggcaaaattaaaattgctaatgaagtttcgggcaccattgtcattgataacatcttatcaggaga

SEQ ID NO: 136885 - DNA, 533 bp, Homo sapiens
ggcgttcaggaggatccctcaagacgtatcagaacataaacaactctttttacttcgaggcccaactctaatatcaaggtctcttgccaggctgggcacagtggctcatgcctgtaatcccagcactttgggaggctgaggtgggtggatcacttgaggtcaggagttcaagaccaggctggccaacatggcaaaaccctgtctatactaaaaatacagaaatcagtggggcatggggcgggtgctctgtggtctcagctgctcaggaggctgaggcaggagaatggcttgaatccaggagacggaggttgcagtgagttgagactgtgccactacactccagcctgggcggcagagtgagacgctgtctcaaataaatacatacatacaacataaagtaagatgttaaagtaaattttaattttagataaacaatggataattttttagcaaaaggatgttccacatttaactggacattatctctgtctctctccctccttacctgcctcctatcctctcttcccaccccc

SEQ ID NO: 136886 - DNA, 795 bp, Homo sapiens
gggaaaagttgaaagtatcccctctgcaaactggaacaggacaaggatgcccattcttatcactcctcttcaacatagcactggaagtcctagcaagagcaatcagacaggaaaaagaaataaacggcatccaaatcaataaagaggaagtaaaaaaagtcactgtttgctgacaatatgatcatttaccttgaaaatcctaaagactcctccagtttgctgataaaagaattcagcaaagtttctggatacaagattaatgaacacaaatcagtagctcttctatataccaacagcgaccaagcagagaatcagatcaagaactcaaacctttttacaatagctgcaaaaataaaataaaataaaatacttaggaatatacctaaccaaggagtcaaaagacctctacaaggtaaactacaaaacactgttaaaagaaatcacagatgacacaaacaaatggaaatacatcccatgctcatggatgggtagaatcaatattgtgaaaatgaccatactgacaaaagcaatctacaaattcaatgcaatctccatcaaaacaccactatcattcttcacagaattagaaaaaatcaattctaaaattcatatggaaccaaaaaagagcccatatagccaaagcaagactaagcaaaaagaacaaatctgaagacatcacactacctgatttcacactgcactataaggccatagtcaccaaaacaacgtggtactagtataaaaataggcacatagaccaatggaacagaatagagaacgcagaaataaacccaa

SEQ ID NO: 136887 - DNA, 207 bp, Homo sapiens
cgtcacactatgtgcagaggattaatttccaactgtagggtaatagttgttttgccagttttagtggacactttttaggatgtctgccaagcctactttttacaaactttttttgccctgacataagagtttgccagttacccctgtacccacctttcaccagagctgacccaaacagaaccaatgagattcttgcctggcaatctg

SEQ ID NO: 136888 - DNA, 1128 bp, Homo sapiens
cgtgggtaggagagttatgctataccaataaacgaatcaggtgcctcgaaagtgacatatattgttcctttaagcattttttttaaaacagctctcagcatgttctgtagatacttattattttccagcccaataattatactttttcattgattatgcttatacaacaaaaatggatagagtgttctggagacaaggccagtggtgaaatgccaaaatacttcattttacagaatgttaagcatctggtcatttttctataagtttcttgtaaaatgtttcatcaaagtggaggggtagccacaaagggaggaatttcattttggtaaccagaaccagcttatcccatcctactcacttcatcatcactaccctggctttgtaaaacctgttttgccagcttaggagggggcttcatactgggcaaggaaagcagagtcccttgcagtgggttttcaccatccaccagattgaagcacattctgcaggctgtctgcatatcataagtatggttataatgactcacaatttaaaattctattcaccactcaatcctccggcaccatgtagcatcttgcctttgtccatttggcactgatacttgtaattaacaaaaggacccatgtaaaccatgtgttttttatcatatgcctttgaccagaaaactcaaaacagacagcatccaatctgtttgcaacattagggttgggaaggaagagtgttcattctgttctctctgtttcaaagatgcagtgagatgggctagaggggacttaatagacacatgtgcaagaggctaaaggtgaagccaaaagtggacagagatatcccaattcctgttggcccagctcttctcttctatggaccatgtcctcttaactgggatccaacaaagggtcctcttctcatcccttcctcccttatactttttaaggcataatgggtgattgagaagaaatagaaaagttaatacattatattcattaggatagtagctcaatttagctttatgtttattttttgagacagagtgtcaccctgtttcccaagctggagtacagtggcatgaagatggctcactgcagcctcgacttcctgggcaatgtagtgagacctgtctctaccaaa

SEQ ID NO: 136889 - DNA, 693 bp, Homo sapiens
ggacttaatagacacatgtgcaagaggctaaaggtgaagccaaaagtggacagagatatcccaattcctgttggcccagctcttctcttctatggaccatgtcctcttaactgggatccaacaaagggtcctcttctcatcccttcctcccttatactttttaaggcataatgggtgattgagaagaaatagaaaagttaatacattatattcattaggatagtagctcaatttagctttatgtttattttttgagacagagtgtcaccctgtttcccaagctggagtacagtggcatgaagatggctcactgcagcctcgacttcctgggctcgagtaatcctcccacctcagcctcccaagtagctgagactacaagggcgtaccaccacacctggctaatttttatgtttttaattttttgtagggacaagatttcaatacattgcccaggctggtctccaactcctgagctcaagccatcctcccacttcagcctcccaaagtgctaggattacaggcatgagccaatcgatttatcttttaaagttgtaatagactgggtgtggtggctgaggcttatgcctgtaatcccagcattttgggaggcgaagatgggaggatcacttgagcccaggagtttgaggccagcctgggcaatgtagtgagacctgtctctaccaaaaaaaaaaa

SEQ ID NO: 136890 - DNA, 231 bp, Homo sapiens
aaacagtgggagaccgaacatcacaaactgtgaaggagactgacagtgagaagaggaccacagtctgacttgggcattgttcttaaccttgatagagaatggcattcagtggagtcaattgctgggattggagcatgaatcaggttataagagagtgaacaaaagatgaagaactttaaacatgatttgtagacttctcttacccagaatttggcaagaaacaaaaggatt

SEQ ID NO: 136891 - DNA, 365 bp, Homo sapiens
gttacaagcttcaagccccacaaaacctggatctgtctctgtcttggatccaagacttgctgcctcatgttggttttcctgttgtcacttcatattacacagatggggaaattaaagccaagagaggggaagctaaccttacttggcaaaactgggacaggatccagttcttccaattcccagtttaatgagtgctctttccccctattctgtaaagttttttggtaacttgtctgtaaatatcggtcatggtacattgtccactgggtggcactcaagagattgaaatttgagttccttctctttgagtagttgggtagtcttgaactagtccctttccctcctgggacagattttcccagttt

SEQ ID NO: 136892 - DNA, 416 bp, Homo sapiens
ctttcgcttgtctcctgtctgcagtttccttcccattctgctctgtgtgtatttagatcttaccagtctatttcgtagtctctcccatggagtgtattttctaatttgtatctctccatctgtatgtctttgaggaagtttatttaagctctctgtgcttttttagattactcttaaggtgtgtcttgataaccaaggttattggagagtgatgctcttggttaaaaaaaaaaaagcaggaggtagtaaagtgaaagtaagcttcttttatgcttgtactcctcagaggcaaccactatttactatttttaagaaccaatttaaaaagaagtttgtgtagttacagtctcattttaaaaacatcctgtgagattatactgtattactactgttcaacttgctttaaaggttgaaac

SEQ ID NO: 136893 - DNA, 629 bp, Homo sapiens
acttcagggacatctgcggccacctgtcatcatgatgttgccattttggcatcaggaagtggtggtgagctttgaggagctttgtgtgtgtttgtaggaagtagtttagcccagtcttagccccagggtgtgcattctgcccaacagctgcctagatttgggttgtaggcaagctaagcaaaggcaacattgggttccaaggcatgacctcattggcattggcttaaccagccaagctaaccggctagccaaccagccgggtggacgttacaggactacaagcatccttctttcatgaccttcccagggagccctgctcagctcagctgaatcacccttcagtgctgacagcagttctagtctgtgtccactgttggctctcgctggagaagcctatagagagccaactggttccctattgggacagctttgttttccctgctgaacacaaaatcccctgttcactgggagagctgacaaggagaccccatggggctggcccggtgggagcagataccaatgaatgcagcgcccgaatggcttcagcttattaaaggcgaatacacaggataactctgcccgccgagtgggagatagaatggagggcacagagctgttacagcggatta

SEQ ID NO: 136894 - DNA, 172 bp, Homo sapiens
cattctgtgtgctggggcacacagaaaatgaagcagacaggctccctgccccaacgggctcacccacacaaatgcccacagggcctaggaagatccagcctggagggaagccagccaggtagtgagcctggagaactggagaagactgctgccctggtggtggacatcctcc

SEQ ID NO: 136895 - DNA, 461 bp, Homo sapiens
gggaatgatgctaccacagacactgtctgtccagctcttgctaaagacatgtaattggaaaggtttttttaaaaggaaaactataacaaaagaaatagatacatgcaaaaaaaaagataaatagtagtgaaatatttagaactacattatttctggagaaaatgagtttactggctaaactattggcccttgcccttcttctgggtttactgagaaggcatttggtgcctagatacagacttagccaaatatctctcccacttttggtaaaccctctgctggtgaatgatgtgggaaactctctcggaattccacaccttgctttagtttgtcttcattcccttgctccacttctatgcttggagcaacagcatgctgcctccccttcctgccctcttgtacctttcatgcaggtgctgatggtgagtcaggctagaggtaagggaggacctggaactcca

SEQ ID NO: 136896 - DNA, 205 bp, Homo sapiens
atggcctggcccagggcacaagccctctgcatcgtcagggcggatgatacacaggtctttggtgtttcatttttacccacttaaccaccctaacaaattcagaatcctgccagcgatctggctaccttgggagacctgagtaaaccaaagcccccactgtgtgcaggtgttgacattcatcatttcggggacaggtactgggtgt

SEQ ID NO: 136897 - DNA, 433 bp, Homo sapiens
tgagtccaccacacagtaaatgatgacattttggtatgtttggtatattaaactcactgctatgtatttttaaaaataaaaatataaaattccttgtgaagactattataaaatattatcatctggattgtatcgtatgtctatactataagctacctcctccattctgagcttgttcttccccattttgtctattattccaacaatgctgcaataaacacctttgcatataaataattctcttaatttcccatatcaccagaagttctagaaacactgttactgagtttaagggtaagaattttaagtcctttcatgcatagctccacaatactgacagatcataaactgagataattttcacagaacatattgaacatgctgccatcttaccaagggcttgtcagcaccagctgttatctgacacaacttt

SEQ ID NO: 136898 - DNA, 685 bp, Homo sapiens
acacccggctaattttgtatttttagtagagacagggtttctccatgttggccaggctggtctcgaactcccgacctcagatgatccacctgtctcggcctcccaaagtgctgggattacaggcgtgagccactacacccagccttttttttttttttatggacgagttcctacctgggacttctggtacttgccttcctgagtcacatacttagtggggcagggaacaatagagtgagcattaactgtgtcaaaatgttatatttccctaaagttattaaaatgcaaagaataataatttactgttcagaatggtccaaggccatttcatacccaggctgctgtgggaagcagtaggttggtaagagccagcatggataagtttctcactttaatgcagcctttgaggcaaggtttgaaaatcgcttttcagactctggtcacagcaagcagtatcattactgtgtcttctagccagcaggcattggatcatcattaacaactatttcctacgtttttcctccatgctaggcttgggctggatacaggacattcagagctggcctgatggtctgtctaatgggaaagacggttcataattgactctggcggtttgtgttctcactaaaatcttttttttttttttttgagacacagtctcactctgttgcccaggctggagtgc

SEQ ID NO: 136899 - DNA, 503 bp, Homo sapiens
cccataatgggtgagacacacatgaatagctgccctcaccaagcccagccaaaatggaatatttgtgagcaaaagaattattactttatttttaagccactaggttttagggtaatttataatgatacaatagatagctgaaacaaacacagcttgaaagataggcaaactagaactgaaactcagttttactaataccttattcaaaattctttcaacattatcatttttcttcctcctcccccaccagttgtagtagaggaaaatgaaagaatagatatcctatccttaagaatgtaggaagagaaaaatatgactagtgattcaattacttcattctaacagtttgtcacaaatatttttaaagtcactatggtggaactgttggaattctgagtcctgttttagagatgtttaataattgactttcttttctgattagaaatttgtatgtaatgcacaaaacatttggaagccaagtcattggtattgttatgtgctta

SEQ ID NO: 136900 - DNA, 337 bp, Homo sapiens
cgggtggatcacgaggtcaggagttcgagatcagactgaccaacatggtgaaaccccgtctctactaaaaatacaaaaattagttgggcgtggtggtgggtgcctgtaatctcagctactcaggaggtcccagatactcaggaggctgaggcaggagaattgcttgaacccaggaggcagaggttgcagtgagccgagatcgcgccattgtactccagcctgggtgacagagtgagactctgtcccaaacaaacaaacaaaaccacatagcagggggagcccaactagatataaaaagcaaatgcttaccctagcagtaacggggcaggagcccatg

SEQ ID NO: 136901 - DNA, 229 bp, Homo sapiens
gcaagatatttaactcaacattctttactgaaagtgggaagaataatagtacctacctcatggcagtattgagaggattaaatgagatgatgtgtgtaaagcattaataatgcttatacttggtccatgtaagtgctcagttattaatgattattgttattcaaaagtaaaggtagtcaatgaacaaatgtactcagcctctgcacctagcacctatttatgctttttt

SEQ ID NO: 136902 - DNA, 138 bp, Homo sapiens
tatatatatttttaaatcattgaattccatccgtgaaggttaaaataaagatcattcaataaacagtaccaacctcaacctttatgtttaaatttctgtctgcttttgcaaatgcatcagcacagtatctttttttat

SEQ ID NO: 136903 - DNA, 404 bp, Homo sapiens
tgcatcctaaaattcatacagaatctcaagggaccccaaatagccaaaataatcttgaaaaggaagaagacagttagaggtctcacatttccttatttcaaaacatattacaaagctatagtattcaaaatagtctggtactggcataaagacagacacacagagcagttaaacagaataaagtgtccagaaataaacccttgcatatatagccaattaattttcatacaaggacacaaagactactcagtgaagaaaggacagcctcttcaacaaatggaactggagaaactggatatccacatgcaaaagaatagagttataccctttatcttacaccataaataaaagttaactcaaaatgggttaaagaccgaaacataagacccaaaactataaaatgc

SEQ ID NO: 136904 - DNA, 366 bp, Homo sapiens
attcatgtatactgatatcacgagtaggcttcttctcaacattttaatgctcttttataattactatgtgtgttatgctgtgtttactaggtttctctatttggtatgttttgcttattgttaacttcttttggagtttagaaagatttgtattttttgttctaatattaccttttcattcatgctctttatggagctcatttaaatatttactctctggtttgtcagttttaagtgctaaactttgactctgctaccagttatttctactatagacaattgactgattttactttcctcatatcttcgttttcttccagtttttgtttcgtctattgtactttgtcagaacatgtaacatctcca

SEQ ID NO: 136905 - DNA, 440 bp, Homo sapiens
gtttttatgatgaaaacaggcaaaagttttcaaaagtagtgcagagctttatagaaaattagaaaatgcagacagttaaattaaaaatcacttaaaaataaaaaaaatagttgaactacctagagactatcatgtcaatcctttagtgaaaactcactctgatttttttctacacctaggtatagatatttgtattttttcctcagcctgcaattgtatttactcacatcgcttttcaacctactctttttagtggatgatttctacccatttattttagtaaatgttttatcttatatatagatcatactcaaattttccaaaatggttatagcttgtgtgtccaaatcacagttgagttcaatactacacatattatccagttgttccatccttgagtctcttttaatctagcacactcccctttctataatggcata

SEQ ID NO: 136906 - DNA, 357 bp, Homo sapiens
tacattgactgcctggaacgcagaattataaagtaaaagacagtgttagacaatatttccaaggctctccagtttgtaaagatttgttaatggatctcccagttcccttcctgtttctttctcttgctgccttccttttctgattctctttttctctttcttttttatttccacaaataatgcagcatactggaaagggcaggtcaggacagcctaggttcagaatctggctttcacatactacttgtatgacctcgaactgatatgtttaactctttgaccaaacctccatttgccagtctgtaaaatcgcaagactaatacctaccctaatgaggttattgggaaaaatgagaaa

SEQ ID NO: 136907 - DNA, 327 bp, Homo sapiens
tctgaagttccagctggatatgaattttggagacactcttcagcctaagtgatggagccccgagcacagggcccacgctggccagcatctggttccacacaggaaagccaagtccctgtcctggaggactcaggactccattcggggtttcaggctggccactcacaaccacacccaccgtgggtcagggggttcagaaagtgacctggctcttgcaagacggatggagaggagcctcgctccagggagaggtgcctccaggaagggctgaaacgggttgaggtccgttccaaagtctctagttgacctggcaggacccctggcttg

SEQ ID NO: 136908 - DNA, 281 bp, Homo sapiens
tctagttgctctcaatttttttcttacagtaagccttcctcttaggtaatactattatcacatcaacatgattataaataagaatggagaatcaatccaagaaagacacagcgtgactacctccaaagccacttaatttggagatagaaatgaagaggtgtacagttcatcctcagtagggttgcctatgctttgtgccttcctgaaacttttaatcactggaggctgtcataatcttccacatccacaccgtccataaagcatttgttacatattgactt

SEQ ID NO: 136909 - DNA, 281 bp, Homo sapiens
aagaaaagaacagtcatgtagggctgtacagactactgtcaggatttgggctttgactctgagtgaaatcaagagctctgtagaattttaagcaaaacagtgccaaggtctgacttatgtttcaaaagaattccctacgctgctctgtacaggaccaacgatgggtgcaggaaagcctgaaggagtctctactgatgaaaagtaatggtggcttggagcagagtgagaccagaatttacgctgtgtgtttcctcatgtgtctcacgctgtttgcctatgta

SEQ ID NO: 136910 - DNA, 399 bp, Homo sapiens
accttgttggttccctgaaaagattttgtgggacccttgtagtccttagactatgctttgagaactgctggccttagcaattgaacgtaagtacagtaggagacattggtagaaatgcttttgaatttacagtagagtctgggcatcaatattagatgtctattgatcttttattaaaagactaagagtttgagaatttaaaggctaaaacattataggtcctgctgatcagacttttcatagccagatagttctgtaggcttaaggccctttaaatccagataatgtccaagtaagtggcaaggcagcaatttggattccatagctgctaaaaagttttttacggcatttgtacatagatcattaagaagagaggaattatttctcacaaccaatttt

SEQ ID NO: 136911 - DNA, 529 bp, Homo sapiens
tcgtgcctgggaaagactggcgcctcactgagatcaggctggagtgtgtctctcgtctggctcttgttatacactagtacaaataacagaggtcaagtgtaccgaggtggcaccacaaccctgggagtccccattcctgggctacgtgcaaatcaaatgacaactagattggctgtgcatatccttcaagaacgatgtctgtttcattttactaccaatcacatagaatctctctctaagggccaaacacaaatcacacctgcagtagcagtgctttgggatgctgaggtgggaggattgcttgaggccaggagttcagggccagcctgggcaacagagcaagaccctgtccctacaaaacgttaaaaaaaaacacaaaaacccaaaacaaagagtctcactgttgcctaggctggactgcagtggtgcattcttggctccctgaaacctctgcctcccgagttcaagcgattttcctgacttggcctcgctagtagctaggattgcaggcatgcgccaccgtgactgg

SEQ ID NO: 136912 - DNA, 372 bp, Homo sapiens
tactatttcactggtactgaaatgaaattatgatgctccttcttcggcttcatgaagcagatgtaggtggccaatgctttatcttgggtggaggtgttttattcccattcatttgatgactttgtgaataattccttttccatcagctcaacagtgacattgaaaccattgaatcatttggttacaacctgcaattgactttacaagggaagctgaggccactggctggtgccaaaaggcttcctggtgtcctgagcagcaccctgcctctcagtggtcaaatcactttccctccatattactttgatgttcattcaagtgaaatgacctcagtactagcttttgctgctatttttttttttttaactagca

SEQ ID NO: 136913 - DNA, 354 bp, Homo sapiens
agcttagctctagagtgcttcagaagaacagcaacgctgaaacctctggctttcagtagtgtgtataaatgatggaattctttctaatgtgcttcctgtagctttagctaccaggcattcgttgatgtcaaatctctagacttctctgctgggctcagacccatacccatattgccatctggtgtttggacattctcatctggctttttcattattaaattcagcaggtctaagcttcaacttatttctgtcttccccaaagttcctttggttcctgtcttaaacctaggttaaatggtaccacctaattgtgtgagctggaaatcccaatgtttttctttccgcttttcagtt

SEQ ID NO: 136914 - DNA, 200 bp, Homo sapiens
ggaagggatgacccgttcaatatatggtgctgactcagttggatattcacaggtaatatacatcttgatccctatttccacaacttgaaaaaaaccaagtccatatagattgcataataaagatgaaagtgtaaaaaagtaaatattatggttaaaaaaaggaaagtgtcttcatttacttgaagtaggtaaagatttaa

SEQ ID NO: 136915 - DNA, 432 bp, Homo sapiens
  misc_feature (75)..(75): n is a, c, g, or t
  misc_feature (118)..(118): n is a, c, g, or t
tgtctcagtttcgggacggagtccggctctgtcacccaggctagagtgcagtggcaccatctcagctcattgcancctccgcctcccagattcaaaagattctcctgcctcatcctgncaagtagctgggattacaggcacgtgccaccatgcctggctaattttcgtatttttagtagagacagggtttccccatgttggccaggctggtctcaaactcctgacctcaagtgatctgcccacttcagcctcccaaagtgctgggattacaggcatgagccaccatacccagctggaaataatatttgaatgaactctaaaggaggaaaggagttaactgattgaaaatgaaaggaaaacccttctaggtaaagcagccagcaactgcaaaggccctaaaaggggaacattgtgcgtcccgaaactgagaca

SEQ ID NO: 136916 - DNA, 479 bp, Homo sapiens
ccagctagcggctgtgcctctcgacttcacagctatcttctggctctccactgcttcactgtggccttgtggtgtggcctctccccactgttgcctccagcactgctctttgccagagtcacctggttgctgcatgcactcactggtcacttaatccccatcctccttgaccacactgtggcattacaggccattgcctaaacccttctctgagctggtagcaccactctttcctggcttttctctggtttctttgaactcaattctatccctttcactattacttccatcctctgcccatgagtcatttaaacacacgtttccccaggttccctgactgacctgcttctcctctcatttcactctcactgctagagtgactcatccactgctatggcttcaatatattctgaagcctctcaagtctcctgttcttggcccaaactcaccttgactatatacaccaagctctgcctcac

SEQ ID NO: 136917 - DNA, 413 bp, Homo sapiens
ctgaaagtagaatgggggttaccagaggcttggaggtatgggtaagcagggagacaaagggtacaacacttcagatgcaagaaatgagttctggtaagccactgcacagcatggtgactacagttcataaaaacgtgagacacagtggcatgcatccatagtcccagctgagaggctaagggcaagaagatcacttaagcccaggagttcaagtccagcctgagcaacatagggagaccctgtgtctactagatatacaaaaattagctggagatggtggcaggctcctgtagtcccagctacacaggaggctgaggcaggagaatcgcttgaacctgggaggcagaggttgcagtgagctaagatcgtgccattgcactttagtctgggcaacaagagcaagactccgtctc

SEQ ID NO: 136918 - DNA, 490 bp, Homo sapiens
accttaatacgtggctgttagacaacctctcttcagctgctctgaaagaagacagatcccttcagacaggcttcagaaagacgggaaggaaagctggtgtacacccagtaccccactgggagacgtcctcagcaagcagccagagaagaggcacagcgcgggaacttctgctctaggggtaggaatgtggtgggacccatctctctccttggaagaatgtgggactctcgcctgctcactaaaaccaacacctgccgatgtgctaagagtcctcttgaagtcccaacaatagacatcaaagctgatgtttggaagttcagataacaaggaaagggagtttaaaaaaaaaaaaaaaaaaaaaggaggaaggagggaggaaaacaacaccaacaaaaagtctgtctcacctttgacctctggagaggcaacagaccaaacactttaaactatgctggaggacatacaccgtccctgctcacctataaaagca

SEQ ID NO: 136919 - DNA, 348 bp, Homo sapiens
catatccagggaaattaaacaaaaatataaactaatgtgatctggaaaatgggatttcggtctcctgtctaatcatatttccaaggattccagagcaccgtggaaaaaaagaaaagggatatacaagccaatgcatatataatttcacataatttggattgcacatacaatccaaattaagtgaaaaaattaagctctaaaagaataaagcataaatgattgaaccattatgtattcctattgataatgccataattatgcaactacatttcagatgttaattctctttagaaaattatctgacttcattaaactacttcagagctaagtcaagctgatctattacag

SEQ ID NO: 136920 - DNA, 367 bp, Homo sapiens
ttacaaaatgaaaatctgagaaatgccccacctacatcactacatcaaaaaagcagctgaaagacaaagagcccaagccttctcgcctttccacaacaaatgtagcttcctttgtaaacaaaaaataagttgttttcaacaacattgaagcccttcatttcacccagctttctttcatgcagagtgtgtcctcacatcaggggaaacaggagagggaaagaaaaaagtctggaggccaggacacaggagtgttagagaaaactcaagctgcaactggtctccctacagcttgcagaggaggagactagcacacagacatcaacacttcggtaaagctgaagcataagccactttttttttttttttt

SEQ ID NO: 136921 - DNA, 284 bp, Homo sapiens
gctgggattacaggcatcttaatagacccatgtccctactgccgccaccaccagaaaaaagggctataagtccatgtcctgaagcccaaggcctcctttggctgatggtcaccatgacacatcaccacgtcatcaggtgcctgggcctcagttttagcctcagctcctggtgcgagtgccatcaggagaggaagttctagcagtatgttgtgcgaggggtcaggatatttggttttactcaacaatatttttgtcttggctcagttggtcacagctgtacacct

SEQ ID NO: 136922 - DNA, 418 bp, Homo sapiens
agcaaggatcccagtcgacggagactctccaaatatgatatctaacccttgttctgactccaaacagagttgttttcgtttttgatttttgtctcaaactttgcagtttttatagaagtttggttagatatcatatttggagagataacaatgataattattttgctaccttttagtagctctgctgtaaaataattttagctaaaagactgtaatattttatgaaaataacaggtttgagtttaaatgtgcagattcaaggtcttattattatctttgaccctccccttaagtgagagagggccataaaattacattcagttattgactttacaggtaatcattgagcacctgccatgtactaggtgctttcagatactggagatagagttgtgaacaacacagagagtctccgtcg

SEQ ID NO: 136923 - DNA, 260 bp, Homo sapiens
taactgccttccttctctacattgctttacggtataattcctcagggctgtccatgcttgctgtctccaatctctctcctccattctctctctgcaacccatgccaatcacgctgcacccactccacggaaacagctcccttcaagtacaccaatgacttccacattgttaaatcccaaagccaatcctcagtccttgtcttaccagatagcaatatctgacactgctaatcccctccttactcagcttctggggagtca

SEQ ID NO: 136924 - DNA, 772 bp, Homo sapiens
caccgtgcctgaccatagccctgtctctttaagtaatcccagaaattcaagaacagagagctctggacatcccagttctttttaccacaaaactcttggatccactaactacctaactcttaatctccagcttctcctacaacaacaagcttcatccttgtccaatatcacctctaaacttagaaatttgcccctcactattcatcccattggatctgaaatggacttggcttttttggtttggcctcctgttgccccctggctctatccattctgggtacctactccaggagatcaagcctacactcacaagacccaacctgtgattagcaagatgcacaaggccaccactgagatcatctgtggttcctgttggagagaactgaagaaactgggcatgctacaatcatcatgagtgcagtcagaaggaggacataattctgccaagccacctgctgcttctcctaccaccagcagcagcagccccttcccctggatgttcattcacctctcaggtaagcaagaaggaatagtccgacttggctcaccaccacctgaagcaacatttgatttatcagggaaagcaaaaatgaattgaggaatcaagacatgaaagtagaaaagactgaaagctccctgaaggcaagcattatgtgtgtcttattcataattgcatcttcaggtcatgccagtgtctaacctgttagtaggttctcaataaatttgtggaaataattagaaatagaatgtctgtcttttatctccatcatac

SEQ ID NO: 136925 - DNA, 1374 bp, Homo sapiens
taatacactcccaccagaaacaagaggcaaggcaggccctgggggcctcacaaaggcggtcttatgcaagggtgagaaagcagagttatcagggaggtgggactattgctttatgaacgtgatgattggaagcaaaaacgtggggctttttcctattgaatacaaagtaaaataatgaatgctggtgtcagtggttgggaataacaacatttgcaggctcatgagagctgcctgacaaaaagcgtgtaaacaacagtgattgctcctgtggccctgtgattcagcaggtttatggagcagttaagaatcgcagatgtcaaatggccaacacagaatctaacgacatgcttaatacaaattattattagtagaaatgctgaattgcttcatttctgcaatttctgctgcttcttaagatgcttttaatgaataaaatctgccttaaaatttgatacctggtaacttctctctgtgagttttgaattggctgatgtaaccaaaatgccagctcttgccatctaactaccattaaaaggaacttctaaagctccgaagtggtcaacagtttcacttccaacttttttaaaagatacacaattttctaaaaaatttttctttatgggcgattgaatagttgggctttggctaattcctcattagcaatagaattatgtatattttgcaaactctaatacagaacacttaatgtatcagacaaccatgattatgatgtatatacctggtataaacaatcttttttgcatattgaattctgcatttttttcttccttgatacgtatgagattcaccagtaccagtttttctcttgtggtggcatatagttgattgtcatttgcattatctattaaaaacctgtggcagctcatggtattattgaccatatgttctagtgtcttcttgcagatttaaatattttattgcagtgtaaagtttaatatttagatgtgtgatacatctttggataatctgtaattaaattgatcttttgtaatggtgatagtgattagcacacactgaaaatccagcaaagcaattatttttctctttttaactggaaatcatattcgtaagttgtggtagatattatcatcagtgtattcatgattcgatttatattttgtgttatctggttataaattttatatagcattcaatttgacaaaatataaatctatttgatttgaattaatggtgtgtgtgtgtgtgtgtgtgtgtgtgtgtacttccttgaactttaggaaattctacaaatcttatacagatatgaatgtatcaggcttatattttttgcaaggctatatatacatttcttctgtttattaaaatactggaattggtgttatgtagatatag

SEQ ID NO: 136926 - DNA, 344 bp, Homo sapiens
aagccttttccatccatatttatcaacttcctaagttctcttttgagtggattctctggtgttgaataaggaatgaacgttaaagagaaattttactatactgattacactgaaagggtttctttccaacatggattctgatatgatgaaaaagctgaattctgactgtgaactttaccacacttgttacactggtagtaacatatctccctggtgtgaagcctctggtgctggttgaggactgaccactggccaaaggctttgttgcacttgtcacatttattatagggtctctctccagtatggattctcttaacgatgaatgagtccagtgtttgcactga

SEQ ID NO: 136927 - DNA, 562 bp, Homo sapiens
ttaccatttgtatttgttgatatgtaatttacattttattcattgaattagtatttataatcttggtttgtgtatggagtatatatgaatctgcatgactatgtctaggattataagatttaaagcaccataaaaaacagacatataatgggacactttttctgctgttgacaactttacttaatatatggtggtaactagtttcaaaagcagttttcttcatctacagtttgaatttgctttcagttgccttttcaatttatttctgttcaagaaacatttttgagcttctaacatgtataactctttgtgctaagagctggcagaataaataattaggaaggtagaattactcaaaaataaatggaatcatttcatgacctcaagaagaaatgtcaaaatctagatggaatgatagataagtattaatatacgattaactgtaatacaaaacagattgtgctaagtccagggtgagtagagaattttaatgttaggtattgataaacattctaataggtacaaatgaagtacaaggggatattagtgggaatagtgatta

SEQ ID NO: 136928 - DNA, 498 bp, Homo sapiens
gtaaaaagcataggcagttgcaggaactaaatgttgtcattaactgagtgtactgaaaatagttttattctttttaatttgtataaaggttgaatggttttcatttttaaacaatatttatcacaatacagtaaaattgcactgaaaaacaaaagaatgttgaaaagcatttcaaatcctttatgttatgactttatttgctttttatctaaaaagaaatttctctcctgtagtgtcacccgcacattaggtgatgacagtactaaaactgtatttagtggcaattaactgctatttcccacttgctgtttttattccattttaaactttcttttaaatctcaagtttatttaaaagccgaaatagatatataacaccaagatgattttgagaaaaataatcttctattaatatcatgagaagcatttttcaccattcatttcagttcaagaataaaaatgactgtctccacaaaatcatgctgcttccaattatttg

SEQ ID NO: 136929 - DNA, 462 bp, Homo sapiens
tgcatgctctcccatgcccagtgccctttcacaatgaaaggagccagggccctttctcatgtggaaacaaatggcattttagattaaaaggaccaaactttgtcataacccttttctaaattgcataaactttaaactaaagcagtgcaagtgggcacattaccttgtatgtaaaaccaccatccatacaaccgaaacagagaagaattggatgtgtttgtgccctacaaagattctgtttagtctgtaattttgttccttcctcatctcacacacagctgaaactagtcaggtttcaaagaaggtagcattgtattgtgcatcaacacttgtctttagtggaaaaaattacaatgattgtgtgcaaaatttttgtagttcatattcttttctgaaagattagagtcgttctttattactttatacaaattatgagaacacagtgtcattaaaacacagaca

SEQ ID NO: 136930 - DNA, 231 bp, Homo sapiens
gtgggtgctgtgaggcactggggtctttggtatcctggcatggctggcccatgtggacaccccccacctccaccacagttgtgggtggctgtgtgttaagaggctgcgctctgccctctggcacactgcctccaacctggcgctgtcccctcactgtgtgtggtcaatgctgttgtttccacagtggctgggtgagtcacactggctttcatctgtagtgtggaaaatgcc

SEQ ID NO: 136931 - DNA, 373 bp, Homo sapiens
cttttcttccctaaaactttatttcaaagttattcacctcaccgttaataaggtgtatgattaatgctctgtgccagtattaccaggcctgcccattgccagcaatggtctttgagataacccatttcctagcacccaaaagttaaattactcttttcaaaacataccgacctccccaacacttgcaaaagtattacatgcgccattttgtcaccattctttaaatcagaacttacaatattagtctacatcggtacatgttaaaatgaagtcattttaatgaattatgactgtacaaatccaaatactactagttagtattagaccagagtatcttacaaacatattacatattaccttgcaatctgaaaca

SEQ ID NO: 136932 - DNA, 569 bp, Homo sapiens
cattatgtcattgttctaagactcagttttctcatctataaaatgggtcaattatataacatgtcatgtttaggattgctgagggggtaaatgacattatccacataaactgcctgtgctgtaagtgtttgggaattcttaactataatgttgttatcattattgtgttgttattgttgacaactaaattcagacattactgaattgtctgaacacaaaagccttcaacacagttcttaggaggagagaaaggtaagagcacacagttaaatcaataggaaatttattaaatgcatattataattcaatcttctgctaggtactgggaaaaagaaaatgaacgaaagacaaaaacacaccataggccctaaagaagtttacaacctcactgaggagataaagtagatacatgacacatttcaacagtgtcgagtgcataacaacattcaaggtccttcactggtgccactcttgggagaagagaaagcccttccaggaataacatgctgtggtatttaggtattcaacaggcacgtgtctggtgtcagccagtcttggcctcagatccc

SEQ ID NO: 136933 - DNA, 402 bp, Homo sapiens
aattacgaggtaggtatcatctccattttacagatgagaaatggtgagtcagagaggtcatgtagctgagaaattgcaccagcagaattcaaacttaccacctaacttcagtccggtaccttttctactaagcttatgactaggagtacttgctctatctgtgcatttacttaagtagttttctctatctggtatgttctctctccttctgtccttcccattccctcctgtcagaatccttcaaggaagggcccaaagcttcctctcctcctcccgctctcatccaggttatctccaccttttctgcacacccatggccactcttctggcattgagactctttcatcttattgcatggttattgctttaccgctaaactccaacctttctgagagcaagact

SEQ ID NO: 136934 - DNA, 185 bp, Homo sapiens
attttaaatgtagttgtacaagaattttatgacattttatttttattttgtaggtagtttccttttcttctatctggtaactattcagttagctgagattgaaagagtgctctgcgctagcaaggtcatgaccatatgtgtgatatcatgggcgtgctaggctgactccatctgttctgtggtca

SEQ ID NO: 136935 - DNA, 360 bp, Homo sapiens
gcaaacactcccatccagtctgtcctcacgttttgcccagactcctgcaagaacttccagaatggtcttctctgtgcccctgcccctgtccctcccatgtcctggaccatgctccacactgggccaggttgggctttaacaatatagtttctttttttttttcagatactctcactctgttgcaaggctggcaaaccgtggcacaatcatggctcaccacatcttggacctcccggcctcaaactatccttccaccttgactccctgagcaattgggaccatccgtgtgtaccccaatgcctcgttaatttttgtatttttttttttttttgtagagacagggtttccctatcttgccca

SEQ ID NO: 136936 - DNA, 405 bp, Homo sapiens
ttcatgatgacatgtagcctttaaaaatggctgaatctaaaacatatttatgatgcccattattttatctagtggaaattttcaaaagcaaaaaccaggaaatgatgaaggctattgacacattcagaaaatattctgagcagtttgtgggtctccattgtaaagctacagttgaatcatttttacaagtgggtatgaataattacaattttatattttgtcctgtggtaattaaaaagcaaatagagccaaattatcattaagcgtaactaacagaaaagtaatattgatagatttacatgtttaaaaatataagccaacccatgcattcagtattttatcctcaaacaaggtgttccagctttagttgacactcagataaaaagcaaactagtggctgggcat

SEQ ID NO: 136937 - DNA, 580 bp, Homo sapiens
agcatccctgctctccatgtatccattcaattgtttatttgtatcactataggctcatgcatgttgatttaaaactgttacaattgtataacagtttttcttatagaaaagcatacattcctaacgatctttcataagcaaaatggtgtaacaaaattgtttataacagtatataaagccattttataaaaacagaaacaactcagagagatgccagtgactctagcctggcagtctctgtatcgtacagaagaatgatagttgcccctaaggatgcccttcccaatgatgaagtgtaaacagagaaaaactgctaactttaatcatctgtaatctattatttcttctaagccctatgtgaccttgcttataattttcttgtagttcagtcatacagattttctatgtgttatttagtttatatatgtatatgatttatagatagatatgagcctagcctaaatctgtattctgagaagtatttgttctaaatacttgcaaagtatttgtgatgaggatgacaacacccccgccccctggtccagttgtcttgtggcctgtttaaatccatcctccttat

SEQ ID NO: 136938 - DNA, 507 bp, Homo sapiens
agctatgacatgatcgaagttagctcggtaccggtgtttatcgatgccacgtgtatatcaaaactcagtgaattcatacttaaaatgagtgaaagttattgtaaattatactttaataagttaataaaaaacaagaagtgggttggggagacgttgctcaaagggtacaaactttcagtgaggaggaataagttcaagagatctactgtacaacatggtgaccatagtcaataacaatgtattatattcttgcaaattggccaggtgaggtggctcacacctgtaatctcaacactttgggaggcaggaggaacacttaagcctaggacttcaagaccagcctggttttggaggtggcccagcatttggtgagtttgccaagaaactatgaacgataagactgtggagcgtagagcacaagtcaagccttaaatgctttcaaatacagatattttaagatattctgtcaggcaaaaacaacagtataggcagattttaggcctgaag

SEQ ID NO: 136939 - DNA, 320 bp, Homo sapiens
gttcagggccagggatggcagaccgcagtccccggccagatccactgcctgttcttgtaaatagagtctccctgggctgcagttccgtctgctgttttcatgctacagcggcagagtggggtcgagtgcgtggtgtcgcctgcacagcgggcagtgcctactcttggccctttacagggagtctggagggaggagggagacaggtgagaggagggagggaggacaggtcttgagggagggaggagggagggaggtggcaggagcttttgcgtctgtccccagtgagttgccttgattccatcttgaggcctgtactgtga

SEQ ID NO: 136940 - DNA, 101 bp, Homo sapiens
ctcactcctaccctataatcccaaccaggtaatacttcctatctactcttccagtctcctatacctttagctcaaatttatagcttgaagaaacagaccag

SEQ ID NO: 136941 - DNA, 751 bp, Homo sapiens
aatcagaattcatttgtaaggaagagctatctcttctctgtcatgtattcattcattcacagacatgtggctatttcattctgtgtgctagaatctgatattatcattattttgctatgcaaatggttccagctgtggccattgggagcgctccctggttggttcctaggcccctttgatgtgcttccaccattttttcagcacttctttatttactgaaatgttaagatgctccaggtcctttttatattttatttatcccatgtctggaaatcaaccacttgtctaaggagccctgatttctttttattggcatatgatatttagcaatatctggaattgagaatccaatgactggggtgtcataagttctaggcactcagcagagtgagctaggatatgtatgtatttgtagtaacatgtaaacacacacatttattcatctacgtgtgaatatatatatataaatatatatgtaacttgagtttatattgatacctccaattccaatccaacattaattttggaagggttggtataaatttctacttgttcacatggtgttttgttttttaataagattttatgtttttttcttatataagttctgtacctttatttaaattactcctaaatgtgttatggtttttgtcagtatcacaaatgggatgtcccatttgtcccttcctcccacaccacatttctgtttgttacttctagaacagacagaagtggttacgttcaataaata

SEQ ID NO: 136942 - DNA, 989 bp, Homo sapiens
ttcccgagtagctgggattacaggcacccgccaccatgcgcagttaattttttgtatttttagtagagatggggtttcatcatgttggccaggctggtcttgaactcctgaccttaggtgttccgcctgcctcggcctcccaaagtgctgggattacaggcgtgagccactgcacccggccagggacatgcatggttttctacagagtggcttcagcttccacggttcatccctagacaattttgcctttttttttcaagacacggtcttgctctgttgcccaggctggatgacagtggcactgtcatggctcactgcagccttgacttcccagggtcaagcaatcctcccacctcggcctctggagtgccagcaggacgtgtgccaccacaccctgctaattttttattttatttttttagagatgggatctccctgtgttgcccgggctggtctcaaactcctggtcttaagtggtattcctgccttggcatcccaaagtgttggggttacaggcatgagccaccacttggggcctacttggctcttttttacaggtttttggttgacacttctctgcagaatagcacctggcacctctcaccaccactgaaaaggatggaattttatacacctctttttcctaggttctctctagcagttaccaagggaccatcggaggtacttattgtggctgtttacaaaagccttgcctccagtctgagtcacctcaccctactctctgcttcttccttttagctactctttttttcagtaaccctccctctttcctctgaaggcttgtgcttgcacacacaggcagacatactcatgcacgcgcacaccacacatgcttcctgtcctctggctctcccgtatcctatgtaaaacctcctactgtcatttaagtgaaacccttctagcacataagagttttcatctcagaagctcaattttacctttcacttttcagatagagaacacccaag

SEQ ID NO: 136943 - DNA, 533 bp, Homo sapiens
accaaagactgtaaaagagagccggtaggcacaagtggtggctcatgccggtaaccccaacactctggggatgccaaggcaggaataccacttaagaccaggtttttggttgacacttctctgcagaatagcacctggcacctctcaccaccactgaaaaggatggaattttatacacctctttttcctaggttctctctagcagttaccaagggaccatcggaggtacttattgtggctgtttacaaaagccttgcctccagtctgagtcacctcaccctactctctgcttcttccttttagctactctttttttcagtaaccctccctctttcctctgaaggcttgtgcttgcacacacaggcagacatactcatgcacgcgcacaccacacatgcttcctgtcctctggctctcccgtatcctatgtaaaacctcctactgtcatttaagtgaaacccttctagcacataagagttttcatctcagaagctcaattttacctttcacttttcagatagagaacacccaag

SEQ ID NO: 136944 - DNA, 180 bp, Homo sapiens
atgtcgaccaaaaagaaaggtggtctctatgtacagaaaccacaaaatttatctcccaaggaaacttgtttatgatgttaccacgttaacatgacaatttgatatactctgattcaaccgttttttaaaaacctgactacaatttcaaaaactaatgtttgaaaagaggtattcaaccca

SEQ ID NO: 136945 - DNA, 521 bp, Homo sapiens
tgtctcatcctggagaaagtacatccagatacctactggtctagacagctgttatccaaatttagaaaaacacgaagctacgtagcagtaacatcctctatgatggtcaattccttatttcatctccttagaagctactttctcctcctatgcttttctttataatttttaacagatgtgaattgttggagtttcacatactctgttagtgagttttggaaggactttatttgatgcacctctgttaggaaaatgcaggggatgttcaaaccagaaaatgcaggggacattcaaaccaggctccctaaaactgcttatttagtaagccacaaaagaggttccttcatattaatgagcaatcatattattaagtgtagtgcatctcacattttacttacttgaatatgcttgcttaccaaagtattttaatggcatatctcattttttacaagcttctgcttttctcaatatactatttaaaaggaattagacatatagagttttagtttctccagggacag

SEQ ID NO: 136946 - DNA, 280 bp, Homo sapiens
ccgggtactgcactgacccagaggctaacttacatgctataaacggacttactctgaaaatgctagaactggaaaaaaaaagagtactacctattgagctcttatctaataagcactttatgggcatgatatcaggtaacagtagtaccagttggtactactatgtagcctcactttgcagatgatgaaactgaggttcagggagggtaagtgacttgcccttatcacacattaataaggatggaggcagtgtggctctaaagccagtgttgtgaccact

SEQ ID NO: 136947 - DNA, 334 bp, Homo sapiens
ctgccttagagaatgtgtaataaatgcttgctgaagaaacagactgggtatctttcaagttcttcctttttctccgggcactgtcagtgggcacaagagggacataggtgggacactcctgcctcccctggacgctcttcctgacacagccgctgggcatctccgagcacacagaggccccatgcctacacactcctggggccctgcatcactggctttaggcctgggcctaggagctcttgtctttcttggagggtgtgggtgaagctgagctctggcttcaggaacagataagccatcttaattacagaacgagcatatgggacagcctcag

SEQ ID NO: 136948 - DNA, 281 bp, Homo sapiens
gtgaccgcatctcactgctgacccatcctgagcagatggacatccaaaatgcctaaaacttttttctgtgtgctcttgctattaagttctgtctctcctgccccattctatgctgttgcagttgtgtttttaacccaggtgcagaatcttactttatttatacctgtggaattttgctcgagagggtggggcatgcatgcgagtgtatgctggtgtgtttattcatgctttctgctgcaccaaagccaagtcctaggtccccacgcagcgatcctaaggct

SEQ ID NO: 136949 - DNA, 757 bp, Homo sapiens
gaactgggcattctacgccacttcttgcacctgggggttgaacaattggaggtttttaaattattggctataattagagattatttagtacagtagctctcactttagtacacaccagaatcaccttgagaacttgttaaaatacagatttctggggccctcttacagagattctgattgagcaagtctagggtggggtccacaggcttatatttataacaagttcccacatgagactgatgctgctgggaccccacattgaaaatcactgatttataggtggcaattgagtgaggtcagagttattatttcctatacttacctgataagatttacctggagtgattgttaaatataaattgctgagtcccatcttagatgtaatgaatcaaaatctcttgggaagggacctggggcagctgtacaagatacctcaggtgattctttatcatcagtaatgattaggaaacactgatctaggaaattaggtttttcttgctccaatcttatttcctaataagtcttccatctgcttgcccttgttctcactaagcttaatttggggcaaaaaaaacttggcttttcaaatcatacaaagttccaaattacccacgtctctttccactgggatttcacaaaaccagtgagtaaacaagcaaagttttattttcttctttcactgttttcaagtaggcccatttcaacaatggagatgttatgcttgatcttggcctaagaagcacagatctgagggcca

SEQ ID NO: 136950 - DNA, 311 bp, Homo sapiens
ctgacagataatttagatggaattactaatgtccaggtttaagcagtcactcagatttcaggtaggtatatgaaaagtctttaattaaggtttagggccttaccacaaagaatgatactttaaatgacaactctgacctaattgttgcaaaatctaaagtccttccaacattcaggaactaagatttcatttcactcattctgacaacttcatttaacactgtcatcgtagaaaacaccaaaaaaacacttaacccatcatctcagcatatttataggatcttttcttttcctttttttttttttttttga

SEQ ID NO: 136951 - DNA, 146 bp, Homo sapiens
gaacctcaatgaagatggggaagaattacactgagaagatattatatgcagtgaaaatggttgacagtgcttcagaaatttccagaacaattgggtaagagtggtcagcttcgtatttgtcatttttgttatagataattagttca

SEQ ID NO: 136952 - DNA, 624 bp, Homo sapiens
atcacgcaagcaaatgaatagcagaccctcaataacacttactgatgattattgccatgtataagttgggatactcttgagtacctttctaagtctgcatttagggaaatacagaacacaaaatgaaatgtttgattggttgcttagtttccacagtgacttttcaaaatgtataggagcatggtaacaaaactattttaaatactacaatcttaagtatgcctttattattcttacccacaataatgcattgctttaaaaaattgtttatcagtgtcagaccatacctttctgagtctctactatgtaagatgtgaaagttaatattcttcaattccagctacttttcttttcctgccttctgtcaactcctgtattccatatcattacttcttattgctaaatttataatatttatattctggtttgcatctatagttaattctcttgtgcttcatttctcagtgctaattgaaaaagaaaacacatcacttacaatgccatgattgtaataaataaaattcactgtaacacctagcagtatggttgaacatgtagaaaaggaaaaagtgatcctgtgacactaaaatttagcttgttctaaggatgctactttaagcatta

SEQ ID NO: 136953 - DNA, 449 bp, Homo sapiens
agattacaggtgtgagccactgtgctcagccaattgtccccatttaagaaccactaccctggaaaccagcagtaaccagaccctggtgggtgctgagaaaatgttgaattattcagatagttgattcacattgaattgtatacatcaaatgtaagaattatgaattacatttcaataaaacttttttaaaaaaagtattggtttactattagttattattagtggcattattatgaggtggtttccatttgttttcctcagtggccaccagtgcaactgattttgtcatatactgtactcattgatgccaaatatatatatcttatttaatgctgacttcaaacctgggaagttgatttgtttatctcttcttaactttttggaaatgcagacacaaaaagattcagcaaattgcttaaaatcgaggtaactagcaagcatatatcaag

SEQ ID NO: 136954 - DNA, 515 bp, Homo sapiens
ctctccagtttccctctgcaatacagacagatgctaatagataatttcttcgtgattgagaatattttaccaaaatttaaaaaactaaaataatggtaaggaatgcagtttcaaaagagtaactataatactttatttttgtgtatcaccttacagtttgccaagtaaccttggatatattatcttatttgagtctcacaatcattctgcagagtagacaagcccagcatgagctctttttacattaaggaaatgaagatcagagagattaaatcacttactgatgattcccacagccatggggcaccacgaaactaagcctgccattctgcctctcacctgacagagaaagggaggggacaaaattcctgaagtgtatatatacttttgaaatattttgtgcttttataagctgtcttggttcactaaaactttggaatacaaagccagtggtgatttgcagcaatatactaatccactaacccaccccaccagtccttttcctcctcctcctt

SEQ ID NO: 136955 - DNA, 758 bp, Homo sapiens
taccgttccacattccatatgctgttagataatatgctggctagaccgtcaacagttaccccaggaagggggaatttggattggaaagaaatcaaaggaattggaggtaacataatggactgcagttaaacagtaatagggtggtctggacaactggacgaaggccagtttctaaattgcaggcaatcccctctgcccttttagaacaaggcaaggtccactgaatggagaagaaggcaggccatcagccttcttagggtttaattcagacacgggctctgagctttgtcttttgttctctttaaaggaacaaagccattgaatccagccagaaaaacctgtgcgtatccatcataaacatccacaaactcttctttaatctcccttgttattctccctaagaagtaaggctccaacataagttcttggttgcatctgacaagtgtcagctgatgtccatgaccccttcgtttcctgtgtcccttctacttgatgcaatgactggcataacgtatttgttggaatgaatgaatgaatggcattggtggctgggcacagtggctcatgcctctaatcccagcactttgggagtccgaggtggctagatcagttgaggtgaggagtttgagaccagcctggccaacatggtgaaatgctgtctctactaaaatttcaaaaattagctaggcatggtggctaatgcctgtaatcccagctacttgggaggctgaggtcggaggatcacttgaacccaggag

SEQ ID NO: 136956 - DNA, 150 bp, Homo sapiens
ttcagatgggctaggatcactccacctaacaagctgtctctaagatcaccagtgacctctgtgtataacgttctggtgcctgtctctataagcgttctggtgcctgtcttcattgacctttcagcagcctttgacactgtggaccacacc

SEQ ID NO: 136957 - DNA, 395 bp, Homo sapiens
agggtgggtcaggacaggaacaaattgacccaaaagtaagcctcaatgtcattcctacagcaactccctgtgataatttacagtctgcaatcaaaataaaataatctcttcaaaaatctcgttcttttatggttcattctacaaattgattctcattttcatttcatatttcatcgatttaactttctttcgcttcacccaggtaaagaaatcacatgcctcgaatgatagatgcacctaaactctaaatatgttttggtatttgagttacagcaagtacagggaatatctaagttgcccaagttactttcaatgttgttttaactttgtgaaaatatttaatgacaatttttaaaaactgcgcatgaaaaagaacattctccagtttgaagctc

SEQ ID NO: 136958 - DNA, 982 bp, Homo sapiens
gacataaatatgaatagatttaaaaccttgagaatcttctttggtaccttggaaaagcaatttgcaaatccccatttgggataatgtgttagcctcttctctactagggctcccaagacaattctggtctattcagagaaagggaatttatatgagggaaactggatcttatgacagggaagtaaaggtatggccataggaagctgttctaagaaagtcctaaaacagtggttctcaactctcttgcatactagaatcacttaggagattttttaaaatcttgatacccgggcccaactctagacccatcatcagcatctctcagggtggggccaggcatcagattttctttcttttttctttttttttttttttttttttttttatataaacctcccaaggataattccacgggtggggaacccaaaaagcaagagaaaacctctgaaggggtgagtggtacaccgcttataagaggggggttttacaagaagattatattctgggaggccgtggaaatgggatagggagataatttgtgtaagagagaacaagagaagtgttgaaagagataagtgtgagaaaactcaaaacaacttggtgtgcacagaggagaaaaaaaattctcaacaaggggggaacaaacaaggactcactacaaagagggggagaactacacaagaggagacagacaaccataataaaaagagaggagagaacaaaaggaggggataagagagagagagagagggggggagataataaacaaccccacctaaaaatggggcccccaaaggggtgaacaacaagagaccacaagaggcgcgaagacaaaatagtggagcgacaacaccagggaagaaacccaccacaacacgaccacgcgagggaaaaacaacacaaaaataattataaggggacgaaaagaacgacgccacagaaggataggaggaggaaataacagggggcccccgaaaaaaga

SEQ ID NO: 136959 - DNA, 468 bp, Homo sapiens
ggagttgtcacctggtcagtgattgggtttcagagtctggataggaactgggggctcaggaaggaagtggcaaagatgtggaattttcaggtcatcatcaggcctgaacaagacctgatcaccacccagtctcggtcctcaaacagctgcttgtgaaagttaagttctgtaaccaacttcatgcacaggctatgcctagaattggtgttctactaggtcagtcaggaagtgacaggggatttgagaaatgtttttagagcctttgtgctctgaaatgtaccctcctccctaacccaactagcctagcctggatgcttgaaattccataaagaccaagccctggatttgattggagagttgggggaatgtgttgcagcccctctcccaacccagaaagaaggcatgtaatgtgctaacgccgttaggagtgtttatggcatatgggttatgatattgaatttgtccaat

SEQ ID NO: 136960 - DNA, 261 bp, Homo sapiens
catgattcccataatctggccttcatatagaagtacactaagacaattgatgattctggttaggaatgattcattttggtgtacagggaggcacccagtgagtcaaagacttttttttttaacagctccacccttcatgattattctagcgtgtttcttttttctccatcagtctagtgaaaacaccccgttagccaaatctgaaaaagattctaacctagtcaccaactcctggcaaccacctctttctccttcccaata

SEQ ID NO: 136961 - DNA, 333 bp, Homo sapiens
gtatatacactcaatggagctgaaattaccatctcataaagctataagtactcccatgtttattgtaatgttattcataatagccaagatatggagccaacataagcgattatcaacaagcaatttgataaaaaaaacctctctctatatatagataaatagatggatggatggataaatagatagacataataaaatcctattcagccttgaaaaagaagccaattttgccatttgccacaacatagatgggcctagggggcattatgctaagtaaaataagccagaacagaaagaaatacattgcatgatcttacttatatgtggaatctt

SEQ ID NO: 136962 - DNA, 331 bp, Homo sapiens
ttttaaatcactaattaaatttcttttatggtgacaaaattaaaaagattttcaacttcttttcaagtcagttttggtaagatttgcttagttatttttaaaaagtgctttccctattaaagctatcttttcatagctcactaaattgtctaatatttaattctgtgtagttaccatgtaaatcctatcagaaagtatcaaatacccatttgaagccataatccattaaatgaaacatctacaaacgagacagattacaatcataagaatttgcaccaaagcagcagttgcattaccacagttctatcttcaccttcacaatgtttccctt

SEQ ID NO: 136963 - DNA, 341 bp, Homo sapiens
gaggtcaaagctgcagtgtactgtgattacactgaagcaggatatttccctgacccctttgtgggacttgagacaggggtaccttgtttactcagcctgccactctcaactccttgctggaaggaacgcctgagcaaatgagcatgggaactggggtgagtgagtgctggaaccagctggctgctttggcacgggcaggagtgaactctgtgcaggctctgcagcagcatccaggcgggggtgcctgcaactcccaaagccccctgagggcatgttacagtgcgctttgatgtctgccgtccacggttggcttaaatgttaacagctcagtgggccctttg

SEQ ID NO: 136964 - DNA, 381 bp, Homo sapiens
accagttacttatgcatcgattactgtagctttatattaaacgtggaaatcaggtagggcaaatcctccaaatactttttaaaattattttggctattctagctcctttgcctttctgtataaattttagaataattttgtcaacttttatcttccttccctcaaagaaaataaaactgctgggattttattgggattgcatttgaatctacaaatcattggggataattaacattttaacaatattgaatattccaaactatgaatataatgttatctcctcattgttttatttctttaatgtattgtagtttttggcaaatagatcctgcacacatttttgttaggtttatagttaaatatctcatgtttcttggcgct

SEQ ID NO: 136965 - DNA, 416 bp, Homo sapiens
ccagtggaccactgtgagttaatttcttcctgttcaaaaaaatccaaagatctcagtaaaggatagctttgccaacattttacttgattatataaacttttctacaaatgtctatgcatttgtgtcctcatttattccttcattcaacaaatatttattgagctacctattatgtatgagttcctgtattaatctgagaactcagcaattaacaaaacagagccctcatccacatggaaataacattctaataaggaatgacatacaataaataaataagcagacgcctattacaggatttatggcaacttagagataaagtattatagacccaaaaggacccccctagacaccagcgatggggaggaagaatgaaaagttttttctagtaactaaaaaaaaaaccctcagctaaa

SEQ ID NO: 136966 - DNA, 287 bp, Homo sapiens
agttaattacaacatgatagcatcagatcataggtgctttttatattccccttataggttttgtatttttctagtggttatggattactgttacaattttgtaaaaacaacattatgtgtatctaaaggagaaatggtaatctattgtggtgctgtttttgcttgcatttagaaacagataaaacataggagatttgtggctaaattttagaaaggatccagggtctggtctctgacttctgctctctgcctaaaatgataaactttctatatatcttcacctgaat

SEQ ID NO: 136967 - DNA, 451 bp, Homo sapiens
aactcccacagaggagaaaatacttttctaagaccacatgtcctcttaggagcagacagaacatctgagtcctcaaccagcatgatttctgggaatggcatcttgcatccgtctttgtcatcttacaaattgttctaggaaagcatttggagtcctggttccatttttctatattaaaagataaagggatagctttcagaagaaaaacccaatcttccctaagacagcttctctagaggctacttcatgcccccttgaaataatgagtttctatttctgacccatcgtaatgaaattggctttgctaaatcacctgcgggtggcttgaagtgtccacctctgaggctgcacgaaatccaggtgggggagcactctgcagcatggagctgcctagattttggtggagtctctgggtagatgcaaggggcttttctcaggagctgtagcccct

SEQ ID NO: 136968 - DNA, 349 bp, Homo sapiens
ggaggacagcactcacctgtggcctctaattgttcatattcagtatggtctcatactgggaataatctagtgtttgtcttatgatctttctatagaaacaaatatggaatgtgtctataagtaccattagttgatgacacactagtgactttaattctcttacagtaaaaagttttgcaatagcaaggactttggctaggggagtgactctatgtgtggtgaaactgtcctcacccatttttcatttgaggaaaagagataatcttttgattacacccaacacaggtaacatctgtactttgaacagttaagtatagcagctgatgtttaactgcaggtaggggggaga

SEQ ID NO: 136969 - DNA, 614 bp, Homo sapiens
gaaatgtatgcttacatgtgcaagtcttataggaataatatatgtaaggttccttggctatagttttttccagtatacatttacaatattgtctgtctagtgatattaaatgagccaaatttgaacactctcaagtccaagaatgttgaactgtgggaaacaaaggtgtcataagaagaaaatgactatttgtgtgcttgtctattcaccaaatgaaacttcccacatttcaaaataggaaagatttggttttagttcttggcttctaggggatcaatattcttggcctaacccttcacaaccaaagaaagagccctcataatcggccattcattaaagaaaggcaatgtggcattgctgttattaaccagccttcacacctcttgcctgaatctggttgagcttttaacaaagtaaattttcaagccattttcattcatatgtaccaaaatgtaaatttgcttttaatttcctcatatcttgtgtttgaattgatagaggtatatttttattcttgctcagttttgtcctaaagattaaaaaaatcccagcatataggaaatggaatagtctgtgtgagtgaatagtgaaggaaacataaattgaaagagaat

SEQ ID NO: 136970 - DNA, 427 bp, Homo sapiens
tagcatttaacacactgacattgatctcttggttcttcaaacttgtatatcagcagcagtctcgacttgattttgaagcagagcattaaaaatgttatccttgatggtgatatctcataatttccatctattatgctaggatttttgaatcaagtttccaatctttaagcttcattccaaaaatactattaatcttaaagtttttgataagcttaatgttagaaaatgtcttagttatgaagaaacagtgaagtagataataaaatacaaatctaaaagctaaagtaactaatcggttccagcctgacaaatacttaaagaaaccatttgaataagaatgtccacaacacttattattttgttttgaggacttgggtagtcctcatgtcttcaattactttcccaagattatgggaatatttccaag

SEQ ID NO: 136971 - DNA, 769 bp, Homo sapiens
ggaatccctcacatggagtccctgagtgacccagcacttggagcataggaaatgaaagaacaatgactttgcaataatttaaagtgttacatgagcaatgacaacatacttgcggatatttgagctatttctttagaggaaaaaagaacagtttggagaaacctaactcttgtcatatggtttatttaatgatgatactaatttagagtaggttcccgctaatgaaaagctgtagcaaattatactaacgaatccttgctgtaaaattctttcttgtaattctttacgggaacacagggcagttttcaaatgaagatgtgatggacattcgttcttgagtttttaactgcccccaaaagggaactctgaattactgggacacatcgagggggagggatatcgtttatataataatcaggactgctttcattcagagtacagaaagcccaactcaaattagcatcaagagggacttcattgggtcttctaactgaatagtgtgaggatagatctcaagtatggctggattcagaagtcaacccactttcctctgtgccggcttcatttacaaaagattctctccgcatggaggtgtggtcccccagattgagaaccagcaggaaaggaagtactgctttctcctggtggttcccaggaaattctgcaagtcttatttttcagaattggctcaggaacccatccctggaccactccttggggccagggggatgacgtgctccaaaaaagctttggggcttgcgtggcatgc

SEQ ID NO: 136972 - DNA, 202 bp, Homo sapiens
agtccaaagcaatgggtgagggggaaggagggttgtgtggctcagatgccgggggacaacatgtgctatgggactagacagagaaggattcacaaagtaagtgaatctaaagaaattacctggggttataatgtccagttctggccaggatgcccaaataaataatcatcacaagggtacttgatgaatatctccagagctt

SEQ ID NO: 136973 - DNA, 313 bp, Homo sapiens
cttgatccctggctgctgctgctatctcagtcacctgataatgtctcagtctttctctcattctcttccctcttcccctctctctgcccctctagctgcctggcggtcctcaactcagattctcagacctcacagtgagattttggagctaacccactccattagaaacaaacaaaataaattgtttccattccccaaaggaatgtgctaaagcctttttcctctttaacatggatgcaatttaagtttggcaagagctgaacacaatatacctcactaggaggagaaagatttctgagaccctgatagaaag

SEQ ID NO: 136974 - DNA, 505 bp, Homo sapiens
tagtagagacgaggtttcaccacgttggccaggctggtctcgaactcctgacctcaggtgatccacctgcctcggcctcccaaagtgctgaggcgtgagctaccatgcccggcctctagcatcacttctccttggccctttcttcctcctttgatggcctgaccccaccttcagtcagaccagagccattttttgaaagtctactatatcctcacaggcaaaaaaaggaaaggccccaccctcagaaaaatggtaatttgtaagttgcatctcgcctcttgccgactttccatcacctcaggttctcctctgccccaggggccttcatttctgtatcttctctcctcagtccagtgaaatcaactgacctcagttttggtgcaggccctgaccctgtcaccttgagcagatcactgtgcttctctggacttcagtttcgtcctctctgccagatcctctctggctccttcctgctctccgtggtgcctctgtggctgtgctgact

SEQ ID NO: 136975 - DNA, 199 bp, Homo sapiens
caagatactatttccagagagaaagttgtaactttacagtggagaaattttgctgacaggattgtaaccatgtgattaaagttttatcaccagtaaagggacaagttgacaagtgtctcctgatatagagcactgagaagacaccatcacttttgtgttattcctgccaaaaatctaaaacctgaatctaatcatgaga

SEQ ID NO: 136976 - DNA, 366 bp, Homo sapiens
actgaggttctcaaaattagcggttccctgctatctaatgacttaagtagggtccatgttatagtaaaaggaaataacttttaagtcatgtccatgtaatagagttttgactatatatattttaggaaaatctactacaaatactgacttcaaaagagaaaaaataagggatatttactatacaagtaaaggtatcaggatacatttagaatgggatagaaatttttagttttctctccaatgttgaatatagtctcaaataataagtagtagtacttgggaaaaatgtgttatctttcttgcttgaaaaactggtattttccttttattagctattgagatttatatcatccgtcatgtttccct

SEQ ID NO: 136977 - DNA, 205 bp, Homo sapiens
ctcttggtattcccattatacatatgtttcaaccttgactaactgacccagttcttaggtattttgttcctttttcctctttacttttcagtttgagaattttctgttgctatcacttcatactcagatttttcctggctatgtctagtctactaatgagcccaaaggcattgttcatttctgttataattttttggatttctag

SEQ ID NO: 136978 - DNA, 312 bp, Homo sapiens
gctgatctggaggataattctcctcctcctcacatgcccctcggcccaatcacatgtctgttaaaacctaaagcatctcagcagaaaggaaaaaaaagcaaggggtaaaaaaaacagtacggataggcgcagtggctcacacctgtaatcccagcacttggggaggccaaggtgagtggatcacttgaggtcaggggttcatgagaccagcctggccaacatggtgaaaccccatctctactaaaaatacaaaattagctggtcgtgatggcgcatgcctgtaatctcagctactcaggaggaggaggaatg

SEQ ID NO: 136979 - DNA, 1121 bp, Homo sapiens
gggagggtgggggccacagggcagctgatgcaggagcagggctctggcacagttcagccatcaccaattctgggactgcaaattcagtttcttcatctggaaaattgaactggtaataccaatacctcttttcccggtttactagacagagacaatgcagtgaggcacaaacatgcaactgtttgattttcctcccacccatgctccctgctcagtgacgtgtgattttcctttcccatccataaactgcgcatttggcaaactccaaacttttgagtcacttttgggtaacaaagtcaggtttaagatttccatcgcctgcttaattgaatgctcacctgtcctcttcccccatgctgtgaggaccttcatcactcctcttctgggtccctctctcctctaggtgttggggcagggtggggaggaaagggaccaatgtgtctttcctggtgatgctacagccctctcttgctgaccttgcttcctgggccatcagtgccccctgcacagaactctccaaacatcagtccacacctttgtaaaaacagtctctccgctaagctatcccaaaatgacctgattagagtgtgcaacgtctttcctgctgggactctgactgataccctggtctccctgagtgattttcctgcacaccctgctggggatgtggaagcctgtccccctcccaccccacaccccacacttggctgagatctcacagtggcaaagatgtctttgaatccatggtgcccagggttcagcgtgtagagtgaggtggggtgtgtagagagctggggcaaggaaccctgagaagatgtcttaccccagttgtttccaggtttctttagaaagcgggctattttaccccatgtgtcctcagatttatgtcctggaaccaaattccaaatcagcagccacatgaaaagtcccctcctctctggcgtggaattaaactgttagacctgcctttgtgaccaaagcaattgtaaaatgtgggggaggaaattaaaagcctgccaccttagtccacacagtgtgtgctgtctctgtgtgtgtgcacgtgtgtttatgtgtgtgttgaatgatcacatgttccagggaggatggtgaggggcgagggg

SEQ ID NO: 136980 - DNA, 928 bp, Homo sapiens
cgcccccgggcaaactcctctgctttcactgagtggactcttctcttcagttgctatttggtaaattgcccttcatgtttccctttatgttcggctcctaggaagctcaggccacagggaaaagtcaaggcttgatagaattaatctttgtcttaatgatgactaactgttgagagatcataggtttaagactcgactctggtagaaagatagctatagccaatttccttgtcaaaatgcttctactccaaatttttatgcagtgtctaaggagctcatgcctagatctatctggcaatctatattatccctcctagtctcagttcacatagtagactgctggaatgactgagggtgatgtttggcctgtaaacaaaaagtgttaaagaaggccaggtacagtggctcatgcctataatcccacctacttgggaagctgaggcaggagaactgcttgaacctgggaggcagaggttgcagtgagctgagatcatgccactgcattccagcctgggtgacagagcaagactcagtttcaaaaaaacaggagagagagagagagaaatgtatctatctctctgaaatttgtttataaatatagggttaccatgcaatactggcatatatctagactaaaaaaattacttgtttatctgaaattcaaatttaactggtatcttgtatttttttctggcaaacctgttaataaactcccatggaccccagttacagatcctctcctataaatagtttcttttttgtttttagaattagataattccaaattaaaattaggcaattcttcatctgacctgtgaataaatatgttcatgttataagttgcagaagtagatcagacacaaataaaaaacaaaattagtgaataaatgctgttagcaattgattggaaaaaattgtatcaaccact

SEQ ID NO: 136981 - DNA, 552 bp, Homo sapiens
tgaggaagaaggggacggctggccacaggaggtctggactgagatgtcgtaggaggggacagaagaaaattgtaggtggaagaagagttcaagggatcagagggcagaatgaggatacttgatggagaaagtaaagggatctgggtgtgagacagaaaggaaaagaggaagcaacatcatagtaaagggaggttgagcagagaagacagaggagatggaaaagagaggaaatggaaagtagtggggcgcaagacttgctatagtaactgattaccattttctcttcacttcctttggatcaagtgcaggagaaagcaaaatgtgactaatgatggaataatgtctatagagcgttaatttgttctgtgagtgttaatggatgttaagggaattggtgacttttggaaatgatgtggtcaggaaaatatggttcacctctttactaccatctcctgagaagcaagacttctcagtattttaaatccttcggtttgaatgtttaacagcttctcagccaaggaaatgaacttacattctacctgcctccctgta

SEQ ID NO: 136982 - DNA, 188 bp, Homo sapiens
aaattattggatacaggtaacaatcagaattgttgtcccagacctgtcataaagaggttttaatatggtaggggcacagcaagatgtatgccgaagtcaaagcttaagtccacatatagcagaaaagttgagtctgagattgagtatataagcacctaatcaaaataggctggaagagaataatgagg

SEQ ID NO: 136983 - DNA, 204 bp, Homo sapiens
tctatcacccccttggccctgggtatagtctggatgagcagaggcacgcgtgtggccccaagagtcccaccctctggctctctcctcccaagacattctggagccatgacatgtctcccaggaagggagaattatttttgtctgtggcataaataaagccaggaatgagttccaataatcacaagcacatgccagcatgtggag

SEQ ID NO: 136984 - DNA, 342 bp, Homo sapiens
aggttagcgtttggagagggcaagtgagacagaaacaggattatttgtgttcaggtaagaacatgttatcataggatgttcatgcacacaggacaaatagaaatgtcgataccctattttatttattatattgttttcatatgatataatattgccttgtctaaaggcagtatcttacctgatggtaaaaccagtctagacttgtttagtctttgtgttaaagggacagtaagcttacagatgctttagtcataggccagtacagctcaccagggttgtaggccagaactacacaattctataggattaaacatctatttgagagttgcaggtagtcagtgc

SEQ ID NO: 136985 - DNA, 215 bp, Homo sapiens
gtttcttatagattctgagtattagattttgtcaggtttataggttgtgaatatttttgccattctgccagctttggggttagtttgtttttgtttttctagtttctctaagtgtgatgttaaattgttagtttgagatcattctaacttcttgatgcaggtatttagcactctcaactttcctcttaacagagcttttcctacaacccagacat

SEQ ID NO: 136986 - DNA, 151 bp, Homo sapiens
tgtttttaatgctgtgtaaagttagcaattagagtaagagaaacgtatgggataatgattgagtaaaatctcagctccttttgagtcaattttgtagaaaaagatattctggggtttagtaacagagaatttttctttccttactgcgatt

SEQ ID NO: 136987 - DNA, 381 bp, Homo sapiens
agtagatgcagagatcctgcttaccacatggaatcagggaaaggttatttactgtcgggacatagaagactcactgggtagccactatttacttttcacagacagaacatcaactcaagtccatacactcataaaatgaagtactcttaagtttcttttctcttttttttttttgaaacagggtcttgctctgtcacccaggctggaaggcagtggcacgatctaggcttatagcaacattcgcctcccaggctcaagggacactccacctcagccctggaggagctgggaccacagacatgtaccaccacgtccagctaatttttgtgttcttttttttttctagagatgggatctcgctatgttgcccaggctagtctt

SEQ ID NO: 136988 - DNA, 411 bp, Homo sapiens
tcccactggccacgcaaacccactttaccctctccttcctctgaacttttatagacctttttgacaatatttgacggttctatattgcttatctttttatgtactgatctcctcatctgtattgtgagctctcgtatacagactatgtactcttaagtcttcagagaccagccttgaacctcaaatgttttaatatatcctggaggatatattttaaagacctgcaacaacattagttttgtatttttattacaaattttccattcctgatttatttgtccttctcttcttccttcctcatggataagtaaaacaaagaacatctgtgcataatagtaattacctgtccttcctgtcactacattagatagcataattggtaaagaagggagaggagctacgaaataaaat

SEQ ID NO: 136989 - DNA, 420 bp, Homo sapiens
ttacctggatgtaagcaaatgtcaaaactcactgaactgaatacccgtatattttattgtgtattagttacagttcaatttaaaaagtacataaagaagagtctcctctccttttagcctcaaataatgtgttctgacacagaggggagaaccatcctgagcattttttaaatccccaccatttgtcagatctttgatgcaattccctgtcttaccaccaggatcaagctactatgggtaaaaccactcatttcttactgttttgattttcttcctaccaagcaacaaatacctagaatggagctggggccctaacttaggctgttatcactgcagaggctttaagtaaaggatgtccccgatttccatatccagaggtaaacaggctttgaataaaacatgttagagaaaaatctaaag

SEQ ID NO: 136990 - DNA, 106 bp, Homo sapiens
agcgggaaacatcactctaaagacatcactgggcgcgaacactggagggcaggagtgtgatgaggtacacacagtcccagagtctaaagtgtctctcagaaaccat

SEQ ID NO: 136991 - DNA, 145 bp, Homo sapiens
tcccagcctcagtgacagagcaagaccctgtctctaaaaatacattaattaattaattaaacagaaatgtacattgtttataggggacatatataaaacataaggacacaaaaaggtgaaatttaaaaagatggaaaagcatgat

SEQ ID NO: 136992 - DNA, 410 bp, Homo sapiens
cttgtagaataaggccctcagttattatactgtcttctctgcagtctcttaaaacagttttcagacacaaaaggtttaaaccatcttcaaaaataacaaaagcattattgatcccttcaggtaacaaagtgctgagaataacgaatatacttttaaaaatacctttgagctaccaaaattatcactgtcttaaagccacataatgcaagcctttaccctgaacttaaggtacacaagtctagaaagtagttttgcaactcaatgcatattaaaagctgggggaggagggtgtagctcacagtgcctaaacaccaagacgcccaccaatcagagcaaggagagaacacatgcactgcacaaagcaattaagttctataaaaagcaggccatttaggagtatccaatagcca

SEQ ID NO: 136993 - DNA, 106 bp, Homo sapiens
accataaaggtctacactgtgctggtgtgaacccaaacagaggggagccaaggtgggaagcagggacatatagacgtggtcccctccctcacagagctcagggttt

SEQ ID NO: 136994 - DNA, 402 bp, Homo sapiens
agtccttctgtccatgagccactgaattatatataaagcaagtttactacttccaaggtgcaatgattgtacaggcgttgggtaagcattcccagacaaaaggaaaaaatttgccagaaacaagcacaaaacacagacgggacttacagaccccatgcaagtcaaaaacccagcaggccagtcattgaatcctacaggtcccaaatcatcttttctgaatctgtatcccacatctggagcacaggagtggatggctgggctcccaaggccttgggcagctcagcatctgtggctgtgctgggtctatcccccacaggtgccctcatgggctgggctggtgttgggtgcctgtggcttttccacactgagggtgccagcagttggtgggtccatgaatctggg

SEQ ID NO: 136995 - DNA, 464 bp, Homo sapiens
tctaacttataacaaagagaatctgaaatttaagctggtatttgccatgctctgagtactcagcagcatgccattttgtgaaattattgctgagaaaatgtacccaaatcttgagtacagagtgttcctgcatctgattggaaggggcacatgaattgtttctaaggtattgcagacccaaggctgcacaaattaaggtggagacttgggggagggatccagtcagggaagggaagcttcctagacattacagctctgtccagaggccaaatgggagataaatcaccactggccacctctcttattattgaaatggtacagccctggggtttaactgaaggactgacagggttttgaagtgcaaatagaatggtgaagagtaaacccttttagggtttcattttgatggatttttttttcctgtgtggatttctggtacagactgtgatctggaaggggccctt

SEQ ID NO: 136996 - DNA, 295 bp, Homo sapiens
tatcactccatttctccttaggaaaggagtctctgaaggaagtagaaggataaaaagcaaaagaaatgaacgggaataaaagtgacagtgataaagtaggaacttgatgggataaaaatgaatatagggtcatgaaagagaatgacatttgaaaaggagaagcacaaagttaagagtctttagtatcattttaataataattcataatggttaaacaaagacctgtgtgccaggcactgttctcaaacacctcatgtgtattatttcatttaaatttcatgacagtgtatgaaga

SEQ ID NO: 136997 - DNA, 234 bp, Homo sapiens
cctgactttttctatagcatttaggagtattacaggactcactaataatatcaaaaatgaatatagggtcatgaaagagaatgacatttgaaaaggagaagcacaaagttaagagtctttagtatcattttaataataattcataatggttaaacaaagacctgtgtgccaggcactgttctcaaacacctcatgtgtattatttcatttaaatttcatgacagtgtatgaaga

SEQ ID NO: 136998 - DNA, 186 bp, Homo sapiens
taggagtaaggcacaatgctgaatactagtaaaacacactactcttgttggaaagcaaagcttaaaatgtgcccaagagtaaatgcagtacttagcacatccaaagtctaactatattaatacaaactaaatgtgatttgactagaagccagcaaactccttaagtctggggtcttagcacaattg

SEQ ID NO: 136999 - DNA, 459 bp, Homo sapiens
attcagagggtggtacagagaccccaggtaagaaggcagaaactcagagaagggaggagacagaggagacccagggggacagagattcagaaagagagaaggatagagacccaggaaacacacacccagagggaggaataaagaccaaatatggggacagagacccagagaaaagggaggacagaaagccagcaggagaggagggtgagatgtagcgtgtgtgtatgagagtggacacaggaggggacagagatggggggtaggggggttggacaaaggcccaaaagtgtagacagagatgcagaaggagacacagagaaaaggaagaaacacagagagccccatcgtatgcagatggaggggaggcatgagacagaaaccagagagactgtcagggagatgcagagagagcagctagacgcagaaggtgctgacatgggctgaaaatctgctatgggc

SEQ ID NO: 137000 - DNA, 120 bp, Homo sapiens
cagaagtgtcatatagctattctctccggtattcaattaagaaaaataaccttgactagcacattatatgcatcttattgtagttgattcagtagacatgtattgaatacttaccacaca

SEQ ID NO: 137001 - DNA, 377 bp, Homo sapiens
gtgcttttgtttctatgtgtaaggaagttatagggaaaccacagatcactggtttctaggcatgtaccactagggtggtatgaagggttgattacagagaaacaggacaagggtatttaggagtgacagaagtatgacggtgggtggatacatgatttgtgtccttataagtcaaagtttcttttgttttttctcctgtttttcattcacctggtttttattgagtgctttcattacctagtttttattgagtgctagacatcacaaagaaaagttataaggtttcagtccttggataacattatacaaaatccaataaagatttaagtttgctatggcaagcagtcttgaatcaccataatccaaatttttgaaat

SEQ ID NO: 137002 - DNA, 213 bp, Homo sapiens
ggtatcatgcgattacgtagtttatttggtgtcacctggaggttttttacaacccagtgtcttttatctttagggtttaactttttaccaagtactcacagacagagaaaaaccccaagaacctaaaatttaaaacagaaaacaaggatatgagtgacatacataaataaaagccttgacatacacacaaactgcacaatactgccgttttaa

SEQ ID NO: 137003 - DNA, 249 bp, Homo sapiens
ctttagagttccttggatttggctttttccttcaggaaaggacttcaaagcctagcagatttggtgctagttctgaagatagtaaaatctttgttccagagagcaaatattttctcaataatttcttactgcaatggattacgggtatatactattgttccaattgtgtggatgacaaaataggacaacgttgttgaggaaattctgtgatggatcaagttctgacccctcagccagttctataccagc

SEQ ID NO: 137004 - DNA, 471 bp, Homo sapiens
gtgtagctgttctagaggatccctcataggttcgcagatgggggatggggtgggaggcaggtgagatgagagctccagagttcagcctggggcacggtcattgggttcaagatgccttcagatgttggggcttgacagtgacagtggctgcagatacccaggacccagcagagggcctggcacagcggggcccagggacacgtctgtgagtcaggctggcactcaagtgtgaatctggacaaagaaggtggcattgttggcattgaatgctcaggggctgggtgaagtcagctagggagaggggctctcaaggcaccaggactgactccgtgggtgagggcggaggaggagacggcagaggctgagagaatagccagagacaggaggaaggtcagcagagccatgcacagaagcctggagaagatttgaggaaaggaagggctgggtggtcgtcattccctgcagctagga

SEQ ID NO: 137005 - DNA, 268 bp, Homo sapiens
aacccctacccttccaagagatggccctaattcattaattgtcctgaaattctgttgtagtgagtattacctggggaaaatgtgttatttaatgggatttgaagttgtttgatacagcgttttctttccttctttttttcaaacagagtcttgctctgttgcccaggctggagtgcagtggtgcaatctcggctcactgtaacctccacctcctgggttcaagtgattctcctgcctcagcctacagagtaactgggattacacacgt

SEQ ID NO: 137006 - DNA, 504 bp, Homo sapiens
gggcttgggggtgcttgggttgacggtggcttggggttgggaaggaccatgccacaccatctggggcatcatttcatggggcagaatgaggcatgcttttcttctccccaccctgcccctcaactggtgcccacctagataggataatgcagcagcacgaaacttagggtttctgtgggatctaccactcctttaacattgtggctgatagtgccaggaaaggtctctcaccctgattcccttccttaactgcagggctttgtaaagcaagggaacaaggcacaggtatttgctttctgagttgctagtccctttcttccaagaaggtggtctttgtttagcatgggctcacctctccgtgccaacttctcgatctttgtcctttagccagctcctctcagccttatacttatcccacctctttcagaggcaggtgctaaggttccttgccctctcctacagaccaacaagcatcttcaggtaggcaagccacggtcaacccac

SEQ ID NO: 137007 - DNA, 444 bp, Homo sapiens
ctagatgagtgtacactggggcactatgatgacgctagctcagtgcacactgggacactatgatgaggccgggtgagtgcacactgggacactatgatgaggccaggtgagcgcacactgggacactatgatgaggctaggtgaggggacactagggcactatgttgaggctaggtgagcgcacactgggacactatgatgaggccggttgagtgcacactggggcactatgctgaggctaggtgagtgctcactggggcactatgatgaggccaggtgattgcacactgggacactatgatgaggccgtatgcgtgcacactggaacactatgatgaggctaggtgagcgcacactggaacactatgatgaggctaggtgagcgcacactgggacactatgatgaggctaggtgaacacacactgggacactataatgaggct

SEQ ID NO: 137008 - DNA, 367 bp, Homo sapiens
gccggttgagtgcacactggggcactatgctgaggctaggtgagtgctcactggggcactatgatgaggccaggtgattgcacactgggacactatgatgaggccgtatgcgtgcacactggaacactatgatgaggctaggtgagcgcacactggaacactatgatgaggctaggtgagcgcacactgggacactatgatgaggctaggtgaacacacactgggacactcatcatagtgccctagtgtgcgctcacctagcctcatcatagtgtcccagtgtgcactcgtccggcctcatcatattgtcccagtgtgcgctcaccttgcctcatcttagtgtcccagtgtgcacacattctggcgc

SEQ ID NO: 137009 - DNA, 363 bp, Homo sapiens
ctactagacaaagacttcaatatgagtgtcttacagaggctcaaagaactgaaaggaaaaatagagaaaaacaagaaaatgatgtatggacaaaatggaaatagcaataaagagatagaaaaaataaaaaggaaccaaaagaaattctggagctaaaaagaataattgaaaagaaaaatttactagagggattcgaaagcagaattgaaaggcagaagaaggaatctgagaacttaaagataagacaattaaaacaatatcaagctgaggagcagaaagaataaggagatttaaagggttacagcctattttcctctcttttatttttcccccttttcccttttgggagccagacattcaaaa

SEQ ID NO: 137010 - DNA, 164 bp, Homo sapiens
cgcccactgtatctgtacttgcaaaaaaccattctgagagagggcaagaaaagaaccaggatgttctttctccttcagggccagtgggccccagtgagatgtttaggctgctctagatccttatcagaactctgattattaatttctagtccccttgaaagtta

SEQ ID NO: 137011 - DNA, 498 bp, Homo sapiens
tgtgtgaaaatcccctgcttccatagctaattcccaaatatctgcactaaagtgaagagaaagtagagcgccacaaaattgtttccatttgaattagatatgtagtttggttcttacttttgaatttcaatgtctgtgaaacttttcataatttgaaatgtgcagattcagtccgtgagaggatcattcactgactacccaaaagagttacagtgacacaaccagaccaaaaagcccatattttgccccacatccagataaagtcagttttatttactgttatttatttattctatttaagttatactttatttatccaagtataactttttaagaatagcaaaacttagcagcagccaactgctatctttactattttattttatttttactatttttaaagctttttttaaaaaaagtctacaaaataaatgcttagggcacaatgtcaaacctttgtcagcaattcttaaccattctgatgttggagcggccgca

SEQ ID NO: 137012 - DNA, 399 bp, Homo sapiens
aaatatattttttccacagaatgaggataataagtattgaacttaaaaagtgtgatctagtttatttgttgtggtagacaactcctaaaattcaaagaaatataaaaacacttatcttttccagacaacagccttcaaatgttctcaagcattaaacctgaaagttggaacaaggggtgccgctctggcagacccaacgtgccttacatgacaggggtgcctgacagagatgtgtgtgcgcatgtggctcagtgggaggacagggactctgaaatgacagataatcagattaccgaaacacaacaacttggaaacgatgaggaagaaagcttcactgagaaagcgaaaataaagaagaataatattaagttcaacaaagaggctaggcgtggtggccca

SEQ ID NO: 137013 - DNA, 231 bp, Homo sapiens
ctcacatcaccattcctggtgacttgagcctggagcttcctcatggttcttttaggcatatgggcctccttttctgctgcagccccctctgttcattctaggctcctttttcctctgctctatttataagcatactttgatcaggtttctgttactcagttttttgttgaaatccattaactgccagtgggcccctatttgttgtagatttatactttttaaactttttta

SEQ ID NO: 137014 - DNA, 308 bp, Homo sapiens
ctggtgcatttatatcccggctctggactcggtgcctctctccacctacccctcggcacacccctcccgtcctcttccctccaacgaccttaaaagacatccaccgacataagactcactcttgtcacttgtccaagttgattttgatcagtgtcccgttttgtacccaggagcaaatcccatccaggtcgggctgcgtggtagcgtttaactccttggaatcttgatctggagtccgaaggtccctttgtcctgccgcctgccgcctgcaggatgaagcctctgagacccctaggcagccagctcta

SEQ ID NO: 137015 - DNA, 239 bp, Homo sapiens
ttcctgtgtttatgggcaacttccagaactcattgccctgttttaaaatattgcaatatcttgtttacagacctgttgtctcattctttacccgcagctgagtaaaaattaactacaaatttaaacatactcttttcattaaccctgaaagcctgaattttataggtcttaattatgttgtattgatgacagttgtccaaaaatgagtttttctctccgcttccacatatacttatcag

SEQ ID NO: 137016 - DNA, 541 bp, Homo sapiens
tgctgggattacaggcatgagccaccgcacccggcctcaaacagagaattgtaaaagacaaggagctaataagaatttttcctcttatgcttcccttattatcacctctgcattcttctctcatcccacagtttttcctcagtaattcatcaaatttcaggatatgtatacctgcatatttctgctcctcaggacagtattccagttgaaagacagttttcaggattttgaaaatcttttccttgaaaaattgtcccttaaaccttgagcatacctgctggcttggtggtgacaaggatgttgctatggcaactggaagactgattctacacgtccatcaccagctttcatgtcacccacacttgaatgaaaattttaactcattacagtaagtgaaagtgtacaaaacaatgactgtcaaatccacccactcagctaaaggaaaacttcagggtgtagggggaacactcatttcagaaaggattttgactaatctcttgtttctaatttaaatattctcatttattgtgccatgccagca

SEQ ID NO: 137017 - DNA, 336 bp, Homo sapiens
ccaggagtttgagaccagcctgggcaacacagtgagaccatgtgtctacaaaagataaaaacattaaccaggcatggtggcatgtgcctgtggtcccagctactcaggagtccgaggtgggaggattacttgaacccaggaggttgaggctgcagtgagctgtgactgtaccactgtactctagcctggacaacagagtgaaactctatgtcaaaaacaaaaacaaacaaacaaaaaaagcttctcattcctcccatgtcaagtattcccactggcttctctttaatttatcccctgaatgacataaaaaatttactaccaaatcttgttcctacc

SEQ ID NO: 137018 - DNA, 272 bp, Homo sapiens
agtacagacggggtttcaccatgttggccaggctggtctcgaaccccacctcggcctcccagagtgctgggattataggcatgaaccactgcgcccagccaaaacatgcagatttttaaatgagtttttgacacatgtatgtaatatcccttgggcaacccaatcaatatgtaacattttgtcactccagaaagttccctcatgtcctcttcagtcatttccccaactctcctcccaaaaagcctttacattttaaatttatcataggattt

SEQ ID NO: 137019 - DNA, 534 bp, Homo sapiens
ctctgttctttgcctgtgccagaacccatttcagtggcaccaggctgtcaactggatgggctagacgggtccttttggaattcctcctttccgtcagttagcatttgatactaatgctattagtattatttggatattatttaggctttcaagatacataccctttggatgctggaagatattccaaatagtttttccaaataacattccaaataattattccaattagtattttccagcttccaaagggtattttgaaagacttaaatcaattattcttaacctttttagggtcatggacacttttaagactccgatggaagttatggacactcttcccgctgcctcctaaaagtttgtatacacacaaaactagacggtgtcagaaatttcacaaactgtccccccacctaaattcagactatagtttccaaattaaaaaccctagtactggccaggcgtggtggctcacacctgtaatctcagcattttgggaggtgaggcaggtggatcacttgaagtcaggagttcgag

SEQ ID NO: 137020 - DNA, 508 bp, Homo sapiens
catgccatgttccacagccctgaacccctaaccccagctattcaacccccgactctggcttcggggagctcactctgtctagtggagccaggacacaaaccaggagtgagactagaagggtctcccctccaagaaatgctggggtaggggacacatgagaggctaggcccaacactgccccagtgccttggacagcaccagtcaccccagaccttgtgggcctggccttcagatccccctcggcagcctgcggagccagcaggccctgacctgtccagcaagatacttcaggaacttaaccgaagtccaaagtgcttctacctcccgggcgtagggcaggagtggcagaaaggaataagagcatactacaggggtgaggctcacaccgaggaggtctagcaaaccagactacctttcctgccccttccctcagacaggacccactgggccgcaggcctgcacccaaccaaaagttcatcatagggtggggtcggggaagacattacca

SEQ ID NO: 137021 - DNA, 543 bp, Homo sapiens
ggcttttcctgtccccactctgtggggagcaatccccaagccttactcctaatgcttccccctagttatattaccttcagcaaaccctagaccaggacttccagggacttggattgcgcaagtagctcctccctcatcacatcatacttcttttctccaccttgatttcctcacctgtctaatgaacgacactcactgggtctcggacactgcacaatgctcaagcagaaatctatgggaatacctctcacagccgcatctctagtcagcattattcccaacaagccagcagcctgcaggacattaactgttggctgtaccacctttaactctactcgtcaagtctaagtagtaattaattcactgctgaatcagatcaacctccttttctattcccattaatggcactgtattttggggtgttaccaagttatctattacggcacattttctatcatatgttttccatgtcacagcactgtcaatttgcctcccatcttgctctcacattaacttcttcccttgggttctcatttccacagc

SEQ ID NO: 137022 - DNA, 308 bp, Homo sapiens
gctgggattacaggcgtgagccaccgcgcccggcctgatgtaagctatatcttaataaagctgattttaatagcagataaaccaaagcaaaaaaaaacctgaatcatttaaagaggtaaaaaattggcaaaggtataataggaacatgaatgaacaaatgtatttgggacgtttcaaaattcaaacataatttgatccatgaaactgctgaattccacaaaggagacttttttaaaaaaaatagtacagtacaactagaagttaacaaaagtttataatttacaaactacttgggaatttatcccata

SEQ ID NO: 137023 - DNA, 266 bp, Homo sapiens
acttcgcgtcaaagtaacataatgaattggtgctaaaatctttaagttacaggtgtgttcaaaagaattgttgaatgaaggttaataaatgtggaagaatagccgtcctctctatatctcttggctgataataaagatcaaacaaggataatgtatacaaaagtgcaggttccattaaaaaaaattagtcacactttgtaccttcctgttaatagggacagaaatataggattaaacctagcatcattttgggttactttgacgct

SEQ ID NO: 137024 - DNA, 414 bp, Homo sapiens
cctggaagcttgtcttgaatttcaagcaccctctctcaaattaaattacatgtttatttagtgtgcctgggaggctgaaggagagcaccatggacctgagtcccaccctcagccacttctttgcacctatattcataagagagatgagtgtcaaagtgtcactaactagctttatggccttagggaagtcatttaacttctctgggcctcaattttctcatctgaaaactgagatgactgaactaagtaaactaattccttccaactccaatatcccatgagtgcctgtgaaccataggcttggtaacattcactgagaattgaatgctggctcacctggctgtgttcatcatctctgcctggtttgtgagtaaaataaatattcagtgactcggccagaaactctaaaatgca

SEQ ID NO: 137025 - DNA, 443 bp, Homo sapiens
ttttatgatggtccccagagttttatttaaagattttcaatagagacttaagatttgttgtcaaagccaaaaccataaccagcctcccctgcatcttgcatttggctgccatttcagtttgggtaccaaccattccatacggaaagaccataatggccacgcagagtgagtggagagggttggattgcaatctggacaccttgattccatgttcagctgtctggcccttgcccctgagacctgggtgtgtctctgtgaatccaggaaggagaggcagacaggccctgtggagccttttttgacttggcattgcaaagtccacatggtgaccttcctgtcagcctgttgctgggctgactgtcatgcttatccaaagactcctacccaaaggccactgtactttgcaagacgaccaccggaaacaatattgggacgagaactga

SEQ ID NO: 137026 - DNA, 300 bp, Homo sapiens
agataattccagaggcttctcttactatgtcagcggctgctaggaaaggatgcagagtgctggtgaagaacccttgtcctccataaatgccagttttaaaggacgcatcttattcatctttgtgatcaaccgggatttccattactcatctttccttccaagataactgacatttttgaagggcaccctttttgttaaactttatttccttctactaaagaagtctttttaatcttctggaattaaggagttcatttccacccacaaagttctttttgttaacttcctcagtctgattat

SEQ ID NO: 137027 - DNA, 121 bp, Homo sapiens
ttcttccaggggctttttacaatctgcttgacaggtaagaggtcgatagtacgaattcaaccactattagcaaattaatacaagcaacaacagtttatctagaaataagagtactcaaatg

SEQ ID NO: 137028 - DNA, 536 bp, Homo sapiens
agttcgacggagactctcatcattcacatcatcattgcagctgttttcctagtggctctccatggaggttctccaggctggcagcaacagaagcatctttagatttacaaacaaaatctaaatcctcctttggaaggagggcatgaagtaccatgctgtattaggaatcgggcaacctgtgagccatggagccctggaaaggtttggatctggtagctcagtctcctcacctccaaaagagaatttttttttcttttttttttttttttttttttttttttttggaaaaggtccccttttttaacccaggtgtggtgtgtcgggggcacaattccgggtccctgggaaccccgcgcccccaaatttgaacgagatcctcgtgtttcagctccccaagaagcgggtgtatcacggggcggtgtgccccgccccccggttttttttggttttttgagaagaggggggtgttgcccctgtttgcgccgggcgtgtgtctcgaactccgggcctcgatgtgtccggcccccttgtggctt

SEQ ID NO: 137029 - DNA, 397 bp, Homo sapiens
aagaaatgcaccttacatatagaaagacatatttacgttgagagtgaaatgacagaaaaaagatatactgtgcaaattatgagagagctaaaggggcaacattaatatcaaagttgacaccaagagaagtactattactaggaataaggaaaaaaaactgtaatgataaaaatgtcaattcttcaagaaaacataaaaaaatctaaaatgtctaggcacctaataacagagcttcaaaatatataaaggaaaaacatctgaaaaagaaaaacagaaatccaaaattataattggagacttcaataggcctcctctcagcaatagaacaagtagacataaaattaataaggatataaaaaacatgaacactatcaaccaaaataaccaaattgacatt

SEQ ID NO: 137030 - DNA, 578 bp, Homo sapiens
gaacaggttattttaaaaaagatttattttgaaaggggatgatcagttgatttagtatgaaatggagagctgagctagcagagatatactgataacttctggtcagtacaagatgcctctctccttgagtgatgaccaacctttgctgcttagcctgccccacgacccatctgttaggttctctggattctcactgcaatcaggagcctcatccaggagctttcttttttttttttccccaaggacctttgatgtttgattcttatgctattatagttctcaatattaataattcagagtcaattgtttttaataacctaactataaataattagtgaagagaattaaaggaatggatatactcattgatattttcataatccttatcctgccctgtggcattgtctgttactgataaaacttgatattgttaaaattttatatgatgaaattcaaatcagaggggagcaaaaggattacaactgctttgaaaaataaaatgaagagcacaaaaaggaattactagggcctttctaaaccaaaaagaaaaattaacgaataaaagatttggaaaaaaa

SEQ ID NO: 137031 - DNA, 346 bp, Homo sapiens
tgtgtaaattgcctcaatccccttcctttgtcttgagaggccagagagtttggctaaaggtgggataatcttcaatgactcttctggtactgagtcacctgtgctttttcaggactaactgatagacaagaagaccacaagtaaaattacactagagactggggacaaagaggtatgaaacatgaccggtgatctcaaggaactaacaagctatttactgcttaaaattttttaaagtccaacactgatgaattctctgtccggagaacttcaatgactccatgttggctgtaggtagaatgaatgatcatttcatttattatccaaatcaaaatgttttgatagt

SEQ ID NO: 137032 - DNA, 353 bp, Homo sapiens
ttagggattagtactgttactattcctactttacaggtgaggaaactgagccttagggagggaaataacttgtccacttttgcacagctagctaaatggtggagttgggatttgaacgaagcagtctgattccaaatcctgagttgttagaggtctatcttgatctctgttttctcccttaataacttaagataaagaaaatcaaagtgcccctgggctaaccaggcagggacttagttatctcaaagaacggggaaaaacatgaaaccactatcccttccagagagtaactatttaataaagaaaacattattaatacccccaggggagtaattaaaaagtactcatgaaac

SEQ ID NO: 137033 - DNA, 304 bp, Homo sapiens
cttgaaatgtagtgatactaaagatctaaccatcagcacagtgagaacttcttgttcttgatcatgataatcaaaaccaaccttgccaaggcttcttaaagtaaaaagggctggataaaatgccattgtctgattcttttgttttatagggtaatatgcaaaatcttcagcttttcctaagcagtatataaatgtcctcaaaattctaccctttagcataatggaatattttgatgcttttatagtgttttgttttgtttgttcatttttgttttttgcattcagtactatttacaacttttac

SEQ ID NO: 137034 - DNA, 171 bp, Homo sapiens
gtcagttagagcaagcagaaaaagccctgagcacggaacacaaaaagccgagagaatttccctgcaggccactgcagtcaatttggtgggtggaactgtagcacccagaggcccccaaatcaatcctcttcaggatgcttagctcagcagaatggtcagtggggaagactc

SEQ ID NO: 137035 - DNA, 574 bp, Homo sapiens
caagaagcccttgatggaggtgaagagaccaatctgcagagcagcaacaggttatcaggaaggggagtcttgtcttgagaagggaggttgtttcacaggaccgcagagagcttttctagagatcatcttcaccatgattcccagtggggagattcctaaaaataggcaattaccacatcttgtatgtgataattatattacgataaaacagctcatagtatgacagctactgcctgtgagtaagaaatcgtgttgcctctgagatcacagcttcaagaaggggttgacctgtgtcaaaatcccctgacaggctttatttgtcaagtcagttctcacagcactcagccttgcccccagctctgagacaatggggctctgtgtaggagcagaggccaaaatctggaaggacactggcacgcctcttctacccccacgaggtgtttattattttgcttgcaaacaggctgggtccagtgttttactttcttcccccttcttccctttgctaattttatctcaatttcaaattagtatttttcaagagataatttacttaattcccagcccctcctac

SEQ ID NO: 137036 - DNA, 378 bp, Homo sapiens
cctggctctgaacttaggcctggctctgaacttaggccctggctctgaacttaggcctgcctctgagatcacagcttcaagaaggggttgacctgtgtcaaaatcccctgacaggctttatttgtcaagtcagttctcacagcactcagccttgcccccagctctgagacaatggggctctgtgtaggagcagaggccaaaatctggaaggacactggcacgcctcttctacccccacgaggtgtttattattttgcttgcaaacaggctgggtccagtgttttactttcttcccccttcttccctttgctaattttatctcaatttcaaattagtatttttcaagagataatttacttaattcccagcccctcctac

SEQ ID NO: 137037 - DNA, 827 bp, Homo sapiens
cccacgagactatggactgctagtgagcagcctggatgagcatgtggccactgtgacccaggaccgggccttccctctggtagtggctgaggccgaggggtcaggggagctgcttcgcgcagagctaaccatcgctgagagctgccagaaaaccaaacgcaagagtgtgctcgccacgacccctgtgggcctgcgggtgcactttgggagggacgaggaggaccccacttatgactacccgggccccagccaaccagggcccggcgggggcgaggacgaggcccggggagctggcccgccgggctctgcgctacccgcaccggaggctccaggcccgggcaccgccagccccgtcgtgccacccacagaagacttcctgccgctgcccaccggcttcctgcaggtgccacggggtctgacagacctggagatcggcatgtacgcgctgctgggcgtcttctgcctcgccatcctcgtcttcctcatcaactgcatcgtttttgtgctgcgctaccggcacaagcgcatcccgcccgagggccagaccagcatggaccactctcaccactgggtgttcctgggcaacgggcagccgctgcgggtgcaaggagagctgtcgccgccagcaggcaacccgctggaaaccgtgcccgccttctgccacggcgaccaccacagcagcggcagctcgcagaccagcgtccagagccaggtgcacggcaggggcgacggctcctcgggcggctcagcccgagaccaagccgaggaccccgccagctcgcccacctccaagcgcaagcgggtcaagttcaccaccttcaccacgc

SEQ ID NO: 137038 - DNA, 212 bp, Homo sapiens
gaaatgagatgaggcagaaaataagaagccattcccaatcctcagatggaatgaagatattcttggcagagatgagcaaggaaccaggacaggggtcaagggggtgggtttccaatgcacagagatctgggttcaattctgcagccctgcctttatgaggtatgtgcccttggacaacttccttaacttctccgagcctgtttccttggctg

SEQ ID NO: 137039 - DNA, 1071 bp, Homo sapiens
ataatttgtattctgatgtatcattgggtggcatgctttatatatatatgttagggccagttcatttgtagtgtcattcaagtcttctctttccttgctgatcttctgtctaatttttctatctgcgattgaaaggtgggatattgagctccccaactattattgtggtttttgttttgttttattttgtctgagacagagtctcactctgttgcccaggctagaataccatggcacaatcatggctcactgcaccctcaactgcctgagctcaagtgatcctcccacctcacttttctgagcatctgggattactggtgtgccttaccataaccagctaattttttatatttttgtagagatgggtttttgccatgttgcccaggctggtctcgaactcctggtctcaagagatccacctgcctcagcttcccaaagtgcagggattacaggcatgagatactgtgcctggcctattattgttgaattgtctatttctcccttcaaatctgtcagtttttgcttcatatgctttggaacactgttgtttggcttgtttataattgttatatcttgatgaatcgactgtttcatgagtatataatgtcctcctttttccttgtctcttgtaacggtttttaacttaaactctatattgtatgatactcatataggcactccagctttcttttggttattgtttgcatggaatatttttctatccttttactttcagctgatttgtgtctttattttatttttttagagacagggtctcactcagtcgtccaggctggagtgcattgctgcaatcgtagctcactgtaaccttgaactcctgggctgatgggatcctcccaactcagtctcccaagtagctaggactacaggagagcaccatcatgcctgactaatttttaaagtactatttgtgtcttttaatctacagtgagtctcttgtagacagcatacagtggatattttaaaaaaaaaagtttgttctcacaatttctgccttttaattagagagtttaactcatttacctttaatgtcattatttctaatttgat

SEQ ID NO: 137040 - DNA, 684 bp, Homo sapiens
gtcgtggcttgttgagatgagcttcttcactgcaccctcagcttcccaaagtgcagggattacaggcatgagatactgtgcctggcctattattgttgaattgtctatttctcccttcaaatctgtcagtttttgcttcatatgctttggaacactgttgtttggcttgtttataattgttatatcttgatgaatcgactgtttcatgagtatataatgtcctcctttttccttgtctcttgtaacggtttttaacttaaactctatattgtatgatactcatataggcactccagctttcttttggttattgtttgcatggaatatttttctatccttttactttcagctgatttgtgtctttattttatttttttagagacagggtctcactcagtcgtccaggctggagtgcattgctgcaatcgtagctcactgtaaccttgaactcctgggctgatgggatcctcccaactcagtctcccaagtagctaggactacaggagagcaccatcatgcctgactaatttttaaagtactatttgtgtcttttaatctacagtgagtctcttgtagacagcatacagtggatattttaaaaaaaaaagtttgttctcacaatttctgccttttaattagagagtttaactcatttacctttaatgtcattatttctaatttgat

SEQ ID NO: 137041 - DNA, 321 bp, Homo sapiens
atttcctatgcatttttaaataaatgagaaagttttataaactaaaaatcttagtgtatattaaacattaatatttgtgtcattaagtatttttaatagatacatattttgttagattgatacaccatggtttattaaaccactctcccactgctgaatattcagattgtttcctctgtatagatactctagtgaatatgcataaatctgtgatttcatatctgattatctccttcaaattggttcctgttagtgcaactactgtgtcaaagaattggacatttttaagaccccagaaaggtaatagataagactgaaagt

SEQ ID NO: 137042 - DNA, 401 bp, Homo sapiens
atttaccataccaacaggcaatgttgggccataaatgcaactttcaaacgtggtccaggtgcctttcatgaatgaggcatcgtccctctgaggatttctctgcatcctgaactgcagggtgctggcatttagggctgacaggtggtgctgttgctgcttcacctaaggagccccacagccctgggaggcacagatgaagaagcccactctctggaggaaattcgaagactctgagagtttaagtagcttggctaaggctgcagaggaggaccctgggacagatctggagcacaggtctgaaatgatgagccctggggaggggacaatcaccgagcgtgtcactgctctcccccaacaccctcctctcaggaaggagtcggcaaacctcacatggcctctcc

SEQ ID NO: 137043 - DNA, 368 bp, Homo sapiens
agacttggagcttctcgactgaggggagatcgggtccctttggggaagaaagaagccttcaatgttgtcacaagtgtatcctggaaatcttcctctaagccttcctagagggacctgataacatgacttatgatacagtgaccccaaattcagggtgttcttgtctactgtcaagaatgcaatatcttattcctctgaattgaacgtagtaccaatatttgtgtgtagctatgcaccttaatagaccatagctaattagatgaggaacggtagacccaattcaaccatacaggcatcaaccatatcagcatacaggcatccctctcccaccgtttccttcttgtccccactccaaagccttctccatt

SEQ ID NO: 137044 - DNA, 176 bp, Homo sapiens
ctccagtaacactttattagctatttattacatatttgaataccctcaatgtttatgggtcagaaagtaaacgaaccaacaacatagtctctagtaaaactgcaaggtgtaactactttctccaaccaagacagtaattcttgttttagtgaatggcccagattaacaacaagctg

SEQ ID NO: 137045 - DNA, 144 bp, Homo sapiens
acagcacagaggaggtggacagtacagatgaggaagttgaggctcaccaagatggggctccccgagtcacttggtggcctctcctcgtcaccagcctcatccaccccccggctttccagggaggctcttcctgggagccacctc

SEQ ID NO: 137046 - DNA, 335 bp, Homo sapiens
atttacctaatcgcctagcgaagaatgtatgaatgggttccaatttcttactattacaaacaagctacaatgaagaatatccttttgcatatgtgagtatatctgtacctaaattcgaacaaatggaactgctcggtcaaatggtatgtgcatttataactttgacagacaaaccggctattttcttctttttcttttttaacttaccgtacttgtaagtaatacttgttatgaaaaattatttattgttaatgcccctagatgtcactatacctcaccaaataaatattatcaaaaaattatgaatcaagtagcccttcgcgattagggttagt

SEQ ID NO: 137047 - DNA, 445 bp, Homo sapiens
gtgatataggctcgtctaagataaaaatgccctagcccacttcttaccacaaggcacacctacaccccttatccccatactagttattatcgaaaccatcagcctactcattcaaccaatagcccttgtcgtcgaaggggcatttccatcatcacagaaaattctattggatagtgctgataaccctcattttacaaatgaggaaactggcatggaaaactcagcaacttgctcaaggctaaggtgagagagctgggattcaaatccagttagtttggcaccagaaatgttgcccttaagccctatgttgcacatcccaatggaaggtgaaatagttggctcttaaaggaagaggaatttgatgtgactactgaggcaagcactggtggtgcctattcagcagccaagcttttctcccttgctagcaaagtctggatttcacaca

SEQ ID NO: 137048 - DNA, 311 bp, Homo sapiens
tggaggtggaatagaccctcaggaacaggctgccaagagagaaagggccaggaggtgggaccgtgtatctgtggcagttcagagagcgatgggcagttgtgggcagctggatgaccagtgccatccagcagggcagtaactggcttgtcactgagattgacccatcctttcttggtccagccacccttgtgagatcatgttggggagaggggagtgctgaggaagtgggtggagaagaaggttggtttccacatagtctgtgggtgtctgagcagagcatgtgacaggtgatccctgcagctctggggaga

SEQ ID NO: 137049 - DNA, 440 bp, Homo sapiens
tgccggatgttctctagaaggcaaatttacccctggttgaggaccactggtttattacatgtatttctcattactttgggccctggcttatagttgataaaatttttagagactcctccactggtaatatagaatcagtgaaagtgataatacttaccataacagtgaagtgatattcttgttttaatatcttcagattttttttttttttgagacagggtctcactctgttacccaggctggagtgcagtggcactaacatggctcactgcagcctcagctgccgctgctcaagtgatcttcccacctcggcctcctgaggagttgggactacaggctcaagccacatgcccagctaatttttgtattttttgtagaaatggggtctcattatgttgcccaggctggtctggaactcctgggctcaagcaatccaccca

SEQ ID NO: 137050 - DNA, 398 bp, Homo sapiens
gtcttatttctttgccttgcctttatctcagcctggcttcccctccaggcagctctgagtggctcttggtccaggcttgtctccatctctccttcctcttcccaactccctaaactcaggacccagtcactcctgctccttacatacacacacactcacactaacacacgcacgcactcactctcttctcccccacacacagtcacacacactcccaccctaccttaggaaacaggtttccttccaagaacctttattaagacctgtggggaatgaccaggatctgggcccccagtgtgtctgtgagccagcttgcgtgtgtgcaaaggtgtgagtgtgtgagcatccatgtggctgtggaaattagaaagcatgtgtgtacacacgcgagtgtgaca

SEQ ID NO: 137051 - DNA, 290 bp, Homo sapiens
attcaggaagaacttggcacctaattgtcaattctgctttgagaagattagagaattatgtaacacactgctcattggaattttatcagagaaggaatagagcatccctctggcaattttccccctaaactttatggactttattttctttgcacagaaattggttgaaagcactgccatcccaagtcatttaagtaatgattacctacttagtgtgttgggcagcctcctgttccatctctgaggtttatgtgacacacacgccccccaacccccagccaaagaaaaaa

SEQ ID NO: 137052 - DNA, 165 bp, Homo sapiens
ggtgacaagtcccatggtgcagaggcccactgccctttctgcctcggtcttctgtgtcttgctttgccttgtaagatagcgtggtcatattcccgtttgactgtgcgtacttttctaaaagagtttggttgtagtacagagttgccccctgagagccgggcttcc

SEQ ID NO: 137053 - DNA, 225 bp, Homo sapiens
ctatgtttaccccagctataaaatggaggtgttggattggctgccacaagtgtccttccacctccacaataccgtgactggagcgggttttcactcctttttcttgttagcataactgttggagctatagagggtttggagtggggctgtttttctcccttcctctaaaacatcaacaattttgagaattttgaaggtcttcttgcttgaagttgcttaaggagt

SEQ ID NO: 137054 - DNA, 279 bp, Homo sapiens
aagaggcagtgcctgactcaaccctaaaggaccaagaggaattagctaagcagaggcgacagggagtggcagaatctttgtattctagatggaggaagcagcacacgcacagcatgaaggcataagagaacaggcctacttgacagatgaaaagatggttgtcgcattcaccaagatagacaattcaagaaaagaaacaggttagagagtgaggagtaaagggaagacttcgggcctggcacggtggctcacatctgtaatcccggctgaggcgggtgg

SEQ ID NO: 137055 - DNA, 532 bp, Homo sapiens
ttatcagcaaggtcttcatgacctgtatcttgtgcgacctcctatctcatcctgggactaagaatgcctaacctcctgggaatgcagcccggcaggtctcagcctcactttacccagcccccattcaagatggagctgctctggttcacatgtctctgacaagttgacctgggttgagtgttccatagcgtgtggttgttggagcttttcttaggagtaagaagtattgttagtaggaaacaggcctctattggccctggggctggcactctgccccagtatgtcagtctcattttagtggtgaccaaactggggctcagagaaatcaactccctcaccccgaacccccagactgtgagtggtgggctggggtttgaatgtggggcttgaagacccaccgtttcctctggtcccccatgctctgctgcccgagaggaacaggatcccaggatccaggcccctgatggcaccagccagggtgggtggaaatggggaggcacagtcccaaagcccccaggactctgaggcaggt

SEQ ID NO: 137056 - DNA, 174 bp, Homo sapiens
cgctgacattacagatgtgaactttagcgcctggcctatgtatttttgtatgtgttcttcctgcatagtctgtttcctctaagctgctttttttgttgttgtttttttgctttcgctttaactcctgtgtaacatgttacatgtttttcttggatttttggtgatcctctgcgg

SEQ ID NO: 137057 - DNA, 449 bp, Homo sapiens
agcaggccattcatttccttatgtaacttatagggccccagtgggataatgaagaatcatatagtcttcaaacagaacttggtactacccgattcttcaccagtttatccaagactgatccaggagagagtgtgtcaatacacaagatccaacaacacagggaaaatctattaaacctgaactgatgagtaatttggacctttcggtagctgctatttcctgccccttgttcacctgggaaactatgtatcgctgtgagataaggataacctgtggtatttggggtgggggtgccgtgggaggggtaggcaaaggcaattaagtctcatcaacttccagcaggaataaacactgaggaatgggtttaaacttcttgctctcggatgtttgcatgtcacaaacacacacctttttgtactagagtcctagtgttaggtaaaagtccacct

SEQ ID NO: 137058 - DNA, 628 bp, Homo sapiens
agtggctgtgtggctggggtggtggccctgctgaaggggatctgacctggcagccgtttgggcaggagcagttttcagatgtgagcacacgttcaaacttgcagcagcaaagctgctcaaggtcccaggaagcccaggcttctctctcgtttttgtggctgccttggtaacgtgtgggtgtaagagcgtgtgtatgtgcaggagagagacggagagaaagaaagacctgtgcattccagaacacccttcttccttgaacatccgattacccagagcctaattttaaaaccgaagtcgatgccttcttaagtctgcgatggcccagctggcctccttaagtctgtgatggcccagttctgttcttgctccaagtctacgaagccagcttcccctgctggggcttgaaagggacccctggccaggagcaagcagggcagcaagcaaagctgttgggggcactgtggggactcccccaggtggccaggcttctgtgtgcccgtgccacccctcctcaggaccttgtttccagttccggttgggcaggggctggcactggagagaggcttatgtgtcaacaccataaagcagccagcaagccctaatgaccacgctctgcaagaccacacag

SEQ ID NO: 137059 - DNA, 456 bp, Homo sapiens
taaaacatgtttctagaatgtgaacagttttgaaacatctgtattccaatcaccaatccagaatcttgggagctaaagaaagtgtgggttttcccccaaaacaaacactcagcggaggacacaggagaatgaccaaggtgtaaatgaaagaagaatctggcctggggcatcctatggcgagcgccatcccctttaggggtaagagggacatctaagaccaagcggagctgagtcaggcctcctgggtgggatgatacagtatgaaagagaggtccaggaaagggtctcattcaggctgacatgtcccatcatgatcagtcaagtttaggacggagactaataagactcaacatatgcggccggtcgcagtggctcacgcctgtaatcccagcactttgggaggccgagacgggcggatcacgaggtcagaggttgagaccagcctggccaagagac

SEQ ID NO: 137060 - DNA, 236 bp, Homo sapiens
cactaatgttattcattagaactctggaagtagttggcttccaactcagagcaaaaaaatggaatcttgaataatggaataatgggaagatgtagctgtggccattgacaaaatatgacacatctaggaagcactgtgcccattttacagagttactagatttttctcttccttgagtggctgttgaaagctcctcttgtgcgatgttggcgttcaaaattgaactcctttttttc

SEQ ID NO: 137061 - DNA, 450 bp, Homo sapiens
ttgctccaactagaatataaattccaacagattgggaacaatgtcattcttacattcttatatggcatagtttgcgttagaacagtgtttggaagacagtaagcattcagcaattatgttaactcagtgaatggaattctcaggaattcacaggaagctccctgtgtcctaagcaagaccacctcttaatctcctcaattcttaatttccatccagaattattccacccagagcccagaagagtgtaatgactttaattcctccccaggaaagcagtatagctgactacttctttcagcactgccttgcataaccattatttctgtactaagatttgttttgcctcccttttcccaattttctttttcttacctcatattaacatctttgacaaaattctcttattcaattcacataacaacctgggcaagtattattacatcttttttt

SEQ ID NO: 137062 - DNA, 407 bp, Homo sapiens
gctgggcctttttcaatacctttaaaatgggcttattcatttctatgtcatgtaagagtcatgaagtttggatgaggttagagtttatgactctagccagggacacagtaaatactcagggaacagtcgttgcttctggatctatccagcttctttagaggcctgatgtctctatcaggatgtgccttgtgattgcccaggcactcatgcctgtttagattgaggtcccaaccctcctgacttcattggctctgcccagtggtgcactcccttgacctcctctattcttgccgtcacttccaggcacctgtgtctggcttttctcttcagtgaataattcaaatcctatcatcctctgactattcctcctcttctcctccaacctctgtctcttctacttggtacag

SEQ ID NO: 137063 - DNA, 248 bp, Homo sapiens
gaactcaaaatctggatgtgtaagctactttgagtatagctacccaaaatctggatgtaaaagcacttttattcagatgttcatatttcagcttattggatgaaacatgaattctttgctttatgcaccatagcaagtaatgaagttaacacccaaataattgcaattttgctttgttatttgtggtttaaagatttagaagagtgttttatttatgaatttgcttttagatagaagtaacttgttag

SEQ ID NO: 137064 - DNA, 195 bp, Homo sapiens
acgagccggcccgggttcgagtagcatattcagaagcctaccatcttttcctaatgcaagctgaaaaaaagtagagatctatatgtaccctataaacatgtatgaatattacatatcagtgaatgtagagatctacaaaattgtggctagcataaatagcatatcctcaactttaactaaagtagaaacacacac

SEQ ID NO: 137065 - DNA, 196 bp, Homo sapiens
tgtacgagtaaggtgtgtgtttctactttagttaaagttgaggatatgctattcatgctagccacaattttgtagagatctatatgtaccctataaacatgtatgaatattacatatcagtgaatgtagagatctacaaaattgtggctagcataaatagcatatcctcaactttaactaaagtagaaacacacac

SEQ ID NO: 137066 - DNA, 105 bp, Homo sapiens
gagagtcttcggtggaagaaaatgaaaaacagcaaaatgcctctgaaagcaaactggaattgagaaataattcaaatacttgtaatatagagaatgagcttgaag

SEQ ID NO: 137067 - DNA, 271 bp, Homo sapiens
gtgattccaccttcctctgaatgtctgtagcctgaactgcctgtaccacatatttatctttgggttgtgatcttttcagttgtctgcatcttaacccacttacaaatctttgcaagttaaagactataggtttataggttaagcctttatagcttaaagattctataggcaaagtctgtggttctatgtcattgatctctaaactccagtttttaaaaatattcataaatttgtaaaaatctataagattttataaagaaattttagccct

SEQ ID NO: 137068 - DNA, 117 bp, Homo sapiens
agatagccatcttccatcttaaagctgcgccatctgaatttatttttatttattttattttatttcatttattttttatttatttatttttttgagatggagtctccctgtgtcgcc

SEQ ID NO: 137069 - DNA, 112 bp, Homo sapiens
gcatgaggtaagaggtctggagaaaaattaagtaatccatgcagtaattaaaatatagcgttttttaaactagttctacctaataaaaagtgatccaaatctatggtgatac

SEQ ID NO: 137070 - DNA, 409 bp, Homo sapiens
taagacaatcataaacaaaaataaaaacttgaagaatttatttgtaccatgtatgtcacaaggataatatctttataagtttttaacaggtaataagaaataagctaactctccattagaaaactgggcaagagtgctcagaagataagcaaatgaaataagcatataaaaaatgtttaatttccctagtagtgataagcaaaatgttttacctgtcactttggcagacttttgtttaaaaagaaaacccatgacggagagagtgctgctaaatgcctgcttttaatgtattacaagtaaataatgtattacaagtaaatgtatgggagtgtaaattggcacagccttcctgaaaaagcacatcttttgacccactaaatcctcttcaaagaatttatcctaaggatgt

SEQ ID NO: 137071 - DNA, 800 bp, Homo sapiens
aagagcctggacaaaccaccatgtatgttgtaaggaggttggcagaggaacaagagtaggacctgggggcccaggttgaccctgagatggtgcctcttgtctggtcctctaattgtttcctcctctgccacctgctcatcactgaccccagtagagggttcttggcagaaagcattaaacgggctgacccagggcttcctggacagtgatagccgcatcctgttgtcttataggacagagtgtgtgactggagtgggacattcttctttgtaaggatgcagggaactcaactacatttttcacttgactagccaagagtgattgtaaaacaaaactagtacactactcatactcctctctggaagactctgctgagctcccagagaaaataaaaccccagggaagggccatggcagtgtggggccacctttccccgtatggttccgggtcagggatctggatgcacaggggctgggttggctgggatggggagcttccaatgtgtccctttgaaaatctgattctgcaaagcagggcggcctcatccgtcactactctgacgggaacctctccccatctccacacctctcactgcttcctccaccccctgcctgcacacatcaggatcacgctcgcacatgctcaaacgcacactcacccatcctggtttctccccagatgtaacctgaggatttcctttttggacaccagagtgtccttgctcatcctctccatttcattcctctttatataccccttgtgattattttccttctttttcctttatgctgacacttgta

SEQ ID NO: 137072 - DNA, 527 bp, Homo sapiens
gatggtgttctagaggatccctcaaaccgtatcagaacagagtatgtgatcaacttgacgtttccaatagctccagtgagatgaaaactgaggtctgaccaccggatttaacaacatggaaatcactggtgacttttacagtgcaattttgggggagtggtgggaacaaaaaccagattagaatcagttcaagagagaattgggtatggaatgttacctaagtaaattcttgcccagaatgtttaacctgaatcaaatcttaaagaaataattaggccgggcgcagtggctcacacctgtaatcccagcactttgggaggccgaggcgggcggatcgtgaggtcaagagatcgagaccctcctggccaacatggtgaaaccttgtctctactaaaaatacaaaaattagctgggcgtggtggcacgggcctgtagtcccagctactcaggaggctgaggcaggagaattgcttgaacccgggagggttctgatacggttttgagggatcctctagatcaccacacaa

SEQ ID NO: 137073 - DNA, 509 bp, Homo sapiens
  misc_feature (493)..(493): n is a, c, g, or t
gatggtgttctagaggatccctcaaaccgtatcagaacagagtatgtgatcaacttgacgtttccaatagctccagtgagatgaaaactgaggtctgaccaccggatttaacaacatggaaatcactggtgacttttacagtgcaattttgggggagtggtgggaacaaaaaccagattagaatcagttcaagagagaattgggtatggaatgttacctaagtaaattcttgcccagaatgtttaacctgaatcaaatcttaaagaaataattaggccgggcgcagtggctcacacctgtaatcccagcactttgggaggccgaggcgggcggatcgtgaggtcaagagatcgagaccctcctggccaacatggtgaaaccttgtctctactaaaaatacaaaaattagctgggcgtggtggcacgggcctgtagtcccagctactcaggaggctgaggcaggagaattgcttgaacccgggaggtctatacngtttaaggaccgctat

SEQ ID NO: 137074 - DNA, 527 bp, Homo sapiens
cgtatcagaacagagtatgtgatcaacttgacgtttccaatagctccagtgagatgaaaactgaggtctgaccaccggatttaacaacatggaaatcactggtgacttttacagtgcaattttgggggagtggtgggaacaaaaaccagattagaatcagttcaagagagaattgggtatggaatgttacctaagtaaattcttgcccagaatgtttaacctgaatcaaatcttaaagaaataattaggccgggcgcagtggctcacacctgtaatcccagcactttgggaggccgaggcgggcggatcgtgaggtcaagagatcgagaccctcctggccaacatggtgaaaccttgtctctactaaaaatacaaaaattagctgggcgtggtggcacgggcctgtagtcccagctactcaggaggctgaggcaggagaattgcttgaacccgggaggtggaggttacagtgggccaagatcacgccactgcactccagcctgggtgacagagcaagaccccatctc

SEQ ID NO: 137075 - DNA, 486 bp, Homo sapiens
ctgaaaaacctgtctttctgttaggctttctgttattttgagctatggtccaccaatgcgaagcaaattatttttaaagctcttattttaaatattcatcttcttcaagtaggtcacttttttatgagcctcagcttctcttatatctcccctaatagaaagatgtaatgcattcaaaatgtgaaatcaaattccagttaattttattgatttctttcagagactccttgcttcttatgcaaattcatgtttatttcaaaaagagaaaacaaaacaggcttcttagagaagatgacttcaaaaatccacaaagagccaccacaattttattcaattataaatgagctatacaatatttaaatcactggctggaaataagacgggttttaattcatttcagagctcagcaatcgtctttagataacctcatctttaaaagtgaatgaatgactgacagcaggataaaataagtaccttgtcacatgc

SEQ ID NO: 137076 - DNA, 291 bp, Homo sapiens
agctgggattacaggcatgtgccaacatgccagctaatttttgtatttttagtagagatggggtttcaccatgttggccaggttggtctcgaactcctgacctcgtgatccacccacctcggtctcccaaagtactgggattacaggcatgagccaccgtgcctggccacctagaggacactttttatatgtgctaacatacagtctctgtttgaaccctcctaacaatcaaaggagctcaatatgattatccctattgtataaatgcagagactgaggttctgagaagtt

SEQ ID NO: 137077 - DNA, 119 bp, Homo sapiens
gatatattctcagaattgcatcactaggcgattttgtcatgtgaacaccatactgtaatgcacgaacctagatggtacagcccactgcacacctaggctgtatagtagagcctactgct

SEQ ID NO: 137078 - DNA, 281 bp, Homo sapiens
ggcatagaaaggtactcaaagcaaccagtaattgagagaattatttaggtgtttgtatacattcaacaatgtatacaatggggaggtgattaaaaaactgtgactttacctttagtctacatccatggcctttcattaattaatacatttttaaaatttcaacttctattttatattcacggggtacatgtcaatgttcttttacctggttgtattgcatggtgcttagatttggagtacgaatgatcctgtcacccaggtactgagcatagcacccaaca

SEQ ID NO: 137079 - DNA, 185 bp, Homo sapiens
ttattcgttggtattctgtaaagcagaggtttcacttttccccactcacctccaccattttaaagtttatttttgttagtgtcagtatgaattaacaaattttttttttttagagacagggtctcaatctatcatccaggctagattgcaatggcacaatcatagtttactataacctcaaactc

SEQ ID NO: 137080 - DNA, 611 bp, Homo sapiens
taaaagtacatttaaagaatgtaataaacccaattggaatgtcatcaaaatagataaaacttgtaaaaatggacaacgaaatgttataggatataatggtaaggggttcaggctagaactctggtatctaaattctagcactcacctctttttccactggagtcttatcaaggaaattatatacaaataatagtagccaaaggggaaacctagcatcattttattaataaccgaacaagaaccactaatgtggtgctgctccctggtgaactaagtggggaaaatgcagtttggccttgaagcctcagtgaaactttctgcttttctacctctgactcaaggacagacccaatctgacctctcctacccagttgtaggttcagagaaactggagcggaggatggtcaggcccattctgaggaggccaatttgcctgtccatgtaggagcaggataagccagagccagagagccatgggacatgtctgactgtagagtggtcaggcccatgcacctgtctcgggcttcagccaatcacttcagcaattcttcccccaccggaggagctagtgagtggtggggacagaagagcagaactcccacgctcagtat

SEQ ID NO: 137081 - DNA, 465 bp, Homo sapiens
tctaaggagaaagaatttgacactgcattacccatgctacctagtttctatttgaagtggaaaatgtatttggactcttgatatcactttcacagaatttggagtggggaaaggtaaaactggaggaaggctttatgtgcattctttcattctgtcatctatcctcttcaattatcaaaactattttagttgcctcagtctcagcaataaagtgagagaaaaaaataatttttagagcagcttcatacataattatagctcatttattgccaacagtcttaatatgaccattacaaaaaatgtcttcataaaactaccgcaagatcacattcataagaatttaaatatatgaatgactgatctactcaaaaaaacacagaatagtacaggtgtataccaaatggaatttggcagatagccttattttccagtagtcattttcttagagtttgtgatagagaaaca

SEQ ID NO: 137082 - DNA, 589 bp, Homo sapiens
ctttttctaatcactgtttcctgctaaaaaaaataactgtttggcaaactttctgtaactctctatcttttcctggtttatgtctgttgtcccaggcattctgattacatatcccaatcacaatccttttatatgttagtatctaatgtgatgtggaagaatttgtatggtttacttgaaaattgcctattgtttattaaattccgacagcaagactcttctgcataaatgtttttgggtcttaagatcagatttcaagctggtagtacttcatttccccttaagggaaaggatgtgtaagatatttataaattcaagcatgcttaaggaatttatttaaatggctgctaattctactgcattagaagcatgccattgatatgtactgaattaaatttaaggatatatcatctcaaagtatattctagtaatctttaattagttaaaagtatcttttaatattgttaagtaaaactcattaattgtagaaatgcttagagatgagtttaggctacctaccgatttttaaattaaaacttaattttttaatcactataaataaattagtaaaccttttaaaatataaagt

SEQ ID NO: 137083 - DNA, 541 bp, Homo sapiens
tcgactactactataaatttgccggccgcgtcgacaccacacttgtcttctctacctggaagttgtattccccatacccacatggctcacttcttcacttcattcaagtctctgctcagatattaacctcttcagagagcccttccttcacacactgtcttgcatagcagcctcccctacaagttgtcttctttctccttaacttttgtgatggttaattttaggtgtcagcttgactggattaaagaatacctagagaactggaaaggcattatttgttagtgtgtctgtgagggtatttccagaagagattgatatatgactgaatggactaagagggaaccatccgccctcaatgtgcaggtggcttgaaacaaaaacggaagaaaggcaaattggtcttactctcttggagctggaatacacgcttccattcctgcccttagaaccccagcggtgacggaaaggctgatgtaggtcctggagtcctgagacccaacagcctgggatcctgaaatccaaggtcgacgcggccgcgaat

SEQ ID NO: 137084 - DNA, 973 bp, Homo sapiens
tcgactactactataaatttgccggccgcgtcgacaccacacttgtcttctctacctggaagttgtattccccatacccacatggctcacttcttcacttcattcaagtctctgctcagatattaacctcttcagagagcccttccttcacacactgtcttgcatagcagcctcccctacaagttgtcttctttctccttaacttttgtgatggttaattttaggtgtcagcttgactggattaaagaatacctagagaactggaaaggcattatttgttagtgtgtctgtgagggtatttccagaagagattgatatatgactgaatggactaagagggaaccatccgccctcaatgtgcaggtggcttgaaacaaaaacggaagaaaggcaaattggtcttactctcttggagctggaatacacgcttccattcctgcccttggatttcaggatcccaggctgttgggtctcaggactccaggacctacatcagcctttccgtcaccgctggggttctaaggcctttgggctaagaattatatcatcagctttcctgattctgaggctttgggacttggactgagccatgctaccagtatccctgggtctccagcttgcagacaatctgctgtgggacttctcagcctctgtaatcatgtgagccctttctaactcataaaccctcttttatatatctatgtatccgattggctgtgtctctttggcgaaccctgactacgtatacttttgtttgaattcaaagtatttatccctacctgatattacatcctatatctgtttgttttctgtttcttccattagaatacaagtttcatgaggacagggactttatccatttgtttactgctgtatcttaggctcaaagttggcactcaataaatattggttaaataagtgaattacaagcaggttggattattaggtaatatggttcgcagtgtgggactcc

SEQ ID NO: 137085 - DNA, 319 bp, Homo sapiens
ccacccttctctgtcacatggcttctttgctgaccctgatacacaccacacttgtcttctctacctggaagttgtattccccatacccacatggctcacttcttcacttcattcaagtctctgctcagatattaacctcttcagagagcccttccttcacacactgtcttgcatagcagcctcccctacaagttgtcttctttctccttaacttttgtgatggttaattttaggtgtcagcttgactggattaaagaatacctagagaactggaaaggcattatttgttagtgtgtctgtgagggtatttccagaagag

SEQ ID NO: 137086 - DNA, 293 bp, Homo sapiens
gaactgcagggctttggccatagcttatgaaaaaggagtaaattggagaaaacataggtgttctcacttctcatacgctgcaaattattcagtctctttgggtgaaaaatgttatgctaattgaaaggctggcttgtattcggtaccaaatcatggcaaatccatcaacttgtctcaaatgtgttcttttttctcctttcccccttccctctatctctcttccggttctttttggtctaaactgcttaaccagtttttattgagcctccattgtgtgccaagcacagttcttt

SEQ ID NO: 137087 - DNA, 2100 bp, Homo sapiens
ccctctacgccccgaggggaatcccagggaaggttcccagaaatactacagtgaggagatcgcgggttggaagtcccagcacctgagaacacggtgctggcgctgggctcaagatttggctttcccatctggaaaaggggaatgactgccccgccactcagggctgcggcgctcacccagcgggaagccgcacggcggtccccgcaggtcccgattcaaggtgagccccagacctgctgcgtgcggccggcagactccgccgcgggctcggcgaggggagcggtgcaggcgccgagctgcggagcccgggctcagggcaggaccgcgagccctccccacctgaggcccagcgagcggccgctgtccgcgcagtgtcgcagtggaccccgagccccgtgctgaactccttaggcgtcttaggaacatactcagttcgcacgcagctatgggaggaatttggcagatgtggacaccggcctcagtgtcctagccctcgggaatctcggggtgttaatgatgacagccccgtgtgagagactctaacagttatcctgggggtgaggggctggggcgctgggcctgggcgtgcatgtgtgaggaaagagaaatctgcgcgggtgtggaagatggagaagcctgtctttctgcaggactcagaactttcttaggaagtttggagggagtgggagctgacgggtaggggaggaggaaaatggctcaggcccctgacaccggaatccagactatagagtttaagaaactaaatgcctccaaatcctgccctcacagcccgcctggcctgggctggttttctcagcattccagacataaagactcctctagtgcaactcaaaatcaaaacccagacgacaggaagccgaattccccactgagaccctcccgtttcctctctgacgctctttttttttttttttttcatttttctctctccttttttttagttatttatctagcacagttttagctgagcacttctagtgcaaaactagaatatcgttttgcacccaagtaactcacaccaccttctttatttttctcatctacaagtaatcagaggagacgtaaacaatgacacatgaagcactgaggatctgagatgtgttaagcttgctttgagtgttagttaaatggagggatgggtgagtgggtggatgaaggcatcaatgaattcacacaaaaaggagaaaaaattgatttcagcccaacagatgttccgttaccatagtgcaaaggaaagaatgataggtactctgtattttaactgatgtgatcaaataatgtgaataattaaggccacaagtagaattttgggggtctgaaatatcccgagtaaccctctacacaagctaaatgactgctatgttatcactatcaaatatgccctctgatttgtgctgtgtagagcaaataccacgtctggtctactgaattggcaagcctcctggctcaggcaccactggactccaatgttcatctggaatccttctggatactgactgttgggccccttgtagtttctggaatttacccgcttctaggagccacctctctcctctgcacacaggagctcatctgcactaaaggattagaagcaaatagaatctaccctacgatccaagctcaaaggatctggcctgcttgctggtgtcttcccctggcctccgctgggtggtgtttgcctgcccaggtcactgagaccagcagatccttctaggctttgctgaacctggctggtaataactatctgacccttcaattcttccatacactgaactcgttgctccagtgaatccctttcccagcccaccttgttttgtctctgcctttctgtctctcccactttctcaccctttcatgtaattcagcaactattttaaaacaaatagctttatatgaacaaaaggactagatcatgaactacactggttatttggaagtctaggttctttctggtcctgctacccctttaacttgagttatttacaagtctgtttaaaagtttctagacatacactggtttgttttttgtttggctatcgttttgtttttcatttctaattgtattgcattgtggtgaga

SEQ ID NO: 137088 - DNA, 234 bp, Homo sapiens
cgctgccatcagttaaattcacagccagtgtttcccaacccaggtcccataaatgttcttctcaatcctgccgtgggatgggtgaccttccttctctttcatggccttttgttttccttggggcttacagttgatgttttttacccatccaccaccctcatgggcttactcttccccacatcagggcttctattggggtctcatttttttccctggataaagattcaccccaag

SEQ ID NO: 137089 - DNA, 521 bp, Homo sapiens
ccattctctaaatatcatcaagcccatagcgtccctccctacagagaccgtgtctgcttagtagatgagacatttgtggttgttcattgactcctttttttctagaaagttctagtcctctagagactcattgtaatacctttgtccctctgaattcttggtatttaactatacctcctcctgttatatgcacccagggtaatatgcctctggcacatggtaggcacttaatgaatttatgtggaataattcagcaacttacttttatagatacatacagactatccctcttctatgaactcattctttctcagtgtatcaaactaccaatctgctgagctcattcacaacattttggtgcttcttaatgttctcagagaataactttcactctagtgctggcttcttccatccactggtaggggtttggatcagataaaagggagaacatcccaggctgggtgcataatgtttggaaagggttaaggaaggccaagtgaatagttcttgactgaaactaa

SEQ ID NO: 137090 - DNA, 410 bp, Homo sapiens
tgtgaccataggtcactgcagcctcaaactcctggcctcaagcaagcctcccgctcaggcctcccaaagcgctgggatgacaggcatgagccaccacatccagccctcactttctaattatttattatgattttgtcggttgactggggccagccaattcttctgctggtgacagttccttcagcccctctgacctctggcctaacatggaagtggggataatccatgtacccagaattctcccagaattgatgagataagactccaggtcatggaatagttaacgaggaggagtttctctttagaagtaatccagctaataaatgaagacaggatgatagaattagaatattaccatttctgggccaggcacagtggctcacgtcagtaatcctagcactttgggaggc

SEQ ID NO: 137091 - DNA, 451 bp, Homo sapiens
  misc_feature (171)..(171): n is a, c, g, or t
ccacctcagcctcccgagtagctgggattacaggcatgcgtcaccacgccaggcttattttgtatttttagtagagacagggtttctccatgttggtcagactggtctcaaacttctgaactcaggtgatctgcctgcctcggcctcccaaagtgctgggattacaggcangagctaccgcatctggcctcattttccaattttttattgtgttaaaatccacataacagaatttgccatcttaaccataacataaaatttaccattttaacagaattaaccctcttaacagttcagtggtattaaatacatttatgatgtcatgcagccatcaccaccaatccttctccataattattttcattttgtaaaactgagaaattttgtactcataaaacaataattccccattctcctctccccctttcccccagccctggcaagtaccatt

SEQ ID NO: 137092 - DNA, 475 bp, Homo sapiens
ttttccacagggtggccatccactacacagggcagatgtttgccattgttttctttatcacaacagtgttagaaggaggtacttgcccagacatgggttaaaatcttgactctttcatttattatttttattatattaagtttcagatgatgaataaagagtgaggaatgtagattgataaagaatagcaaaagtgggtatggtgggcagaataatagtccctgaagatgtccacaccctattcttcagaacctgtgaatatgttagcttacgtggcaaaagcaactttgcacgtgagattaaagcgaggaccttaagatgaggaaatgtgttaccctaggttatacaagtgggctcaatctattatcatgggttcttaaaatcagagaacctttcctgttggagttcccagccagagagagatgtgactgtggaagaatggccagacagttgcaacattactggttttgaagtt

SEQ ID NO: 137093 - DNA, 318 bp, Homo sapiens
gtggggctgtgcacccggcatgtcagcctgttctttaatggctcacgagctaagaatgatttcatatctttttaaaggtgaaaaaaaaagaacatgcccacaaagtctgaaataacaaccctcgctcttcatcccagtctgtgggcctggggaggctggcagcatgggccatgctggcggggcccctgggtacaggggaagggcctgggcggagggacagactgtcaccacctggggatcccacaccaccttttagatagaatatatacagcgccctctctctaccaagttaggggagggagaagtgttaccaattag

SEQ ID NO: 137094 - DNA, 380 bp, Homo sapiens
ttctacatggggagctgcttggagcttgggggggtttcttaagaaaagatataacaagaccttctaagagtctattatgatagtgtggtggggagagggtagatattgatagcttgggctaaggtaatgttggagaggtgtggatggaagatgttttcactcctttgcttcgttgtcagggaatcagtgtgtctgtgagtatgtgtgggaaaggagtgacagccttgtaaatttaaggatctatattctttagatggattctaggtctacagttgtgtgaaggctgcaagtgctattgtaagccttctttgggggcttatttggcctccctaatgaggtgagagatagatctacttgaaagtaagatcagcctcccctgc

SEQ ID NO: 137095 - DNA, 229 bp, Homo sapiens
acacaaaagaggaaaaaaaaaaaagaaagaacaggaaatttgataaaataccaagtttgagctttctcccccaagctaagtgggtgatattattttcagctccttttaacattttttttttggtctttaaaaatcatgcattatattttataagaatagtgaaactttttcgagtcacccttctggcctttcactagaaaaaggcattcatgtacacataatactgggc

SEQ ID NO: 137096 - DNA, 839 bp, Homo sapiens
gggctcaagcaatcctcccacctcagcctcctgagttgggatcacaagtgtgagacaccacacctggctaattgtgacatttggacaagccaacataactataatcagatctcttgtcaatacataaaatgaattatgcagtaccaaggctgttgtaaaaactgctacaaaggtggcactgaaattttatgctaatagaaagttacagtatagttatgaagatcatgcagaaataggtgtatgctaatttctaaaattatcattggaataaagacacagaggtatcttatagagaaaagtcacagatccccaagaatatatatatatttaggcttggcatgagaaaaactgatgttatgtcatagaaatgaaatggtttaaagttttaaaacaaaatgaaatgcttgaatgaacaggcattcatttaatgctgctttagtctcttttttttgagacagggtctcgttctgttacccagggtggaatgcagtggtgcaatcatggctcactgcaaccttgacttcctgggctctagtgatcctcccatctcagcttcccaagtaactgggaccacaggcacataacactatgcccggctagtttttgcatttttggttagagatgggatttcaccatgttgcccaggctggtctcaaactcctgagctcaagtaatccacatgccttggcctcccaaagtgttggggttacaggtgtgagccacttttttgagaccaagtctcattctgtcgcccaggctggagtgcaatggcgcgatcttggctcactgcaacctctgcctcctgggttcaagcaattatcctgcctcggcctcttgag

SEQ ID NO: 137097 - DNA, 846 bp, Homo sapiens
attggtcttgccagccccagcctctgcctgcttcatgtccactcccagcagaagccacgcagaaagtggggaatccaaagggcctccttccctccatgctggccgcacgtcagcccagagccatctggcaggtgtcctttctgccccacccccgtgcctcaaactaagtatactgggctggtttagaccaaactgcctgctgattttttgaacgaagcaggtgtctatgtgctgcctcatttgctgttgcaacaaagatctgaagaattgctttaataaaaaactccaggccgggcacagtggcttacgcctctaatctcagcactttgggaggccaaggcaggtggatcacctgaggttgggagttcgagaccagcctgaccaacatggagaaaccctgtctctactaaagtaatacaaaattagccgggcatggtggcgcatgcctgtaatcccggctactcagaaggctgaggcaggagaatcgcttgaacccgggaggcagagtttgtggtgagccgagatcgtgccattgtactccagcctgggcaataagagcgaaactccgcctcaaaagaaagaaaagaaaactccagcttgtgtccaggacgtccaaggcattggagaccctgtgcgtccagggtgtcacaccctcagattgtttccatgtatatacactatcgtctcctgcattttcagggtgccatatcctcagattgtaccctcatactaatctctgtgtctggaagttttagctacagtgctacaaaatccagcctgggcgacagagtgagactctgtctcaaaacaaacaaacgaaaacacacacacacatttattatctca

SEQ ID NO: 137098 - DNA, 404 bp, Homo sapiens
acggccatccctgaggaaatggtcaattcccatgcagtgtttggggagggcagctcccaggagtgcaccctgcatgggggtcagggctggctgcgccaggcatggggggaactcagcctggatggagaactctccgctgtcagaagcacctccagctccccagcaagagggcacttccgtgcagtcaggcagaacagcctgggcactgttcacgaaagcctaggagagaaggctgggccatccctgtgcgacgttaagcatttgtgcaggacacaaggacatattccatttgaaccacaggaacaaacgggaaaacaaatttgacatttatctttgatcagacacatgtagaaagggctaagcctcatcctacacacgccctggacgtgtggggctaacgcctt

SEQ ID NO: 137099 - DNA, 318 bp, Homo sapiens
acacgaataataggaaactaataaacaatgaaaccgaagagggcgtgataggatttccatatgaatatgagaccatctgctcacatgtatattctgcattaacaagtgtagtcccatagcttacacagattctcaactttcacgcgtgtagttcttttattttaattaaaaacaacatcagacacacaggcaagagggagtattcaaccacgaaagaaaagttcattcaggcacagcagttcaacagatctgagcaagcagaagaaaggatcagctaacttgaagacaaccgaaattatccagtctgaggaccagaaa

SEQ ID NO: 137100 - DNA, 456 bp, Homo sapiens
aaaagattagtgtttccacaggggttaggagtcagcagagagaaaggaatgtggctataaagggatagcacctgggggccctgtggtgttgatacaattatgtactttgattgtggtgctgattacaaaaagctacacatgtaataaaattacatagaactacacacacacacacacacacacacacacacgagtacacacaagcaggagaaatctgaataagctctatagattgtaccagtgttcattttctagtattgacactgtaatatatatatatttgcaagatgttaacagtatgagagattgagtgaagtgtacacagggcctgcctatatatttcttttcagcatgtacctaactatatattgttataagaaatgacttcaaatacaaaggacatcaaatgatacaaataggttggaaataaaaggatggccaagaatatgccatgtg

SEQ ID NO: 137101 - DNA, 349 bp, Homo sapiens
gttcctgaatcagtgggatatgtaatccagtgaaatatgtgtcagtgggatatgcatatgaagggatttgcatattcagtgccctctgcctggggtgccctccccagactcctccatctgacatcctcaccattcagatctcaacactcatcacctctgccaggcagcccactttaagttgcctgactaggtcacttctcctctttatgagcttcaaagaagccatcaggccaggcacggtggctcacacatgtgatcccagcactttgggaggctgaggtctcaggatcaccagaggccaagagtttgagaccagcctgggcaacacagcaagacccccatctttact

SEQ ID NO: 137102 - DNA, 433 bp, Homo sapiens
gtagaattggttgaagtcacagcacaatagaattaagtggggcttaatgatcctctaccaaccagaggcgggtaaagggtaaccctgagagagacaagaagatgaaaccagaccagaaggtatcctgcagagggaggcaaggccagaaagtgtttttaatgtaggggaaagggagtgtttgagatttaagtgagtaatgagaaggggctgaatgtttaatttccctaattctattgttaatactttggaccatgttcttatgagtggatgagacagaataaaaaaggattgcataaacacataggtaaggaaaagaaattaaggacctttattatgttaaaaaaagtagataactcctgaaaaattaagagttgattgtagttcaaaatcaaataacatgcttagagtaatgtaaattaaccatgagctgcca

SEQ ID NO: 137103 - DNA, 405 bp, Homo sapiens
cctgagacagtgtgcaaaggagggaaggtctttctaaaggctctggacctcataggagattggacaaaactcatgccccagccccacctcttactagttatgtgaacttgggcaagtgacttaacttctctaagcctcagtttcttcatctatacaatggggatgactatcgcagtggggtgataagaggatgaaatgagtaaatatttcgaaagtacttgaaactatggcaccctgatagaatttatgcaagcgtgtgttaaatacataggtaaggtctgtcccaggtatccacccctactatacctacttctcagatgagaaaattgagttacagtgtggtgaaacttaacagtgaagacagttagtagtgaaactaggatttgaacctagacagtctggctc

SEQ ID NO: 137104 - DNA, 1137 bp, Homo sapiens
accaccagtgtatgaaagtcccagttccttaacttcactgacaattggtatgtcagggtttggtttcatttttattttgttgttaggatttcaaagggttatagcgggatttcattttggttttaatttacacttccctaatggccattgagcatctccactgctcgtttgctatccatttgcctattttcttttgtgaactatgttcaaatcttttgtccatttttttaaaacctggattgtttcttattgatttttgagagttctttatatgttctggatagatatctttgtcagttatgtgttttgcaaatattgtataccattatgtggcttgtgtttttattccattaacagtatttttcacacaagaaattttttttaatgaagttccttttttgtctttgatggattgtgcttttggtttcaaatataagaactctgcctaatccaaggtcacaaagattttctcccacttttttatcacaaattttatgttttcaggctttatatttaggtctatgatatatttgagttagtatttatataagatgtgaatctttatataagggaggtccactatttgcatatgagaatccaattctttcagtattgccatggcacctttgtgaatccattaaccatacatgtatgggtctttttctggcctcagtgcagtttcattgatttatgtgtctatcattttgccaaatattgcacatcttgacttttgtatctgtatataatgtcttgaaaccagatactgtgagtcttccaactcattattttattttggctatcaaatttgtcttgccataatttccagaatcagctttgtcatctgtaaaaataatttgctgggatttttattgagattgcaatgaatatatagatgagtttggggacaactgacattttagcaatactgagaatgttctaaaccatacacacagtatctgcctatttaggactcccttattacatcagtaatttgtagttttaacatatagattctgcacacactttattagatttatacctacatattccttttttagggttctaaattagtactgtttttcaaatttcaatttccaattgttctttttcaatatagttgattgttttatgttgacc

SEQ ID NO: 137105 - DNA, 347 bp, Homo sapiens
acacttgttacacacagggggcctgtggagctaagtagtgggcctaagcatctgtggtgtgttgtcaccatgcagccagtgaatggccacctttgtcctcggagagcttacagtttcactgagtcctgggggacccaggtctttgttaccttttccctttaactgaaggagagctagcaatcactaagcactgagccttatggttagaggacatcaaggatcctggcctcttgcagagcaagagatattgcctagttaaaggccacagacccctgggcctctgggccaccaatgaatgctcttggtccacagtggatccagtaagaatggcccaactctggcctgtc

SEQ ID NO: 137106 - DNA, 468 bp, Homo sapiens
gtatttaccacaaggctgcagttttcacgatgcatcagaattacctggagggctttttataacccagattcctgggtctctccctcagagtttctaactcaataggtctgggaatggggccaaagaatctgtatttctaataaatttctgggtgatactgatgttgctgatccagagaccacattgtgaggactgttgctatgaaggactgcatgggaataataaataccaaatactggatagtcgcttccctggtggggagagggagatgtggttagaaaaggtcacagaagagacttcaagatattggtaatgtcctatttattaaactgggtggtgggaacatggctgtttggcacaggtggtcttttaaaaatcattctttaaaatgtatgtatgcatagagtcacatttttataaatataatctattctataattttaaaatttactaaaaccaaaccaaaaa

SEQ ID NO: 137107 - DNA, 241 bp, Homo sapiens
gtggttcagctgttggtggtcatgagccatgattactgctgtgtgcccatgtggctgtgaagatggggctaggacccaggacagctctcagaggagggagcagagttggaggagagcttcttgggcccccggaggtgaggaggtacaggggaaagcttagacaacacccccaacacacacatagtgggggccaggcccttcctgtgcgtcttgaaccgcccgccaccctgccacacacaca

SEQ ID NO: 137108 - DNA, 394 bp, Homo sapiens
taatattgaaaactatcttcagtcaattgttttgtacaatgtttgtgcctttactgagctagtgttaaaatgcccctttgtacacacacgtacataaataatacaaagatatacatacatattgtttgtatataatggtattagagtattcttttttaaatttttatgggtagatagtagatgtatatatttatagggtacatgagatattttaatacccacgtacaatgagtaatatcaggatgaatggggtaaccatttatcctttctttgtgttacaaacaatccaattatgctcttttagttatttcaaaatgtacaataaattattgttagctgtaatcaccctgttgtgctattatcaaatactagatcttcttgattctatccaact

SEQ ID NO: 137109 - DNA, 355 bp, Homo sapiens
ggattatgatcgggtccctccccactctatctaatgttagcatgctgtagagaatttgggttttccaacctgcaagtctccaaattatttgactctcacccatcttggttgcagatcacagccaaaaaaaggcctctcttaacaaagccgtattttttccctctgtgcctctagtcagttttgagcctacatttatctctttcctgtggatcttactaaaagacacaagaaatagccaacacactgcaccattctaaatgcttttccagtgaatccattaatggtgtaccatgagtaggctcctgtctcagaccgaggagtcaataggtggcagcataactagctattttgttgt

SEQ ID NO: 137110 - DNA, 360 bp, Homo sapiens
cgatcagctcggacccgcgagaccccgactgacatggtcacactttgcagtgtttcatctgtttgttgccttttttattatctgtctcctccaccagccaataagttcctggagttccaagactatgttttttcttgtctgttgtacttttggcacctagcaaactggcactttctagaaaccaagtaaggccggtcgcagtggctaatgcctgtaatcccagcactttgggaggccgaggtgggcggatcacaaggtcaggagatggagaccatcctggctaccacggtgaaaccctgtctctactaaaaatacaaaaaatcagctgggtgtggtggcgggtgcctgtagtcccagcta

SEQ ID NO: 137111 - DNA, 243 bp, Homo sapiens
gttgttttcctctccaggactccaagtacatgtatgttggacctgcttgccatgtcccattatgtcccatacatgcccctctactaccacctgtattttccattcattttttcctctcattctttcagtgtggatattttctattgacctatctctgaattcactaatctttttatcagctgtgtctagtttgctattaaacccatctatttagttcttagttttaattattgtatttttcag

SEQ ID NO: 137112 - DNA, 284 bp, Homo sapiens
cttattatatagaccagactccatctgccatatattttttcacaaagcccccccagctcttcatttcatactgcatctgacttcttaatagacctaatgcagtagtagctctaataacaaacatcttaacatcaactttcaattaaaagcttcaccgaagtttatattcatttctctatacctttttcattgtttttgaaatggagttcctacttgttatactcctcttgggattatttaagaatcttggccaggcacagtggttcatacctataatctcagca

SEQ ID NO: 137113 - DNA, 143 bp, Homo sapiens
gtgacacaggcaagtggacaccaagaagaaggaccttccccttctgcctcccagcctgggcccccagtcttcctcagcatcccccagccttggccactaaacactgaccccaggaaggatgagggtctagtcccaagctgcag

SEQ ID NO: 137114 - DNA, 398 bp, Homo sapiens
caacaatcatgcaagggacgcgggctgcagtgaggatttccccccagtcactgccaagagacgcatccaaatgacagacaacgttaggcttttcctgggtcgggcgccatccctgtacaggcaaagggcccaacagcatcttcaacctgagcctgaagaccccagccccgacctggagatgagggggaggaagcgccgtcccagaggagcaagggtggaggccccctggtctctgggaggcgtggagagctggggccggtgcaggaagggaagctctggtgaggctgggaccttttgaggagggaagagcaagttacccggaaatacatcacaaatactgtgggatttaactgtaagtacaaaacagcttttccatcagaacttaacagctactatat

SEQ ID NO: 137115 - DNA, 478 bp, Homo sapiens
ggagtgatagtagtgccttactgttgagtgagtgattctgacccattcccagactgcaattcccagactgggaggcagagggctgagtctccggcagttaatgaatccggaaaaaatctcagctgtgtcagaggagccccagtgccaagttggcctggttttcatcccaagagagctgagaacatggtctggtgtcagacatccacgctgtgattggcacaaatgcctggtgctcctatgacccccctcgttagggctgggggagtgtgggagatgctcctggggctctgcccagagctgctgactgcctagatgtacccaccctgcagctgctgagcacggcggctcattgctagcagctgtgatcttctctggacctgcccatggcttttgggagccaccacaccttggagatgcttgggaggtgtcacctactcccaggggcagctaatgactgatgcaggggtaaaaagcccac

SEQ ID NO: 137116 - DNA, 439 bp, Homo sapiens
gtaactctttttcgttctgttgtttttaagctatatccacctaaaggttatttaaaccccaaactgaacacagttctctgggctagtctgaccactgtaaaatcaagtggaacttctataggtcctgatattaaacctcagtaatacattcagaatattttttataactcaggtgcagagccttaaatgtctacccattacattgtacattgttaaatttagtctattgcatctaccctcccttagcatataactccagaaaacactagaaatggctttctggagaccagctctccacccaggaataatgagcctgatgtcacctcaggctagccccagggacctctccagaaaagtctaaaaggggagatactgggtaaggagactcatggcttgcttcagccaaacatttacagcctctgcaaagctacaggaagga

SEQ ID NO: 137117 - DNA, 231 bp, Homo sapiens
ttccctggacctctacttcctcatctgtaaaatgggggtggtgatcattgccatctcatagggtggctgagtgggattaaaggagaacgtgtgttaagtttttaggaccttaccaggcatacattagcattctctattgcgagagaccctgcccggccacacaggatgggtgttgaagttcttctcggagagagttgctggctgggcgtgatcacacatgtagtcccagca

SEQ ID NO: 137118 - DNA, 269 bp, Homo sapiens
cgaggggtcacacctgtcatgacatgagcaggaagtcagtacgatgcccaaagaggatacgttgaagagttaggataacgctgttgtctaatgacagtgtaaagtggttgccggggaggagggtcagagaacgaaatctgtggctttcatcatcaggcctggtgttctgctcagcctctcttaaccatacattgctttgataacttttaaacatttttggttatctgtggtcctggttgttgtaggttgctaggtctaatgtcataact

SEQ ID NO: 137119 - DNA, 344 bp, Homo sapiens
agttgagacagtctcgctctgtcacccaggctggagtgcagtggtgcgatctcggctcactgcaacctccacctcctaggttcaagcaattctcccacctcagccccccgaatagctgggattacagggtgtgtctcaccacgcccatctaattttttttatttttagtagagacagggttttgccacgttggccaggctagtctcaaactcctgacctcaagtgatccgcccacctcagcctcccaaggtgctgggattacaggcatgagccaccatccccagcctcaggctcggctcttttcctcatttttgactaggggtggactgggtaggagggttttg

SEQ ID NO: 137120 - DNA, 551 bp, Homo sapiens
gggtgatctagaggatcccagtcgacggagactctgtatctgttgtcgcaagaagactcactctgctatttttatctagaagcactccgtttctccctaaaacacagatttatgacttaattctctttcatgtaggacacctgttacctctatttggatcttgtgcttccagtttctcactcgtttaatgaattctgtacacttagaaggcacacaaagcctgggctggggtacacgtggggatcacactgcaggctgtgaatgtagacaaaaatcctttgttgtgggtgtgatcactttaacaattagtgcatcaaaatctcttgtattcacaataagcaattgcatatttaaaaattttttatctccatttaaagatgtagccctcatgtatttagactttaccgtataaattttaattaagttcagttccactctcaagtccctagaattatggcaaaatgctttcaaagatagccgactttcttatagagttaaccagcctttttagtgaaatatgtgtccacaatctctcatctgcaattcaaaat

SEQ ID NO: 137121 - DNA, 371 bp, Homo sapiens
agcctatcacgtgaccatggacaaatcacttaatttccattttcatctacatacctgggataaagaattatcagaaccctagcagagagatgagggcatctgtgccagggaagagttaacttaacagtggggatgagaaattgaatacatacaggagaactgatggaataaatatgcccatgaagaatagtgaaagtagatttctcactgttggagaaatgagttacaaatttggaaaggaagaaagacgaaacaaactctgttgtgtttggactagaattgaatgtgtcagtgtaagttcatggtcttatttatggagaaaggtagataaatgaaatatacaggtaaatgtgtgtgtaacacacacactc

SEQ ID NO: 137122 - DNA, 278 bp, Homo sapiens
cgtactcctgcttggtgggactacaggggcaaggtttccgggctcacaggtgacagggacagcttgtcagccaccagcctcactctccagtcctgccatcagccacactccagggtcagaagaacaggatagcgaacccgaaagcccagcgccctttctacacagagcctcgcccgttccaggcttggatctcttcaaaaaccacagctttgtgttcaaggaggaacaaaaaagacatcaacaaaagcaacaaggagcttttggttttaccaaaagga

SEQ ID NO: 137123 - DNA, 378 bp, Homo sapiens
tctccgtatactggacagaagaaagttcccttgtctagtatcttctatgtcactcaacatttctgtctctcctttcagctcctggtcctttcctcccgtctctctgcatcctttacctggtcccctcataccttcttgcggacctggatttggcatggtttcctcactctcttgcaaacttcatgtcccccttctacagacctcctgcactcacttcctgatctcactccatccttgagagagatcatcacctcttttcttcatccttcactcacacaatctgcaaagcagacacgtgcacgcgtgcatccagctctttaccaccctctcttttctaataatgcttccccatcatccacctgattgaaacctcactct

SEQ ID NO: 137124 - DNA, 169 bp, Homo sapiens
atcagcaatcacttcatgcataagccattatcagaataacaaatcttttatacacatgcatacatgtacacttttattaaaaaacaaccagctgcaaatgctccagaaatgatggaccaagatatgcaattccagacacattcccagcaacaataattcccacataagt

SEQ ID NO: 137125 - DNA, 140 bp, Homo sapiens
ccgaggggagtgaaaatcggataaggcccccgacagccccaagcacaagtggcttaagccggccaagcagccacacggcctggctgggacatctgaaaatgtaagttgacactttttctactaaatcacaatttggtttt

SEQ ID NO: 137126 - DNA, 120 bp, Homo sapiens
ctgccccgctaagaagggccctctgagtgtggcggttatcacgtcacctcccttctctgccgtgctcactgcattccatgctctaggtgtgtggaactggagtccactagcctgactctg

SEQ ID NO: 137127 - DNA, 384 bp, Homo sapiens
aggaaggatggcccagaaaaagagaatttatgtctgaaatacagaatggattactatagagattacaatacaagaggtaacttcaaaggagagtagatttcataacaaaaatgcaagaacctgcatatccaaatgagaccactgcttccctttaccagggttcctctggaggcttggcacttactccaaagatgctgctgtctcaaaacatttatgtaactccttgttggaatgcagttacacagcaagtgacacattccttttaaatagctcatcctttagcaggtaaatttggtttttgctaacagtcgtatcctttgggaccaaatctggagcaacaatttgtattgggaagcataagttttaatcaaaggctacaacagc

SEQ ID NO: 137128 - DNA, 209 bp, Homo sapiens
ataaaatggggctttgctgttgattggatgctgtcaggaggcaggggtatatctttgattgagcatctcaataaatattattgagaagggaagagtagagaaaggctaaagctgaaactgataaggaagtaacaggatataggccaggatagagaaatgtttacggttttttgtggtttgtttgaactatgcttagataagtttatgga

SEQ ID NO: 137129 - DNA, 495 bp, Homo sapiens
tgatgttgtggggccttgagcttggggctccccagagggcaagagcctgagacagcaggtcaataaaaggtgagtggtcgacgggattggcagatcctggactcagcccttcactgggcaaatgtcaggcccagtggctgggcagcttgggggcatttccacctgaatgcagggacaagaccaccggccagtggcatcagactggcaaggtgaggaggtggccttttgtaatggagtcacctgtgtccagaacagctgtcctccccttgggccatgggaggacaaaggagagagccagaggaaaccagagccgaatgccacattgacttcagagtgctctcctggtggctggtggggctgggtggggtagtgtgagagtgaagccagcggcctgcaaggtttgtcctctgcctagttcacttggcctggagcctgaactgggagggaggattccggtctggctgtaagacttactggctgtgagcccttggagaa

SEQ ID NO: 137130 - DNA, 345 bp, Homo sapiens
gaaagggatgctttgcggcaaaggcgctgctgcctcaagcttgctttacatgcctctctagttcctctcgcactacagagtggtagcgaacaaaagcgttcgccctagaagcgacctgaatggaaaaatctgcacacgaactaatgggtttgtcacggaaagtagggaaccgggtctgcagcattccctggagacagactttctggttggttttcaagggtccaaggcagccatcagcccggctgtgccctcccaccctgcctcccacccagttgattctctctttgtgtaagtttagcccctctgaggtggtggagtgagagcatcccatcagatatatatacg

SEQ ID NO: 137131 - DNA, 474 bp, Homo sapiens
tgccctcactgtgtggggtgaggggaggctgttgaaggtgaggggtgccctcactgtgtggagggagaggctgttgaaggtgaggggtgccctcactgtgtgtgggggagatgctgttgaaggtgaggggtgccctcactgtgtgtgaccacagaggtttggggaggagttggagcctttgctgagctgacgtggactgctggcagcaggtgcacacattttgaggagctgtggtgagtgcgtcccacgaggcggtcggttccccattcatagccagggaaacggagacccgggggagatggacgaagacattggtgttgggactggatttgatcccaggccccaggctgcagcgtctgtgctttaccagccctgtggggtcctcaccgtcccgtaccaggagactcagagtaccaggggcttcaggtcgtcactgttgccacctctcccccctggtgagaaggacccacgtag

SEQ ID NO: 137132 - DNA, 344 bp, Homo sapiens
cagacttggccttaggaaaggtaagtaaagtggcaggattgggcaagttattacaccaggtgatggtaagatgaggatagaaagagaaccttatgggtcaggcgtggtggctcatgcttgtaatcccagcactttgggagggagaggcgggtggattacctgaggtcgtgagtttgagaccagcctgaccaacatggagaaaccccatctctactaacattacaaaattagctgggcatggtggtgcatgcctgtaatcccagctatttgggaggctgagggagaatctcttgaacccgggaggcggaggttgcagtgagccgagatggcgccattgcactcca

SEQ ID NO: 137133 - DNA, 408 bp, Homo sapiens
tgagaaattcatcaaggatgttttaaattcagaccataacgttttagaaataaaatgcagtttaccaaaacatttgtctcttttgttgttttagagaatggagagggagtgatatttattaccttttcatgttctaatggaaatatggagacataatatcttctatactatgtaaattcaacagtattggtaaaatatattacacataaaagcaaactattactatacaaattaactgatattatatttgttagaaatcaatagccttgggttaagaaagtcagaattgagacaaacaatcatttatatttaggtgctacagactgtttgtgtcgccccaaaattcatatgctgaaacctaatcctcactgtaatgatgttgggagatggagcctttgggaggtgatt

SEQ ID NO: 137134 - DNA, 410 bp, Homo sapiens
actagtccacggttggctgagtatggattttgattcatatactcaaccaaccgttttttttacagtaaaggtatactcatatgctgggccttagggggttataagttaatgtataactagaattggagctagcaaatgtcactgtttgtaaattaggaactcagaattataaaatgtatactctccttcaagataaatacaacaagtatattacgtacactgttattaatttaggtaagagccaaccgtggactagtgtggactagtagccaaccgtggactagtagccaaccgtggactagtagccaaccgtggactagtagccaaccgtggactagtagccaaccgtggactagtggccaaccgtggactagtagccaaccgtggactagtagccaaccggggtaccg

SEQ ID NO: 137135 - DNA, 334 bp, Homo sapiens
gttaactaatggccatgtgatgccctaccaagtttgaatatattctgggcctgaagatattgcatacgtgctctctgaaagttgaattttcttggggcagagctacccatctctgaatttacatttgaattacagggaataacatctcaggtgccatggtttgacttcatctaaatctttgagaaatgtttcatagtaatcaaagcttctctttctcttcttttttcccttccttcctttatgggtctagcactgacaacttgaccacattgacctaaatattaagacctttttttggtttctctgtacccactactcacatggccactcaata

SEQ ID NO: 137136 - DNA, 140 bp, Homo sapiens
tgctgggattacaggcatgagccatgatgcccagccagaatagtttttaaattgggattattttacatgaaaatctagatttctggcctccctcacttggaaaaaaccaaaaaacccacattcattcttgcatgacaaga

SEQ ID NO: 137137 - DNA, 201 bp, Homo sapiens
ccactggcatttccgggggctggagcatgctcaatgccctgcaggggaaggaggacgagactgggaggaggtgggaagaaaaacttctgtctggtgtggccaagagagcaaccttgcagcctttcttcccggggaccattttcagagcgaagacggagaatgcattaaaactcctggtgccgaatggtgtgaacccgggag

SEQ ID NO: 137138 - DNA, 122 bp, Homo sapiens
tcccagtcgcccacttgcccttccttgaatctattcttactttaaggacaagatctctgggtgaggcgtctctgaagccagtttctgtgtcctaagcaagtcagtgtcaaagtggctttctt

SEQ ID NO: 137139 - DNA, 194 bp, Homo sapiens
atataatattatgctgcctttttagtcaaaagtagaattaggacctaattcaaacatactgaatgtctattgggtacttggcgctttttgcatagtgagggagacattgaagtccactttttgtagaaaaggaaacacacattttttgatccgctcaagtgtttggctttgggcaagttaacctgcctacctgt

SEQ ID NO: 137140 - DNA, 556 bp, Homo sapiens
  misc_feature (17)..(17): n is a, c, g, or t
gagattaattacacagntgtcctggacatccacaggctctcagacaaagataacattatagaatggtaaggtgaaggggacatgtgtaagtcccaggtgccacagcagcacatttgaggggctcccaacccaggctgggtgatggtcagggagggtgaggcaaggtccagggaggcaccagaaaaaaaggaacaaagggctttgtgagagcttgggagagctatcatggaaagaatcagaatttttgtgtcctttccagttcttatttttgaacaggttgatcctatttgtatttgatttgcatttgggggccaccattattctcacccaactctgcctctcgaagttaatatttggaaagccttggaaccctccttctccctacctcacccctgcccatcctggcttgcacagagtttgttttttgttagttaagcaaagccaggaatgtgaatgaaaagtgaaactgaggggtaatttgatcagctctgcctgccccgcttgctttccattattttttttccctttacccattaagctgaaggccaaggtagct

SEQ ID NO: 137141 - DNA, 546 bp, Homo sapiens
ctcaagagttcattcctaaaatccaaatttccttctctggagataggaccagatcatagctcccaatcttttctccagtttttgttttacgacatttcggatttgagattctgtaagaagtgacctaatgtgagcatttcctgatatggaggagacgcaaaatagctcagggaaaaagttgatcattagaaaaatctgtggttgtcccactgtctcatcgtgccactgggagtttctggcctccgctggcatctctgatgaatgttctatgccaggacaaagaaggcgggcatgggccaggcagtccctccagtcagggaacggtggcctctcccagctgccttggtgtttaggaggccctgtaagggtatttgggatctcaagagcctctgggacttacgggcaaagggcagaccttaagagccagtccctcctcccccaaaatgtttagcaagccagaaattcccctttactgctaagtcaaaggaagatgttctttgactcttcagggagcataacgtaccatcctttgatggtcatacacat

SEQ ID NO: 137142 - DNA, 236 bp, Homo sapiens
agctggggctattaagatgaatacaatatcaccctcaagaagtaagagtatgatgggaaagatactagtttattcctcagtctgggataacatttttagagtaaaggaaagccatccaactcccaagatggttagaagcttcaaggaaccaattattatttttgagggaagaagggaattccaaacatgaaggatactttgaggatggctcactggttccccctggtggacattaa

SEQ ID NO: 137143 - DNA, 207 bp, Homo sapiens
tacttcacagggagagtacctacttcctaacccgcccggaacctcactttaccatgtcatcattgttgagtcaaagaaatctgagagagactcccaagatggttagaagcttcaaggaaccaattattatttttgagggaagaagggaattccaaacatgaaggatactttgaggatggctcactggttccccctggtggacattaa

SEQ ID NO: 137144 - DNA, 124 bp, Homo sapiens
tttattagaggacaagcaatcttacatcctcaattatttacttaaattgtttattaagcattggtattaagaaatacctttaaggatatgtgtccacaaacaattaatattttactaccttcct

SEQ ID NO: 137145 - DNA, 245 bp, Homo sapiens
tacctctttctcagatgcatagtttgtgcatattttctcccattctgtaggttgactgtttactctgttgatagtttcttttgctgtgcaaaacctgtttagtttaattaggtcccacttctcaatttccggtttgttgcaattgcttttgaagacttggtcataatgcctagtttcttgagggttattatcaggaggagacattggattttatcgaaagctttttccaggtctattgagatgat

SEQ ID NO: 137146 - DNA, 684 bp, Homo sapiens
ggagcaacatgctttgtttgggctcttgctcttttgaccatggaatttttggcaggcatggaatgtgtctacagacaagaagccagagtcaatgtatggtttcttcatttttatcccttctcttagtaatcaaagccctgtactgcctgtagtacaatgtctaaaaagaattgtcccatatattttgtccagttttctaattgtttgctatagaaatgaaagtctagtatccgttacttcatccgccgtgagacagaaaaccttcagccatagaccaggatccctaacccatgctcccacaagagttggaacctgctgctcagtaaatatataaattttatatcctgtggcaggttttatccagttaggcttttcaattaatactatagctgtttgggtctttaccctcttgtttctttgtttagtatggttaaaaatgtgactcatatttgctacattgtagtgagacttgtagtttttagaaaatatactttaaaagtagtttgaattatgtgtaacttttaaaacttttaatcaaaaatttttttatttgaatttttcatataaacatattttttcattcaaatcggttatatttaaaaaccattaagctaaaatgttgaatagaacttgtgaggtttcctatcacttaatatagtttaaactatgaacaaaggacaagaa

SEQ ID NO: 137147 - DNA, 429 bp, Homo sapiens
tccactagtgtaggcaggagcagaggcgatcataaggacacggttccttagggctttattaactcttgctattcatcaagaacagaaaacaagagaagcaggcaggagcagaggcgatcataaggacacggtgccttagtgctttattaattcacactattcatcaagaacagaaaacaagagaagcaggcaggagcagaggcgatcataaggacacggtgccttagtgctttattaattcacgctattcatcaagaacagaaaacaagagaagcaggcaggagcagaggcgatcataaggacacggtgccttagtgctttattaattcaccttcttttcctctccccctgcccacatcccccaggtggtcactgtggtgtttttcattcttgttataagagacagggtctcgctctgtcacccaggct

SEQ ID NO: 137148 - DNA, 477 bp, Homo sapiens
aatggagagtaatcagctaatggctcattatttatgtataaaatgaagatgtcctgcacgaaaatcaattcacattgagttcaaatgcacactcacattcatctctaagtaacttattcccccactacccccatggaggattttaacaaacccaagctgggaagatgaatttacaacccaatttgttcttttctccaaattgaaatatcaatgcatccaaagagagatttaaaatcaatgacacttctaaattcaacacagatacgctgtctagcatttcaagactagaacttattgttaaagtgagtactgtttatactgtttattctgtttcagagcaaaagctatacttaaaaaagttgagatccaattcattcatgtacaggaagctaccctgacaggtttcattgggttttaaaatcagagttgagtggtcgcttcaattttacagaaatggagtttataaaatgtaaaccc

SEQ ID NO: 137149 - DNA, 525 bp, Homo sapiens
agaagtagagacaccctttccatcccagagaggagtcctggggcccatctgccgagatcagagtaggatttggaacccaagcaccagggaaccaatgttaggctctggttttagatcctggcgggcagcactgtctagaaccacagcaggaggtgatctagattagactaggccatggtcttgggctggaatctaaatttatagtgggttggatttgttgctcatctaaaatggtcattctggaaagtaaaaattttagactttgtaagcattcagtctctgtcatgagtagtacttaactctgccattgcaccttgaaagcagtcatagacagtgcataagcgaatgagcatggctgtgttccaatcaaacttgaattataaaaacagacaacaggccatggaccatagtttgccaacctctgatctagaaccttattcctcctgaggggtgtgtagattttaaacctaattagacagtgatctaagcaaacaatgttgacatgtcaggctggaacctagatcc

SEQ ID NO: 137150 - DNA, 363 bp, Homo sapiens
aacagcaactcccctaggaagcctctctgatcaccctatctaaagcaggtcccccccatctctcccaaacacacacaccattgttctctatctcagcccaaagttttcattcatggcacttaacacaattataattcccacccccagctgttttttaagagacagagacttgctctgtcgcccaggctggaaagtagtggcgtgatcttggctcactgcagcctccactgcctggcctcaagtgattctcctgcctcagcctcctgagtagctgggattacagggccaccaccacaccgggctcaattatcattgtttacttagtagtttgtttaccgtttgaggtctctcttttccatgagg

SEQ ID NO: 137151 - DNA, 264 bp, Homo sapiens
tttacactgaagttgttgaatggatggattttaatccctgccatcctaaaatacactggcaacaagttgtccaaatgaagtcaagacaagggaaaaccaaactaatatggtttggctctgtgtccccatccaaatctcatcttgtagcttccataattcccatgtgttgtgggaaggacctggtgggagatgattgaatcatgggggcaggtctttcctgtgctggttcttgtgacagtgaatgggtctcatgagatctgatgg

SEQ ID NO: 137152 - DNA, 326 bp, Homo sapiens
tattcagttgatggaaatgagttgcttaatcaaacgttgaatatagactgtagaaatcattttgttactgacacgtttttcctcaactctatgtatttatgtagcacttattactatagtgtctagatatcttgacaaatgtgtcatgccaacataaaacactatagtctctggccaagcctatggaaatccatatggcacactgaactattcaaaagcaaacacaaaagtaaatcaccctgtgtgatcaggcattgaatattatccttagcttatcacggtatgaatttctctttgcatgcctgtcccaaacactcatggagtaa

SEQ ID NO: 137153 - DNA, 265 bp, Homo sapiens
aatcattcctgcatctctggtatgaaacccacttgatcatgatgtattatcttttgatatgtgattggatttagttagctagttttttgtttttgttttttaggatttttgcatctatgtctatcagggatactggtctgtagttttcttttgttaagtcgtctcctggttttggtatttggatgatactggcttcacagaatgacttagggaggattccctttttctccacttttggaatagtttcagtaggattggtaccaat

SEQ ID NO: 137154 - DNA, 240 bp, Homo sapiens
accaccatctgtctccagaacttttcatcttcccaaactgaaattccgtcctcagtaaagactaactccgttccgttccgttcccctgctccccagccccagcccttggcagcaccaagcctcattcagttttaaaatgcaaacattcaaagaccaagcctcattcacaccttcggtgtaagttactttcatctgcgaaactcccatcactcagaaaggaatgcccaggtaaagaccgtg

SEQ ID NO: 137155 - DNA, 517 bp, Homo sapiens
ttccttctttttatgcttgtgttcagaaatccctgtgacacctgtcacagactaacaggaaatgtgtacaggattcacaaggtgatgacacttgactacagataatctcaggcttggtttcattgtcttaaatagcaatggcagcataatgacagtgtggttagactcagttatgcgtggactgcaggttttcacatcctggccattgttccaggatccctagttgcattcatgggagccttttgatggcaagtgccggaaacaaatggtgctcacttaaggagaaaggggaaatgtgttttaaggatataggagcatcttgtggaatccaaggacagtagagcagttgggccaaaaagaaaactggaaattggaaagctgtccagacactttccctgctgcttccatctgtccctccctgaaaatcacttcctccttcccttcccagattgactctctcagttctctgagccttatgtttagagcactcaagctatatgttgttacaatatcatct

SEQ ID NO: 137156 - DNA, 337 bp, Homo sapiens
gactggcctcccctttggccatgctgatctgtgtcccaaccctcaacctggttccacttccagatctgcctgtcctcagctcacctttctaccttctgggcctttcaaacttggatctgtcagtcttgcccactccatcaggcttcctgttctctcggtctggcccactttcttggctggatcattcatgacctttctcttgccaggttcctggatgcctatgctgagcacaagttacagttctgggcagtgacagctgaaaatgagccttctgctgggctgttgagtggataccccttccagtgcctgggcttcacccctgaacatcagcgagact

SEQ ID NO: 137157 - DNA, 400 bp, Homo sapiens
tcaaacacacgcccagttcacctctctcagagcaacactttttctcctcgcagcagaggttcccccagacacagacacagacacagacacacaccccaagcagtagacagaaagagaagggagagagggggtgtcagaaaaacccggaaggaaggaagctggacagacagacagtagctgatcctagcttcattgctccagagagacaccctccagactcctagacttcaagggacactatccttctcagaaggagagagcagccctctgtctcttctgaaaccaaattccagcagccctggaataggacctaccccagcgcaacaagaagcctaagctcacttctcttcctacattcttccccgagggttcctttggatcaagacaggggccacctccc

SEQ ID NO: 137158 - DNA, 465 bp, Homo sapiens
gctagagatggtttaggttgtgctgctcggaggaataaatgtctggacaatgagataagacccttcgtaaatactgcaccttctctttcctttcttacttatttgcatgaacctgttttacagcatcctgcactgtcagccaaagacaataaaaaaataagtcacctcaccctgtatgtttttagcttggtaaaatgctgtcatatcttttacttaacttggtcacttggttagtaactaggtaagcaaacctatttatagccatgtgcctattaaaacacactttaccataaaagtgagatgcactttccactaaggatagagtttcatccaatagtcctcttgacaagcttcagaagttttctctttgccatcatctacatacctggaaaggcactctgtaccaaaatcagcatactgaactagcaaggacagacagagatgagaggaaaagagaccatggag

SEQ ID NO: 137159 - DNA, 450 bp, Homo sapiens
tggcttttcaccacaaggatctcaaaatataactttgcagttttctgaacaccaaaactcagttaaaatgcaaagatttaggcaaaaaagaaagaaagaaaagaaaagctttggggtaggaagatagtaaataagaagaaaaaaagaatttaacttctatatgattaaggaagaaaataactaatttttcattttattagagaaatgtacacatatctgtattctcataatatacccaggtgtattttactagttcatttgccaggtgggtccagtcttttgatcagaatcccagtctatgggtgggatcagacatagactgcatgccccaagtatttaatctggcataaagtgatagttaatagcccagtagatcacatgggctacagttccacccaccttattaactaaactgataacttggcactccacacatcccctaccctgttt

SEQ ID NO: 137160 - DNA, 379 bp, Homo sapiens
acatgaaaagagggagagaggggacagccacgtaagttacaaagagatgcctgagaaagacaaaaagggtatgacagaaagaagcgggggcaacaaaagccaagacacagaaaccaagaaggacaaaccccagacaggggagaagggaccagagagaatggcagagaggaacagtgagggtgacagagtacccaggctggggcagagacagaacaaagccagccccacacaggtgagagaagcacatggtgctcagggagagccgagcagggccccggcactcaggagggcgggggtgcaggctcagctgagggcctccttacccttctccttggccttctgggaaacactctcacccctccccaacttaccatggtgt

SEQ ID NO: 137161 - DNA, 328 bp, Homo sapiens
tgggatttggtcttgggacaaagtccagaaatagatgagaaggaaatatagcatttacaactttctagaattcataccaaacagaatattagaaaaaatttaggctatagatagtgtttcggttgaaatatcagctcatatacctgaattggcttggatttatacccaggtatgcaccaaggaccagctccatctggaaaactgatcaccaaacttcaactctggaatataatgctccattcagcactagcacagggttctcatttctcaggggttctcagcaaaaggatcacctggtgaaggtgcttgttaaaatgcagattctccg

SEQ ID NO: 137162 - DNA, 475 bp, Homo sapiens
gtttctagggttaattttttttcatcttcctctcattaatttaccacttttatctgactaagataccttaagtttctttattccttggattggtagtatagtgaaatgattagggcagggctttgaagccagagagtcctgggttcaaatcctggtgtggactctatctttttggggtaagaacctttaaattctctgactttccagtgtcttttaaatgggtgaaataacccttactttatggaatgttgcaaagatgagagaggatgtatgtaaaatgttaacctattacagagcttgatatggagtagacgaattctaaaattacattgagccattttgcctatagtggtgttagaatagaaaagtatactcatacattagaattgtgcacctagagctaagtgattccagccctgtggaacccgtcaatgccagaatggcatgtaggactagatagatgaatgtcacctga

SEQ ID NO: 137163 - DNA, 769 bp, Homo sapiens
tgatgttgtaggacaacatactactcatgcaaaactatggttaaaaaaaaaacaagcaaagcatcatggatgtacttctgaaaagtgtaacatttcctgcagatgagccccagacaggtgcttgaggaggtcttatagaagaaggcattgttatcacaggagaggacaactccatgtatgttattgcccctgaagaccttccagtaggacaaaatgtggaggtggaagaccacaatgttgttgatcccaaccctgtgtagggctaggccaacttgtgtacatttttgtataactgtacaaagtgtttgtgttttaagcatagtgttatcacaaaagtgtcaaaaagtttaaaaaattaaaaagttcataaagtaaaaaagttacagtaagctaaggttgatttattattaaaatataaaaaataaattgagtatagtctaaatgtatcatgtttataaactccacagtagtatatagcgatgtcctaggctctcacattcacttattacatattcactcacccagagcaactttcagtcctgcaagttccattcatggtaagttccctacacaggtgtaacccttttttatcttttatgtaatatttttgctgcatcttttctatgtttagctatgtttagctacaaaaatacttaccattgtgttatagttgcctatagtattcagtacagcaacatcctgtatgggcttgtagccttcggagcaataggctataccatagagcttagatgtatcgtaggccatgcca

SEQ ID NO: 137164 - DNA, 424 bp, Homo sapiens
agctgggattacaggcatgcgctaccacacttggccaattttgtatttttaatacaggaattttgtatttttaggagaaacctagctgtgacagaaggcaaaaagggatttagagtgtctcacggtgattaaaagcttgactaagaaatcatacatgtcacttaactcagaaatgcatttctatcacatgctgaaaggccagaactacacagaattaatcacctccacctcagggtttaaaagagtacatccacagcagcgttttacataactgaaatgcccaacataaaggggttaaagtttccaggcagccaaaatagatgtcatgaaattcaggcactaaagttgagaagcacatgggtagcaattaagatacacttgtaagcctgataacgagacatttggaatcataaaaactaaatat

SEQ ID NO: 137165 - DNA, 196 bp, Homo sapiens
cccacggcttgattagaaggtgaggttgtggaaatgctaggccatgttgtttatatgtgagcagcagaaacattcaaattgggaatgtttctgtttacctttttatggattacatcttgctaatgttaaaatctttccctgggtatagaaaaggcatgtagtggctaatattatgacttaaggttcctgatcaaga

SEQ ID NO: 137166 - DNA, 481 bp, Homo sapiens
gtctacatatcaagccagcttttttccacttaattaacatctcatattcattaaacaattattaataaaatacctaccatgggataggcattgttctaggtactaggaataaagtagcaaatgaagcagatatttaaaaactcagatatttcacatctgggaatctgaataaattacatgcgatacaaaaaattcttatactcaaataactccactgttatttataatggtgaaaacttgaaaatatactacataatagtgggaatacttcagtaaattatgacacatccactcaattgcatattatacagctattaaaaatacagcccataataagatataaaaatgtctgtgttgtaatgttgactgtaaaggagtaacataagatatggtaagaatgtagataaggtgagtcattacatgaacatgttaacaacattaatcctttgttaatgaatctatgggtggcagatttgtactc

SEQ ID NO: 137167 - DNA, 772 bp, Homo sapiens
ctgagaattcctcctcctgggactctcagaggatccagaactgcagccgtcctcgctttgctgtccctgtccctgtccatgtatctggtcacggtgctgaggaacctgctcagcatcctggctgtccgctctgactcccccctccacacccccatatacttcttcctctccaacctgtgctgggctgacatcggtttcacctcggccacagttcccaagatgattgtggacatgcagtcgcatagcagagtcatctctcatgcaggctgcctgacgcaaatgtctttcttggtcctttttgcatgtatagaaggcatgctcctgactgtgatggcctatgactgctttgtagccatctgtcaccctctgcactacccagtcatcgtgaatcctcacctctgtgtcttcttcgttttggtgtcctttttccttagcctgttggattcccagctgcacagttggattgtgttacaattcaccatcatcaagaatgtggaaatctctaattttgtctgtgacccctctcaacttctcaaatttgcctgttctgacagcatcatcaatagcatattcatatatttccatagtactatgtttggttttcttcccatttcagggatccttttgtcttactataaaatcatcccctccattctaaggatttcatcatcagatgggaagtataaagccttctccacctgtggctctcacctagcagttgtttgctgattttatggaacagacattggcatgtacctgacttcagctgtgt

SEQ ID NO: 137168 - DNA, 200 bp, Homo sapiens
gttctatcctgatgttctaattcttctccttagagtcaaaatcacccataatgtactgctgtagtccaaagccccaccagccattgtgccatgatgatagaaatctcatgccattttgactcttaataactgaaaagctggccgggcgcagtggctcacacctgtaatcccagcacttttgaaggccaacgcaggtaggt

SEQ ID NO: 137169 - DNA, 331 bp, Homo sapiens
acagtcagagggagataaccttgggacagactacaggttcctgtcaagtaaaacagaaggttgagacatttcctaaaagtattagtacatgtaactttgttttcagaattttgacatatataatctaacctgcagttaccccaaaataagtggagccaagtgtagagtacttgaaacatagagtttggaatacctcttttgcagacagcagcccacataacaaaaataatgtgccaggtctgggaaagtgactaataatcagaactcctaggactgggctctattttcctatagaatagctgttatcagtgtgtttagatctacaaaatag

SEQ ID NO: 137170 - DNA, 510 bp, Homo sapiens
tcagggaaggtgtcactgtgaagggcagaggctgagctgtgtgcatgtctggagagcagcattcttggtagagggcacagcaagtacaaaggcattggtgctttcctggcaaggaggccaggatgtctgcctggcagtgagagaggagttaggtggtagtgaggaccaacgggttggggggttggattgtgtcaagtctcgaaggcctctagaaagactttggcttcagtgagagcaacaggccatttgaagggtttgcaggagaggcatgggatgctgctgtcttagttgtgaagagtcacctggcccactggattaagaatcagttgcagggaggtaagatcagcagcatggaccagtcagggggctgttggaatagtccaagtgagagatgatgacggcttggaccctggaggtagcctacggtggagatggggagaagtggttggttctggatagaatttgaaggcatggtggaaaggactttcagatagatagagagcacagaat

SEQ ID NO: 137171 - DNA, 402 bp, Homo sapiens
caagtgggtggccatgaagagctaccaatggagactgaaggaaaaccaagaaggaccagagagagaatggagccaggaggctggaaggagagaggcgggttttgtgtcaggattgcccagagctccccggagaggagcatctctcctctccatggcagagcacagagggtggaacactgacgtcagatcttcttcaggccctgaacgtaagaattccttggtacctggtctgctttgagactgacatgctgtgtttgattagtttgacttcgggatgccagctaaatgctgtttgctcagcatatgcctgaactggaaatggttccatcacaaaacaaactgaatcaaatagaacgtgggggtggctcagtggggacacagagccagaggtgagtctccttc

SEQ ID NO: 137172 - DNA, 806 bp, Homo sapiens
ccaatacattacaacaactggcacatagagctatttttctgccacggtaattggtgcttcagtcattaacctagctgacaatcatacctctacacacaaaaatctggacaacctcttctggtctttcccatagggtcagctgagggaagaccaaaagaggggactgagaagaattaaaagtacatcttttcaccctcaagaaaggaaaagatcactctctggcctgagtcccaaggagtgaacaagtgcccagcgttaatgagagataacttcgcatcagtgcacatgctctgaaaatcagccaatccctgatagcctcacttgtgttgtgcttctgaaaaggagccagtcagcaacagcctcgctccagtaactacgcttctgaagatcagccaaccgatgacagctccagctcctgaaagtcagcctgtcagtgacagcccctcacttacagacaacagccaatctgccggtcttcaccccggtgacagtgcttctgaaagtcagctaactccagtgaccaggggcacagctgacgtgctgagtcccccacactctcacctctggaacccaccagcctctccaggatgggcttcttcaaacctcatccaagatcagctcaggcttgatttgggagagaccgttcctcccttacaatttcaactcttccttggaggaaaatgagaagttttcctccataacagatattgagtgtaattcatcattagcttacatatttgcaaccattgtgacagttcattcagcccctattcacagttcagacttgccaaagatggacattaaga

SEQ ID NO: 137173 - DNA, 819 bp, Homo sapiens
ctgcaaattatcctttcagacatatatagttaataagccaattttaaaacaaccttatttttaagctttttaaagaactctccagttcagctgaatggtaaatggtaacagagcctaggttattacaagccttttgaaaagaaatagtgctggtctcgaactcctgacctcaggcgatccatccgcctcggcctcctaaagtgctgggattacaggtgagagccactgagcccagccaaaagatcatttgattttaaaccagtttagttttatgaaactgtgggatgtcagtggagatatggaaaatatacctctaaattgaaaaatggtcaaagttggaaatttagatgtaggaaaaatcggcagaggggtgatagtgatcgtgtgttgtggttgtatccaccgggcatggttttaacactacaccattgtcatcaatgtatagatgcagttggtgggtattttgattatttgtaatttaaggtaatcagaataggtacacatatctacttatgaatatgttaaatgtgtgtatgttttttcaactactttgaaaattaggtataagccatggctgaacacagagatttggaagttggggggctgggcacatggtggctcacacctgtaatcccaacattttgggtagctgaggtgggcagatcatttgagctcaggagttcgagaccagcctgggcaacatttagtgagatcccatctcttaaaaaattataaaaataaaaataaatttaaaaatagagatttagaagttgaattataccttaactgacccttagtagagaaaggctttggaggaag

SEQ ID NO: 137174 - DNA, 329 bp, Homo sapiens
aaactgttaatgggagtgcttgcaaaggccttggtgcttttttttctgtttaataggagcaacatcactttggatcaattatttaatttccttatgtcagagttctttcaatttaaaggaaaatatttcctttcctcattcctttttctctgaggatgaaccagacattggaagttgtagcctgggattgtactggagctctcactgtggttgcattctttcttcacattcagcgtcctccttaaagcacacattttcacgtacatctattaaattacctgggagagagttctagacactatcagtcagtaaatccagttgtctcattt

SEQ ID NO: 137175 - DNA, 218 bp, Homo sapiens
tacctactgtgtgccaggtggtagaaaagtaaacacgattaggttgatgtcttgaaggagcctacagtctggggaaacatatgaacaaataagtataagaaatggtgagtcaggaatatgtatagactggggcttaaaggaggaatgtttggttataccagggaatatcgggaagggctttgtagaggaggtggcatttagtgggtcagaatatgaac

SEQ ID NO: 137176 - DNA, 559 bp, Homo sapiens
agctggaccgggtggagcattgtagacacagaaaggagggcagcagggtaaggatgactgtgaggaggaaaggagaaggctgagcagctggcagacgctgggctgtgcagggacttgagctaagctgtttagggaaaggtgtgacatgaccacaagctggtgccagagtgaccacagaagagtggcttcctgggcatctaagagggcacagtcagggcggtaagtggcttagaagcagggccgcgatcagtattgtgtacgttgtgtgatgactctggaggggactgaatctgggtatgcagctaaacattcaagttctcaaaagcgtgtttcaaatagcaaaactggagaagccctttaatggagtttgaaaaaggcacaggagagaagtctgacgtgtttcagtgcagggtaagggaagaagtggggagggattgggtttggagggtgtcacgaggcgacaggtgagccgaacaaataggacattgctaagcaaggctgggaagaaagggacgacgggcagaaggcacagcaaaggccgaggcggggtgtttggaac

SEQ ID NO: 137177 - DNA, 380 bp, Homo sapiens
ggtttttctccagaggctccccaagccctcctggaattctctgtttgagagtctgcggggggacagggagacaggaggcgggggagtcctagaggccttcctgacgggggcgtggaggggccacgtggggcaaggggaagcacagggacctcttgtgaccttgggcaagcccccttcctctctgaccttgaccagcgtcctcatttgtcaagggagcggctgggtgacctctaagaactcggaggccgaggccggagtcgcccgagtgctccgcccagcctcagtttccccctctgcctccccaagatttctaaaagcacttccggctctgaaaacaaaccaaccaccagcaggcggcctgggcttagggcaggcagcgc

SEQ ID NO: 137178 - DNA, 328 bp, Homo sapiens
caaatagtgtgtgaggaaactctgcaagtgggagaattctgtgggaaaaggaaagtttaatttttcacatctctgaatggacatctttctgaagggcgccagcccctccatacctgtgggtatttctcgtcaggtgggatgagaaactcagaaaagaaataagacacagagacaaagtttagagaaagaacagtgggcccatggggctagcacactcagcatgcgagaacctgcatcggtgccagtctcttgagttccctcagtatttattgatcattatttttactatcttagcaaggggagtgtagcagggcaacaggtggggaga

SEQ ID NO: 137179 - DNA, 274 bp, Homo sapiens
ccttacatttctttagttggattctcttataaacaattatgaaaatttttagatgagattggctacattaaagaactggctttagtattatagcatagtagttaacaaggcctaactcgttaatcatagtgctgtttcactgataaaattttgcgtaggcctcttatggcagctcatgcctataatcctagcactttgggaggctaagataggaggagtacttgaagccaggagtttgagaccagcctgggcaacaatacgaaaccgtatctac

SEQ ID NO: 137180 - DNA, 739 bp, Homo sapiens
taatatttttattgttcagcttcatcttcttaagtcttctgcatacttagttcaaagagaagtgatttacaacataggatctgaagaaacaaaagtatttttggttcaagttgctactctgtttaaaaggagaatccaaatagccactcacctgtagtcttagctactcaggaggtggaagtgggagcatagatcacttgagcccaagagttccaggctgcagtgagctttgatcttgccactgcaccccaacctgggtgacagagtgagactctgtttcaaaatgacaataataggctgggcatggtggtccacacctgtaatcctagcactttgggaggctgaggtgggaggatcacttgagcccaggagttccagaccagcctgggtatcatggagagaccccatctctacaaaaacgaaaattagccaggcatggtgttgcacacttctagttccaacgacttgaaggctgaggtgggaggatcacctgaacccagggaggttgaggctgcagtgagctgtgatcataccactgcactccagcctgtgtgacagagtgagaacctgtctcaataataatgataattaataataataatcataatagaaggagaatcaaaataaaacatgcagatggtcaacaggtacatgaaaaaatgctcaacaccactaatcatcagggaaatgcaaatcagaactacaatgaagccggcctggtggctcacgcctataatcc

SEQ ID NO: 137181 - DNA, 363 bp, Homo sapiens
atgggagaatgtgcccactcccacccccagcgtggagacactggccttccttaagccgaaggatggcccttccccaggggaccttggcctccacaggggacctcggcatccacagtgggctcattccctggaggggcaggcatggactcaggggaagggaccatacctgccccctctgcctgtgacgtttgggacttctgaccagacctgaaaagtcagattctgggaaggtgagggagtgacagtgggggacttgggcccaaagaactggtcctcgcatggcccagaggtgtgtgtgtccccaacctctgtgctgaggagagagacagcggaggtagctgggccagagccttggcttggttc

SEQ ID NO: 137182 - DNA, 547 bp, Homo sapiens
gtgaatcttttaaaaatgctgatgctcctaggttataaaataatctattattttgggcctaggcccaaagtactagactatgatgaagatcccacaaaagtgattgtttttctataattacatatacacatatatttattctgtagttacatgcatagatagaaaaaagacttggaatctaaaacaaaagcaaaaaaaaaaaaaacaaaaaaacaaaacttggtggcggccggcccgtgggcccttgggaaaagactcttccaacaaccacttcgcgtgggggcgccgcgggcccacaggtggggcatacgcggaacaccgtggccaaagcggggttccccagagagaaaccggggccatgagaaatgagtggcttgggtttttcctccacaccatttaaaaaaacgcccgcgggggggaacaccgcgatgtgtttctcggaacaaaatctcccaagaggggatttccgagaaggccctatcgcggggtcttctaacaacagcggggtgtcccaacgggaactcgtaattatcaaatttaccccccg

SEQ ID NO: 137183 - DNA, 592 bp, Homo sapiens
acataaaaggttctgagaagtcctacagtgagcagagttgtttacattttttaaccagtgtttcccaaacttatttggtcacagaattcttttcttcaggtagcgcaaaggaaccagtgttcctcataacaacttattttgggaaatgtacaataaattgccattgattagtattaaatgtgtaatttaatatgtacctgtcccaaaaaggtagccattggcagaatttgctgaagtcccaaaaatgagcccattgtattttatgtcagaaaaaaaaaatctaacatgcctagactagtacttatattatctttaacaagttgaatttatttccagaatatgtgtttcaacccttacagcctgtatgttatttaatcaaatccaaacacccagtttcttatacctgtgaaaagctaaaaaatgaatatgatcccccaagccattggttttttttctgggcttcactgtaagctgagaaaaccctgcagctgtgagctactgcataccttcaaatatgagaataccaaactcagttacagtattttattaactggtgctatgagcctgcatttatgcagttctacagtaaaat

SEQ ID NO: 137184 - DNA, 323 bp, Homo sapiens
aactatgtctgttctttctgctcataacttttcaacttttacataatgtttttatctaaacaaggagaaaactattgaactgtccatagcacttgcattagggcaccagtgtcacagaataaatcacttttaaatgtgctgtgcagaattcttataggattctgtgaacattttgagaaaaatcacaggcctttttataatttgatagtggttattttgtatcagtaacttctgcttacgtctgatagccacagcatcttcttaatgtcaggatcctgttttattgactcagtaatggtggctctcaagtcacaaaccagctg

SEQ ID NO: 137185 - DNA, 364 bp, Homo sapiens
aagatcaagaatctctcataattacattttagctcccaagcttttacattaaatggtagaaattatttaagtgtaagactaaaagcaagagattggagatattgtactctataaatgcttgcactgcatcaataaatatagtgaaaggagacggtgaaatcttaatttgtcatttttgttgtattgtcttacatggagtgtttacatccagaggtgaggttatgccagtgcaaaaccatgcatccttctggctgctggggccattatctcttctgcttggtcatgatgggcattctgattggtctttttgtgcagtgcaggttgctaaacactttgaataacacttttccttaactctgggatt

SEQ ID NO: 137186 - DNA, 406 bp, Homo sapiens
ctcttttatctcaaaaggactcaaggctactaataaaaaaaaattaatacaacagcataaaacaaaataaaaacaagtggagaagaaaagacagccatttatattatacactgctatgaactatgaaaactttagttagagtctattttaacaataaaactctacttggtcaatttgcctaaggcagaccttaaaagtggctattagagtgataaccagagaattaagcatttttaatttaaaggatgtttaaaacaaaaaagtacaaaaccaattttttcaaagatttgggtaaactgcaacaactgcaaaattctctagggagaacccaaatcacaagcttaaacaaattgactccttcccatagacaaaagaattcagtcccatagctcagtatagcacagcc

SEQ ID NO: 137187 - DNA, 530 bp, Homo sapiens
  misc_feature (402)..(402): n is a, c, g, or t
ctcaaaccgtatagaacaaaagatacaaaaatggctcagcccaaaatctccttaagctgataagcaacttcagcaaagtgtcaggatacaaaatcaagtgcaagaagcacaagcattcttatacaccaataacagacaaacagagagccaaatcatgagtgaactcccattcacaatggcttcaaagagaataaaatacctaggaatccaaattacaaggggccccaaaaagccagaacaatactgaaataaagaatacagttggaagactcacacttcccaatttcaaaacttactataaaacttaccatttgtttaaatcaaaacagtataggtgccgggcacagtggctcacatctgtaatcccagcacttcgggaggctgaggtgggtggatcacttngaggttgggagttcaagatcagcctggccaacatcacaaaaccccgtctctactaaaaatacaaaaattagccagacatggtggtaggcacctgtaatctcagctactcgagaggctgaggcaagaga

SEQ ID NO: 137188 - DNA, 428 bp, Homo sapiens
tgaagtgtaagttggctaaggaaagttcccatggtcgcatagctggcacgattaaaaccagacagcccatgcctagagtctggactatgcaacccacaataccactttcctccccaggggatgatggcttgaaagtgctttgtaaactcctgaagtgctccagagagtgaagatgcctgtgtgtgggagactcagggctgatactggatgaagtaccacagtctctggctatttttagccaaacagggtgccctgtttggaggtaatgttcagacactctgcatcttccaagtgcagtggaatttttattttttatttttattctttggtcccttccctcttttctcatctggggaagcttccgagcttggtgaaaataagcctttttctgccagaccctggcagcctaccttctgagtatcttgcct

SEQ ID NO: 137189 - DNA, 303 bp, Homo sapiens
cattccagcaccaactccaaaatctccagttcagagtttcatctaaatcagatataggtgagactgaaagtatgactcattctgaggtaaactgctctctagcagtgaaacaaacatgttctgtgcttccaaaatacaatggtgggatgggcataggatagatatttccattttaaaagggagaaataggaaagaagaaaacagtgactggtcccaagtaagtctgaaacccaacagaggaaacaacatgaaatgttacggcttgagaataatcattggctcaatgttctgccctccaggccc

SEQ ID NO: 137190 - DNA, 284 bp, Homo sapiens
agatgactcaaagttcatggctgtatttagtccatgctaagtgcccaggattctcaacctctctagtctcaatgctagaagaggatgatattaaacttaactcatcccatgatattcctcagctgcagatagtggttcccctcatctgacccagctctggtacctcaacccaatagaacctgaaattttcacatcactttactggaatcggaacatctaggttttcatcctgcatgcattctacatgatcttgccaaatagtctctagatatgaaaacacttcc

SEQ ID NO: 137191 - DNA, 182 bp, Homo sapiens
attgaaagccatttctgcatctgttgagatgttcatgtggtttattttagttctgtttaggagatgaatcatatttattggttttgtatacgttgaactaatcttgcatcccaggaataaagcctacctgattgctgtggattagctttttgatgttctgctggatttgatttgctagtatt

SEQ ID NO: 137192 - DNA, 312 bp, Homo sapiens
aaacctgtaccgaatccataaaccaggaacccagactagccaccttaacccttacatagatctggacagctgtggaaataaaccaggaccaaccaagcaagacaagcaaagtctgtgtattctcagcaagggtgttggctgccaccacttgcatttgggcagaaactcaaaggcaggcaaaggagtgggaaagcgtcacagtggataaaaggggaggctgcaggtgtgtcctgagtggagattgttgatctgggggatgctggaggtggctgactagaaatgggcctcccatgtgattggttagggggatgt

SEQ ID NO: 137193 - DNA, 212 bp, Homo sapiens
catgtgggcagactgaggacaggtggggtggtgaggtcagctgcttcaggagagtggcagagacagagcagaggtcacatccaaagtctgaagccactggattttggtgccccccctgcttaagctgcagaggcagcctgggaggcccaaggccagagtcctcagattaaaaaacaccaagaggtaccagcagtccctacccaccccgcccc

SEQ ID NO: 137194 - DNA, 310 bp, Homo sapiens
agccttcagttccaggacattgtgggaccccagaggctgtcctgtccacttgccttctgaggacatcagctcggtgtccccagcctccgtgctgtgggcacagctgtggtttgggtgctgagcaaaggatgctgtagtcttggccctgtggagcttggctgttgggacaggaggtacaaaggggagtggtgcctgtggacacaggactagaccccaggacatcagggcctcgggctcatggtcctatcaccctggatggtatacgcagctgcacacgtggaattgctcaaacaattcaggcccaactttt

SEQ ID NO: 137195 - DNA, 440 bp, Homo sapiens
aaccactgtaccatgatcactctcgtaacagaaaataaattgacaagaaaaattactcaagaataaggctgggtattgtggctcatgcctgtaatcccagcactttgggtgttcgaggcaggcggattgcctgaggtgaggagttcgagaccaggctgaccaacatgctaaaaccccgtctctactaaaaatacaaaaattagccaggcatggtggcgggtgcctgtaatcccagctactcaggaggctgaggcaggagaatcgcttcaacctcggaggtggaggttgcagtgagctgagactgggccattgcactccagcctgggcaacaagagcgaaactacgtctgaaaaaaataaaaaaagttggaattttgattggaaaaagtaacacttcataagggaacgttttagtttgtattgatttcaattttgccaact

SEQ ID NO: 137196 - DNA, 256 bp, Homo sapiens
tttgcccaggctggtcttgaactcctgacctcaagtgatcctcctgcttcagctttccaagtagctgcaattacaggctcaagtcaccacacctggctcagagaggtctttttatgtcttcatcaggagactattctgaatagctaatacattcatatgttaggaaattcaaaaggcacaagacagtatacagtggaatgccccttccctgcctgggccacacagtcttactctccagcagccaacactgcttgtt

SEQ ID NO: 137197 - DNA, 360 bp, Homo sapiens
atatgctcagtaaatacaaactggtcaatgctttggaaggaaagaacaagagatgacagtttagatttgaagctagaaaatgagacacatttatttagtgatagtcatatggttctcacttacacagggagagctaaatttctgtaacaccaaaaattttcttataaaaatctctattttcattaaaaccataatagaaaattctaaaaaattggaaaaggagaaaaaaatcaccacttgttttatttttcttttagttccctctattctcctttaccccataatttaccatatcatagcatatatataacaccttgacactatgacattttggaccaggtaatctttgttgtaggcagc

SEQ ID NO: 137198 - DNA, 441 bp, Homo sapiens
ttcttaattgctcttcctccgttactcactagtgacagaatacaaccttcttataacaaaagaagtttgcactgactcccatccagagaaatctaggtagaataggggctacaaaacaatggtactcagggccaggaatttagaagttagatgaaaagttaagacaaatactaaatacctgccaaaggccccactgtctaataccatcccctttgagatgactatttcaacatatgaattttgggggaataaagcagtcagatgatagtactatacaaagcttgaaaaggtacaacacttcgccttttgaaacatctataactagaagccaaataacaaaggtctttgggagttgattaggtcatgagggtgacacctgcatgaatgggattaacaacttcattttaaaaaaggcctgagagacaacccttgccctttcca

SEQ ID NO: 137199 - DNA, 219 bp, Homo sapiens
tggtttcacagggataaacgttatgtcaaaactctttaaattatacacttctaaatgcttgcagtttattgtatgcccaataaagttggaaagaaatttaaaaggaaaagactatttttaaaagataggtaaatgggaatgcctgtatgtgactcaaatacaagcttgaatgttggtattcctgttcaaacagttgctttttttctgaaaaatacaagt

SEQ ID NO: 137200 - DNA, 742 bp, Homo sapiens
gtggttcttattttcgctcatgtgtgtgcagtgagtatttagagcataggatattgtgctgcccctgaaccttatgacttcccagaggtgaccaacgttttagctaaaaacatttagctaaatgtttgaatggaattgtgctttaaaataaggtacaacttgctgagcatggtggtgcatgactacagtcccagctactcgggaggctgaggagaaaggcccaggaattcaagtccagcctgggcaacatagcaagacacgtctctacataataataataataattaatacataaaataaggtacaagatgctgggggtaaagagagaagaggaggggcatcatgtcaagcctctccaggagaaaggacacacctgctggattgtgtgagggatttagaataggggcatataagggaacacagggcagtcaataattctacacaggcagcaaatttgatgctgaaggatgaccaatgtggatgccatgccacttaacgctactgttgcagccgcagatcctagtatttgaaatatgcctcaagaaggaaacacttaagaagtgctgaataagaattccaatcctggcttcatcgctaacttgctttgggaacttgggctttaatttgctcaaagcctcagtttgctcatctgtaaattggggcaaataacatctgttcaacttacctaccagaaatgttgtgtggctaaaaagaaatagaagatatgaaaatgctttggcta

SEQ ID NO: 137201 - DNA, 184 bp, Homo sapiens
tttgaccctaaataacaaaggcatctgccgtgaaagtttgccatgactgctgagatttcaggaataatataactggcctttctagaagctagaagcggtggtatgatgtgctgtgtcaaggaataaagagcccacttctccctggaagagtcacagatgtcttcaaagatcagcgtgagctgag

SEQ ID NO: 137202 - DNA, 383 bp, Homo sapiens
tgttcgacggagactctcttctttccatctggaactcttattggctaaactctagactttcagaattgatcttcaatgaattttatttttttctcctattttccattcacctgtcttttgtctcttctagttttttctttttccttttacaaacagattttttgaagcataattgacaaacaataaattgcatatgttttaagtatatgaattgatcagttttgacatagaaatacactcatgacaccattaccacaatcaagataagacatcagtcagcccccaaaactcccttctgtccctttgtaatctctccctcctgccccttcctagaccactttatctctttcctcccaggcaggagggagagtctccgtcgaact

SEQ ID NO: 137203 - DNA, 256 bp, Homo sapiens
aataattaggctgtgagagggtgaggacttgcccgaagtcacacagcccctgctggaaatgcacacagcccctgctggaaatgcgcacagcccctgctggaaatgctccttccctttccctactctcccgcgccttcaggtagagcgtttaagggattcccagcagttcccgagtacacgtggaggctgctccccggcgtgctggagcggctgcgggctcagtctgcggagggcgccccggtgaagtgtggagttc

SEQ ID NO: 137204 - DNA, 179 bp, Homo sapiens
aaagtattatctcttcagagaggtcttcaatctaaagtacagtcctttagtctaaagtaatgcctatcacgttaactaggcttctttttttttttttgatagagtctcgctctctcactctaggctggaatacagtggtgccatctctgttcactgcaacctgcacatcctgggatcca

SEQ ID NO: 137205 - DNA, 265 bp, Homo sapiens
cctgtatcttgggggcagtgaggggagaggtagggaaaacctgcagacatagaaactgtggatatagaaactgttctgaacccattttctgaactctgttctcaacaggtatatttgaatgttttcattgaacacatgactaactcttgtaatccccctcccctttttgatgttcaatagatgtgaagactactagcctaagtgaaaatatattccactattggtgaaagtaatgtttaacacttaatgagcgcttatatactgt

SEQ ID NO: 137206 - DNA, 442 bp, Homo sapiens
ccatctttttatcgttggcaggtgctcttgaaacagaatacataaaagaaaagaaaaaataatcaaaccaactctttatttttgcccttttgaatatattgtaggaaacagaagtttctgacattagtctactctgattcaattaaacaaataccttatgcttgctcaccaccaaaatgaggaagctgcttgcccacaaattctctaaaggaagattcagaagaaaaaggaattgcagttaatcctttcccaggtcacacctaaaataggtctctgctaatagggaagttagttgtgtttaaaatataaatatacattttagaatatgtcgaaggaatcattgataaaagagtagagtcagaacttcaagtccccattaaaggggctggaaaatacaagtacagtatagtattttccaaactgtgtcttagggtctgagaac

SEQ ID NO: 137207 - DNA, 209 bp, Homo sapiens
gctgaattgtccctgctgtgatctgaggccatgctgtgtgctttgcgcgggaaccccatcccctctcgcttgttagggacatcgctgatcaattctctctctcctgcagtgccagtatttcccaatcttgagctgaatcatgccttttagaatacaaacctgttgtaatttctcccatctgaaacaaaacttcttatgatcccacttcc

SEQ ID NO: 137208 - DNA, 449 bp, Homo sapiens
  misc_feature (141)..(141): n is a, c, g, or t
gctctgttgcccagcctggagtgcagtggtgcaatcttggctcactgcaacctctgcctcccaggctcaagcgattcttatgcttgagcctcccgagtaactgggactacaggtgtgggacaccacgcccagccccatttngtctaaattcttaaaggtactggtttaaggctgttttgtcatcctctctctttagagttttgcttttttaaagatgctcctcacagcgtattttgagacggagtctcgctctgttgcccaggctggagggcagtggcatgatctcggctcactgcaacctccgcctcccaggttcatgccattctcctgcctcagcctctcaaagtgctgggattataggcgtgagccaccgtgcctggcccagatggggtctttctgtgttacccaagctgatctcaaagctaagctggtctcaaactcctgggctt

SEQ ID NO: 137209 - DNA, 476 bp, Homo sapiens
cacctcccctatggatcacactcttctgatgtccatcactgtagattagttttatctattccttccccgccagccccctccgccccaagatggtatctcactctgccacccaggctggagtgtgattgcatgatgacaggatgacagttcacagcagcctcaacctcccaggctcaagcgatcctcccacctgagcctccctgttttgtctattcttgaattttaagtataaccaaacaggatgtactcttttgtgtctggcttttattcagcgtaaattttttagagtcatctgtgttgatgcatctatcaataggtagttctttttgtattttttctgagtaggactccattaccacaatttgtttatccattttgtaaatagctatgtgggtgtgttctagtttgggttcttacaaatagacctgctgtgaatactcattcacaagtcttttggtggacatttgcagtatttt

SEQ ID NO: 137210 - DNA, 429 bp, Homo sapiens
agcttgttcttccccccaagcctgagatctgctcttttcctacttctgaaaaatggctccctggtccctgattagtcaaatcatcatttttcaagatctaccctcaagtgaccctgtcaaataatcaggccctggacaatctttcccttttttgagtatgtggcaacttagaatctagagtacgacatattagacaattgatcaaattaattatctattcatgcttacttttaagtcttctctaaccagactattaatgaaggcagatcttgtctcttcccttcttatataccccacagtaccgtacattttggctagatgatttaataatttttgagagaatcaataccctggtccctggccacagggcagagcacctcctcattcatgagattaacttggacaatgagacccaaattctggctaggc

SEQ ID NO: 137211 - DNA, 314 bp, Homo sapiens
aagataaggagaaaataagatggttttaggctgtcataagtgctatacaggaaatgagacaggtggatgtgataaagtgacttaggtggtgtctttagaaagggtggtcaggtaaagcctctattttgtgtcttcccaactctaaacgatacaccgtggattcctctcacctcagatgtccatttggaatcctgctgtattcttccaccccagagatgttctagctgaatgatatcctagcctaagaggctgcccttgctgaagtagcacatactgagtacctttcctggagactgagtgtctcaacagtggca

SEQ ID NO: 137212 - DNA, 368 bp, Homo sapiens
tgactcttgaggatcccctgcgcgtctgctatatctacatttctaaagggaagactgaattatttttctattctctcaatagagaatattgcaaaatgttattggaagagatgatcaaagagtgtgcaaccaaaaaatataggagaattatttcagaggtatggcaatcagttaataaaaatatttgttttttaaacacttcatatttgtagtatttatagcttttaaaaatttgttgtttgtatgatactatttaaaattttttttccagagatgagatctcattctgtcactcagtctggaaagcagttgcataatcataactcactgcagccttggagtcctaggttcaagcagtcctctagagt

SEQ ID NO: 137213 - DNA, 842 bp, Homo sapiens
catggggcaccatctggagctgggaggcctcggattccatcgtccttggaggtgggtgtgtgggtggccttggtgagaaaagaggcctttcctcctccaggaacaatactcaggctcacaaagaggcagacccactcaggcacccactgcatgccccaggccctcaggatgcacagggggcttggtgggtgggggcctaggctcagaaggcccagcccaacctggctttgattcctggctcttcaacatgtgtggtaggagctagagctgttcccttcacttctgtgagtctcagtttcctcggctataaagtggctatgggattctgtcttggcataaacattgagtgtgatgggggaggcagcgtggtggtggagctctgggagtgtgacctgcagcaagccattctcacctctgtgagcctcagctcatctgtaaaatgagatgagaataataatgataataatacccacttcatggagtatttgaagattcaacttgctgttgtgttgaaagtgcctataataatgaaaggcttaataaatattggaacgtattggacagggtgtggtggctcacgcctgtaatcccaacactttgggaggccgaagtgggtggatcacctgaggtcaggagttcaagaccagccaggccaacatggtgaaaccccgtctctactaaaaatacaaaaattagccaggtgtcctggcacgtgcctgtaatcccagctacttgggaagctgaggcaggagaattgcttgaacccagaaggtggaggttgtagtgagccaagattgtgccactgtactgcagcctgggtgacagagcaagactccgtctca

SEQ ID NO: 137214 - DNA, 202 bp, Homo sapiens
tagatttagaaattaaaacgaaaccctaaagttattggaagagaatgtagcagaatacatttctgccttaagagataacaggaaaaaataaagcaaagtagaatttcaccaaagttatcaacttctgctcatcaagaatcaccatgagaaagtgagaaggtgagccacagactgggagaagataattgcactgtgtttacct

SEQ ID NO: 137215 - DNA, 315 bp, Homo sapiens
gcctcctcagaccacagatagtctttcccccttcccagtgtacatcgcaaatcactgctgatttcactaagctacctttagctctggagttggagtgagaaacttttgtttccacttcatgggatatgactccatcacaatgaaaatgggtccagtaaaaggagcagttttaaaaattaaggtcaatacattttcagtgaaatgctgttctctcttttcttattctctcctctctttctctccttcctccctcctttactcatttcctttccctatttttcttctgatctcaaaataaattcagaaagaaataaa

SEQ ID NO: 137216 - DNA, 335 bp, Homo sapiens
cccccaactcttgtcccccagctcacctctccagaaggaccactcctagtagtttcttgggtatgccctccagagacagtcctcacaaatatatgaaaacacatacataatattctgcactttgcttttcacataacactggggtggagatctttccatattatagcacagaggttcctcactgttcctggctgtgtcagccactgaggtacactggggtggtagggtggtgaaccccaactccaaggggacagaagctcttgcacttgggacccttccagaccttgccctatgcacctcttcatagggtgttcatctgtatcctttataatctc

SEQ ID NO: 137217 - DNA, 288 bp, Homo sapiens
gacttcgcatgtcagtacccgcagtgaagggggccaggcccaactggctcctgtacatgcgtgcgtgcgtgtgtgtgtgtgtccctggctacagaaggggcagagggcaatcttgggggcagagggcaatcttgtttgaccgggccacatttattaagtacttaggactgtgtctagcacataataagtgctcaataaacggagatgccatgatcatttgtagctagttacatacccaatatccattcttcctatttttttccttaataacagattcagatcgtgctg

SEQ ID NO: 137218 - DNA, 463 bp, Homo sapiens
aggagaaatgcaatgtactgaatgtttatgtccctctgaaatttgtacattgaaatactgacccccagtataattgtattaggagatggggcctttgggaggtaattaaatcataagggtggtgccttcatgaatgggattagtgcccttataaaagagactccagagtgctcttttgttctttctgtagatggcagtctgcaaaccagaaagggccctccacactggcaccctgatctcagacttccagcctcccaaactgtgaggaataaaattctgttgcttataagccaccctgtctgtggtactcttatagaaactgactgactagaacaggaggtcagtactattttagttttgcagatggagaaattgagacacaaaggtattaagtaacacactcaaggtcacatatgtaatttctagggtccaggattcaaacccaggtaatgaaagtccacac

SEQ ID NO: 137219 - DNA, 557 bp, Homo sapiens
aaggtgattttcaacaggtatacgtgaatgagtcttgagcctttctgtctgggaatggaggagcatttgctgagtgtttattctgagtgcactgggcggatgtgagaagggaataagccatggtctcttgcctctggcagtttctagcctgtgttaccacataataactcaatgctaagctgtgactgtaagtgctacagggatcgagggaagggagaggtggagtgtgcagcagtggcagctaagaaagcttacacaggaaatggaaccaaccttacagaaagccaagcctagaaccgagttaggctggaaggaatggtgagactattccaggtggggtcagtggtaccaacatgacagaagccacaatgtatttaggggtcaatggacagatgggcctggctggagcagaagatatatgggaaacttggagtgaggaaaggttagaaagcagaatagcatcatggaaggagcatgggacagggaatctggacatatggattctgcttttagttttgctactaactagttttcgatgcaggctctgtggaaaagta

SEQ ID NO: 137220 - DNA, 122 bp, Homo sapiens
gcggatactacacacacaacacacaccacgcacacacaccatacaccatgtatgcacacagacaccacacacaaaatataccatgtatgcacgcagacaacacacaccatgtatacacacac

SEQ ID NO: 137221 - DNA, 453 bp, Homo sapiens
gcagactacagctatgaaataccgcaaaagtgacctcagatcatgcagactacagctatgaaataccgcaaaagtgacctcagatcatgcagactaaagctatcaaataccgcaaaggtggcccgagtagaatggtgaatgaacatctgttcacgcccactcatatgaaatgaacagttatgaaaatttctccccatttgcttcatctgtctccttttcttttcctttgctgaacaaattttaaatactttaaacaaatattttaaaacaaatcccagctatcctgtcctttcactctatgtatatccgtctgcatgcctgaaacagcatgaacacctccctacatgactgccatgctcttaacacagctcattaagtgatcagtaattccttggtgttatctgacacccattctatagtcaaatgtgttctcagttgttgcataaagatctt

SEQ ID NO: 137222 - DNA, 142 bp, Homo sapiens
gacgaggactccccagcaccgggggatccaggcggccgtggcttgcagagaagcagggtgggggcaaggagggtgggggcccagaggggagatcagaccgctcagccgagaccagctcccctccttcgccagctcccacccc

SEQ ID NO: 137223 - DNA, 386 bp, Homo sapiens
cagaaaagagtccacggagtaaggcaaatggggtgaccatgcaagtaccctgcaatgggaatcagcaatggggagtgcggcagccgcagaacagagaagggagggctctctcctgcaaggtccacctctcactaaaaaacaaaagatctgaggctcacctacaatccacctaggaccaccctctctcctggccaaggcaagagctgggggcggctctcccaccctctagctcagcatggacccgggatttccttttcatcaaggcagccctggctgttcatctcagccggatttttctctttatgacatccataaggccccagggtggcacctgcccccaaaggctggcttccttcagaagagtccctgactgccccataaacttc

SEQ ID NO: 137224 - DNA, 422 bp, Homo sapiens
atctgctcacctcagatactcagttgctacagcagggggttggttggctttttgctttatgaagaggtctggcgcagactacacacacggccacagatgcccacacttcttcattagcaagcccacctgtctcccctgcccccaggagagcttcagaggtggaacatttgggtggacgagtggctgggaacgctggtgcctcaggactcagggagcctgacgcatcagtgccagagtcggctgcaagcaaagagcgtcacacgcgagcagcaaggacagtttattctgagcgactgaaaatgttatttgtgtattaaaaccaaaaccaatgcataatatgccataaagtcaattatcgtcatcagttgttaggataaaactgcgatttcaatgcaatttcatctttgcactgggcctgttcg

SEQ ID NO: 137225 - DNA, 312 bp, Homo sapiens
gtctcacaggagtagaactaggtcttttggcccttagaccttagatgcctcttcttagatgtggtggctcacaatatccctattgtgataatatcttactgactttcatacaattctttttatttgagaaacatcttttgtcataacctcccttaatgatcacaatgggaaaaactttgtgttgctatttggggctgagctttcttgtcatcacaaagtagaaatgagacaaaattcttcactctgaattccaagagctcttgatgaaattcgaaggttgggggcaagggctggatgacttgggatttggtg

SEQ ID NO: 137226 - DNA, 186 bp, Homo sapiens
actcacatatcgcatacaataccctatattggcctattacatcactaccacagaaagtagctgtagttcattgctggggccaccagaagggtcaagatgaaattgctcagagaaacaggagggctgaccaagcagctagggccaccaccatctctgggaactttttttttttttttttttgagacg

SEQ ID NO: 137227 - DNA, 687 bp, Homo sapiens
  misc_feature (266)..(266): n is a, c, g, or t
actgttactcccttgaatttataaacaaggaggctcaaagagctgaagattaaagagatgaagtatctaggctaaggtcacagagctagcaaatgacatatgctagatctaagcccaagtctgactctaaaattctgctttcttcatttagtttttctgccattcaaagtttactgccagctcctccaggaacttctgagtaagcctgtctccaaattgcccctaactcctcagtgccagtcatgggccaggcccctgggggactnggaatgagtaaaacatgcacctattgttaaggttcacctggtccagaaggggaggcagacccacctgcccaccatgacccggacagaggcgataaatacggagcacctcatggccagggcctggaggattcccaccataccctacccaacgccaataacagagggaccctggagttgtgtacacaagatagcagttcagtgcttgcacacatactagttgagaagggaaatcaaggctaatgaaacagctcaactgtctggcagaaccaggctccttctgccctgaaacagtttggatgtttggccctttctaatcttatttggaaaatttgatccccagtgtttgaaagtgggggcctggttgggagatgttcccggtattcgggaatggatcccttcatgaattaggcctggtgcccat

SEQ ID NO: 137228 - DNA, 2684 bp, Homo sapiens
  misc_feature (1330)..(1330): n is a, c, g, or t
gcggccgcgaattcggcacgagcagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgctgctgatgacccagattcctccatggtcctcctgtgtctcctgttggtgcccctcctgctcagtctctttgtactggggctatttctttggtttctgaagagagagagacaagaagagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctatanaaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacgtgctgtctgccctcatgaaattggctccaaatgaatgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaaggacaaggacctccagccaggcttcatttatgcacttgtgctgcaaaagaaaagtctaggttttaaggctgtgccagaacccatcccaataaagagaccgagtctgaagtcacattgtaaatctagtgtaggagacttggagtcaggcagtgagactggtggggcacggggggcagtgggtacttgtaaacctttaaagatggttaattcattcaatagatatttattaagaacctatgcggcccggcatggtggctcacacctgtaatcccagcactttgggaggccaaggtgggtgggtcatctgaggtcaggagttcaagaccagcctggccaacatggtgaaaccccatctctactaaagatacaaaaatttgctgagcgtggtggtgtgcacctgtaatcccagctactcgagaggccaaggcatgagaatcgcttgaacctgggaggtggaggttgcagtgagctgagatggcaccactgcactccggcctaggcaacgagagcaaaactccaatacaaacaaacaaacaaacacctgtgctaggtcagtctggcacgtaagatgaacatccctaccaacacagagctcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagatcacataaaaaaa

SEQ ID NO: 137229 - DNA, 2588 bp, Homo sapiens
  misc_feature (1234)..(1234): n is a, c, g, or t
ggaagtggcttcatttcagtggctgacttccagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgctgctgatgacccagattcctccatggtcctcctgtgtctcctgttggtgcccctcctgctcagtctctttgtactggggctatttctttggtttctgaagagagagagacaagaagagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctatanaaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacgtgctgtctgccctcatgaaattggctccaaatgaatgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaaggacaaggacctccagccaggcttcatttatgcacttgtgctgcaaaagaaaagtctaggttttaaggctgtgccagaacccatcccaataaagagaccgagtctgaagtcacattgtaaatctagtgtaggagacttggagtcaggcagtgagactggtggggcacggggggcagtgggtacttgtaaacctttaaagatggttaattcattcaatagatatttattaagaacctatgcggcccggcatggtggctcacacctgtaatcccagcactttgggaggccaaggtgggtgggtcatctgaggtcaggagttcaagaccagcctggccaacatggtgaaaccccatctctactaaagatacaaaaatttgctgagcgtggtggtgtgcacctgtaatcccagctactcgagaggccaaggcatgagaatcgcttgaacctgggaggtggaggttgcagtgagctgagatggcaccactgcactccggcctaggcaacgagagcaaaactccaatacaaacaaacaaacaaacacctgtgctaggtcagtctggcacgtaagatgaacatccctaccaacacagagctcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagatcacataaaaaaa

SEQ ID NO: 137230 - DNA, 2371 bp, Homo sapiens
  misc_feature (1017)..(1017): n is a, c, g, or t
ggaagtggcttcatttcagtggctgacttccagagagcaatatggctggttccccaacatgcctcaccctcatctatatcctttggcagctcacagagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgctgctgatgacccagattcctccatggtcctcctgtgtctcctgttggtgcccctcctgctcagtctctttgtactggggctatttctttggtttctgaagagagagagacaagaagagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctatanaaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacgtgctgtctgccctcatgaaattggctccaaatgaatgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaaggacaaggacctccagccaggcttcatttatgcacttgtgctgcaaaagaaaagtctaggttttaaggctgtgccagaacccatcccaataaagagaccgagtctgaagtcacattgtaaatctagtgtaggagacttggagtcaggcagtgagactggtggggcacggggggcagtgggtacttgtaaacctttaaagatggttaattcattcaatagatatttattaagaacctatgcggcccggcatggtggctcacacctgtaatcccagcactttgggaggccaaggtgggtgggtcatctgaggtcaggagttcaagaccagcctggccaacatggtgaaaccccatctctactaaagatacaaaaatttgctgagcgtggtggtgtgcacctgtaatcccagctactcgagaggccaaggcatgagaatcgcttgaacctgggaggtggaggttgcagtgagctgagatggcaccactgcactccggcctaggcaacgagagcaaaactccaatacaaacaaacaaacaaacacctgtgctaggtcagtctggcacgtaagatgaacatccctaccaacacagagctcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagatcacataaaaaaa

SEQ ID NO: 137231 - DNA, 1238 bp, Homo sapiens
gcccgcgttctgccccggaagtctatgcgtttgagaccacggaatggccggggagtcggtcacagcgcatcctcgcctgcgtgatacagaacttcatgcctgaggtcatctcagtgcagtgtctgcacaatgaggtgcagctcccggacgaccggcacagcacgactcagccccgcaagaccaagggctccggattatttgtcttcatccgcctggaggtgaccaggccgaatgggatcagaaagatgagttcatgtcccgtgcagtccatgaggcagcgatcccctcacagtctgtccagcgatcggtgtcgtaaatcccggtaaatggggtggtcctgcctccttccgctcgccagcgcgtccaggcttcatttatgcacttgtgctgcaaaagaaaagtctaggttttaaggctgtgccagaacccatcccaataaagagaccgagtctgaagtcacattgtaaatctagtgtaggagacttggagtcaggcagtgagactggtggggcacggggggcagtgggtacttgtaaacctttaaagatggttaattcattcaatagatatttattaagaacctatgcggcccggcatggtggctcacacctgtaatcccagcactttgggaggccaaggtgggtgggtcatctgaggtcaggagttcaagaccagcctggccaacatggtgaaaccccatctctactaaagatacaaaaatttgctgagcgtggtggtgtgcacctgtaatcccagctactcgagaggccaaggcatgagaatcgcttgaacctgggaggtggaggttgcagtgagctgagatggcaccactgcactccggcctaggcaacgagagcaaaactccaatacaaacaaacaaacaaacacctgtgctaggtcagtctggcacgtaagatgaacatccctaccaacacagagctcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagatcacataaaaaaa

SEQ ID NO: 137232 - DNA, 1351 bp, Homo sapiens
ggaagtggcttcatttcagtggctgacttccagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgctgctgatgacccagattcctccatggtcctcctgtgtctcctgttggtgcccctcctgctcagtctctttgtactggggctatttctttggtttctgaagagagagagacaagaaggtagagcgtgtactatttttgtcctcacccacattcatgtttttctccttcactgattcaacaagcacatatagagctgtgtgccagacttggcatgaggtgttgaagatgcagagatgaagaagccacagtctctgccctcaagaagcatacagtcagcctgtgtccaatacaaacaaacaaacaaacacctgtgctaggtcagtctggcacgtaagatgaacatccctaccaacacagagctcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagatcacataaaaaaa

SEQ ID NO: 137233 - DNA, 411 bp, Homo sapiens
gcaatatggctggttccccaacatgcctcaccctcatctatatcctttggcagctcacaggtgagtccggccggattctcttccactctcctgtctaccccatcctgaatagttccaggtttcttgttccactctgggcctctggctcaactcgggaggctctgtgttctcatctaacatttgctttttatcaatctctgatctctgattctcaggtcaggaagagactagagagagggggaaaaatggctctgggaactgactcccctgttgactgtcccagggatgaaggagctgaaagaagtggtgctgggtatcagagaccatttttctaatccaggttctgccatgagttagataaggaatgttaaagttttcctgggcctcagaaactttatcttctagccttct

SEQ ID NO: 137234 - DNA, 514 bp, Homo sapiens
tcagttaaactactaatgcagtagctttaaggcttattccttcacagagtacggttggcagcagtaatggtatctttctgtctcctttttcttcctctcccaaacagatccaaaaagataagaatcattaaagcagtttgcttagtaatagaaaaggttggtttagtgaattattacaactgaacaaggaaagttcagttcattaagcattcagcaagataaatatgcgttaaacttacagaatagtttctctaagctaggggtgattaaaatcaaacagtgggagccagcatgccagccgatttgggttgggtaaccttggaaataaagtttcctggatgtcagggtctccatggacgatccagagccctgctcacctccctcactctactttctttttgtctgtcttcagatggaaaatccccactcactgctcacgatgccagacacaccaaggctatttgcctatgagaatgttatctagacagcagtgcactcccctaagtctctgctc

SEQ ID NO: 137235 - DNA, 2737 bp, Homo sapiens
  misc_feature (1330)..(1330): n is a, c, g, or t
gcggccgcgaattcggcacgagcagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgctgctgatgacccagattcctccatggtcctcctgtgtctcctgttggtgcccctcctgctcagtctctttgtactggggctatttctttggtttctgaagagagagagacaagaagagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctatanaaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacgtgctgtctgccctcatgaaattggctccaaatgaatgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaaggacaaggacctccagccaggcttcatttatgcacttgtgctgcaaaagaaaagtctaggttttaaggctgtgccagaacccatcccaataaagagaccgagtctgaagtcacattgtaaatctagtgtaggagacttggagtcaggcagtgagactggtggggcacggggggcagtgggtacttgtaaacctttaaagatggttaattcattcaatagatatttattaagaacctatgcggcccggcatggtggctcacacctgtaatcccagcactttgggaggccaaggtgggtgggtcatctgaggtcaggagttcaagaccagcctggccaacatggtgaaaccccatctctactaaagatacaaaaatttgctgagcgtggtggtgtgcacctgtaatcccagctactcgagaggccaaggcatgagaatcgcttgaacctgggaggtggaggttgcagtgagctgagatggcaccactgcactccggcctaggcaacgagagcaaaactccaatacaaacaaacaaacaaacacctgtgctaggtcagtctggcacgtaagatgaacatccctaccaacacagagctcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagatcacataaaaaaaacatgtaggacgtatagatgcggccgattcgagtttactgggcctttgcctat

SEQ ID NO: 137236 - DNA, 2667 bp, Homo sapiens
  misc_feature (1313)..(1313): n is a, c, g, or t
tgcaggctggtacggtccgaagggtagatcatcatgcctcaccctcatctatatcctctggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgctgctgatgacccagattcctccatggtcctcctgtgtctcctgttggtgcccctcctgctcagtctctttgtactggggctatttctttggtttctgaagagagagagacaagaagagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctatanaaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacgtgctgtctgccctcatgaaattggctccaaatgaatgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaaggacaaggacctccagccaggcttcatttatgcacttgtgctgcaaaagaaaagtctaggttttaaggctgtgccagaacccatcccaataaagagaccgagtctgaagtcacattgtaaatctagtgtaggagacttggagtcaggcagtgagactggtggggcacggggggcagtgggtacttgtaaacctttaaagatggttaattcattcaatagatatttattaagaacctatgcggcccggcatggtggctcacacctgtaatcccagcactttgggaggccaaggtgggtgggtcatctgaggtcaggagttcaagaccagcctggccaacatggtgaaaccccatctctactaaagatacaaaaatttgctgagcgtggtggtgtgcacctgtaatcccagctactcgagaggccaaggcatgagaatcgcttgaacctgggaggtggaggttgcagtgagctgagatggcaccactgcactccggcctaggcaacgagagcaaaactccaatacaaacaaacaaacaaacacctgtgctaggtcagtctggcacgtaagatgaacatccctaccaacacagagctcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagatcacataaaaaaa

SEQ ID NO: 137237 - DNA, 2468 bp, Homo sapiens
  misc_feature (1114)..(1114): n is a, c, g, or t
ggaagtggcttcatttcagtggctgacttccagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaagagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctatanaaatgtaaatgcaaggtcacacatattaatgacagcctgttgtattaatgatggctccaggtcagtgtctggagtttcattccatcccagggcttggatgtcaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacgtgctgtctgccctcatgaaattggctccaaatgaatgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaaggacaaggacctccagccaggcttcatttatgcacttgtgctgcaaaagaaaagtctaggttttaaggctgtgccagaacccatcccaataaagagaccgagtctgaagtcacattgtaaatctagtgtaggagacttggagtcaggcagtgagactggtggggcacggggggcagtgggtacttgtaaacctttaaagatggttaattcattcaatagatatttattaagaacctatgcggcccggcatggtggctcacacctgtaatcccagcactttgggaggccaaggtgggtgggtcatctgaggtcaggagttcaagaccagcctggccaacatggtgaaaccccatctctactaaagatacaaaaatttgctgagcgtggtggtgtgcacctgtaatcccagctactcgagaggccaaggcatgagaatcgcttgaacctgggaggtggaggttgcagtgagctgagatggcaccactgcactccggcctaggcaacgagagcaaaactccaatacaaacaaacaaacaaacacctgtgctaggtcagtctggcacgtaagatgaacatccctaccaacacagagctcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagatcacataaaaaaa

SEQ ID NO: 137238 - DNA, 958 bp, Homo sapiens
ggaagtggcttcatttcagtggctgacttccagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaatcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagatcacataaaaaaa

SEQ ID NO: 137239 - DNA, 497 bp, Homo sapiens
aagcctgtccaccctgcaaagactcctcgggcagcatgcgggtcccgcacactgcacccatttcctggatgtcccctgcaggcgcgggaggccatccgggcctgctggctgcggccccctctcagccaggcctggctcagcccactgcgtgggaggtcaccggccactccccgaggagctgggatccccgggatgcaggcccacagtgcggggctgcacccatgatgcggagctggcctccaaccctgcgggccgcgccaggcaccaactcagtgtttgtcagtgtttgtttttccaagaaatggttcaaattgctgctcagatttttaaatttactgtagctgccagtgtacacgtgtggaccccattttatttttacaccaatttggtgaaaatgctgctttcctcagcctccccacaattaaactgcacatggtctctaaaaaaataaaaataaataaataaataaataaataaaaagtatcttttctccccaa

SEQ ID NO: 137240 - DNA, 457 bp, Homo sapiens
atcaccgaaagtgagatacaccctaaagaggaaaagcaatttgcagcacgttgaactcattctggtggtcacactgttggaagctctgctggagctgtcttctgagaattgtatggggaagcccaaagcaaatgaggaattatgttcgtgtccctgagaaccgtgactgctagagagatgaccaatgtaccacatgagcctggggcatctgtccatctttatctttcctgtgacatcagaaatccaggaagtggtcaatgtcatgtcaagagaacacagaaggcttcctgaaatgcttccacacgcagaagatgggatcactggagcatccataacagctttcaccgcaatgcaccatgtacatttaatccagagagttcacaatgatctaaaactaattagtcaattttaaacggagtctactaaaccaaaacttgttatttttacgattagtaaa

SEQ ID NO: 137241 - DNA, 182 bp, Homo sapiens
tgtgacttaatggtaattaccaatttctcagtgtaattcttggtatttttttcatactttagagaaggaccagccagccattctcatattctgttaaaatagcttgtcctctcttaactgctgctatgtgggccaaaaaggctagtattgcattgccaaccaagagggctaagccaaggcaa

SEQ ID NO: 137242 - DNA, 579 bp, Homo sapiens
cccagttcgacggagactctctcttgctgccagcatctgcataagatgtgactgctcctcctgccttcctccatgattgtgaggcctccccagccatatggaaatgtaagtccaacaaacctctttcttttgtaagttgtccagtcttgggtatgtctttatcagcagcatgaaaatgaactaatacagtgtctatgtgacaatatacccaaattattaacatttcaatatataattcatgttaagttattgcctagctaatttacaatctttttttctactaaatgtatatattttatacttacagcacactttggcttggactagcaacatttcaattgctcagtaccctcgaataactagtggctactagttccacagttagagaacacaggtggaaaacacacagaaataaaaaactttttaagacgaagataatgcttctttaggtaaaagtatgtgaataccattactttagccactctcttaataagtacttttattacagtacagtggataaataagtacagtaataaaagtacttattaagagagtctccgtcgaactagttcgacggga

SEQ ID NO: 137243 - DNA, 464 bp, Homo sapiens
cgagtcgctctagagtgatcccgactgcatacaacgccgcaggctatgacacatataccattcctgcctgtgctagaggattgcctttaattgcttgctggagcacatatgcttttccctatggtagataagccttgggtctgggagtaagagtgcagagatctacctgtcttggtgccacccaaggtcatacctccgtctgtaagttcccctttcatggaacacaaggtaaacctcacaaagtataaggcagatcttttcccatttcctgcatgtcttctcaatacctgtgattgaaacatgcagtggaaatatccatgcccgtcttgatggatgaagctaactggctggtaggtcgaagccagttcgaggaacaggctaggaggtctgcatggaacctgggattggccatcccctcatgagggctctaatgggaagatgatgccttgggtgtgcctggatgc

SEQ ID NO: 137244 - DNA, 352 bp, Homo sapiens
cgtacacaagcaggaacaaaatctaactgtagatgcaaactggaaacagtcatgcgaaaagaattatttcaaatacctctgaaccctgggattctaactgactgtcagtgataaatgcaaagacaaacagaccggatggacaccttcagcctcagtctgaccaacacagtgaaaccccgtctctactaaaaatacaaaaaagtcagccaggcacctgcaaggctgctgctaagcgtcagtctcactatcaccagccactatggggcatcttgtgtgtgctgcaggaagaacttggtgtcaggagccgaacttcgcaggaccgagagaaacagagccttctgtttttacacat

SEQ ID NO: 137245 - DNA, 427 bp, Homo sapiens
tggattctggagccgcctgccagcaagcatgccagaaccagaaaggaacgccccttcctcctgcagtgtctttcagacatccactactggcaaagcttaacattgttctggcaaggaaaaatatttctatagcccaggtctgcttttgcagagtgaaaaaatggtgaataaagggtgaatttggaacttaggggcaatacattgataactagcacatagtcttctaagagttttaaagttaattttttaaaatgtaagtcatttatctaagactgactttgctgtgagatagggatataatacttttcaaaatttttatttatttatttattgatagagacagagtctcactctgtcacacatgctggagttgagctgagattgtgccattgcactccagtctgggtgacacgagtgaaactccact

SEQ ID NO: 137246 - DNA, 235 bp, Homo sapiens
cgccaagaggggcatgtgggtttttgatctgggaggcggtcctgtgggacttagggtgttgtcatcattgtccccagcagaaaccagtgcagtggggaagtggcttctgggctgaagcctggttggaattcgggttcctagttctgagtccatgccctttgtagtaccatggttggcagtggtggaggacgccacagggtcagatgcccgcggtggggttcctagtctcacttcc

SEQ ID NO: 137247 - DNA, 450 bp, Homo sapiens
attagtcagggttctccaaaaaaaaatcaataacgtgaattggtgtacataattatggaagccaagaagtcctacagtcttccatctgcaagccagagaaccaagaaagccaggggtatagtttagtccaatgtttgaaatctgagcccaaagacctgagaaccataggtgccaatggagtaggtcctggtccacgtctgaaggactgagaacctggagcaccaacacccaaaggcgggaaaaaattaatgttccagctcaaaaagagagagtgaatttacccttcctctgcctttttgttctgagtcctcaacagattagatggtgcctgcctatgtcaatgaaggcaatttttctactcagtctactgattcaaatgataatttcttgaaaacaccctcacagacatgcccagaaatcatgtattaccagctatctgggtacccccct

SEQ ID NO: 137248 - DNA, 342 bp, Homo sapiens
gaaatgtaccacaaagttttacccaaaccactgacttcactctcttaatagatccccatgtatgtttttcttccctgccccaatctgaaggaggtgaaattgggaggatgcaaagaggtagaaaccacgtgtaataaaacagatgtaatggaagaggcacagatagaggatactgtttttacaaggcaggctcttttattattattattattatactttaagttttagggtacatgtgcacaatgtgcaggttagttacatatgtatacctgtgccgtgctggtgtgctgcacccattaactcgtcatttagcattaggtatatctcctaatgctatccctc

SEQ ID NO: 137249 - DNA, 737 bp, Homo sapiens
gtagctactctgcctctgacatccttcaacgtttattatgcagatgtgtatttgttaccaactacataaaattgaaaacaaatttatcatgcattacccaagctttcactggcagggctatctggtcacccctgtgccatgcccatcaaggtgaccagtagcatacggctagagtctgtggtgagaccatcccattgccaacactggcactcaccaccctttaatcagagcctactaagagtggcagccagagagaggggaaacacctgccacattatcaagctttggggtttgctggtacagagactaacgagatacaagctaagatacaaaaataggaccaacaaaaatgctaggctatatttaaacaagttttagcatgtgtaatgataccttcttaacaaaattggattttttcttttgtacttttggtaatttcttttcctgtaggatagcttcttctatttattaattgtataaatcaatgggaaattaggctacatatttacaatgtttatttacatatagtctttgaagaaaaatcagtttagttaattaaggcatccttactattaattgcattattttagaatgttacatccttatctttgtataattatacttcaggaaaacataatgtcaagttgtaaataatggtggacaagtgaataacaattatattattatgcttgaagtttataaagtgtaattaaaagactttatttgaaaggcatact

SEQ ID NO: 137250 - DNA, 567 bp, Homo sapiens
atattcgacggagctctctatgcaggctgcaagttttctgactagcagcacctttcacagccataattattatttggacaatgtttaatgtttcttccagttgtctcatgaagcagggactaaacaccgggctgacattcaccagtgtatactcagcatctctcatgaagtgggcactcaataaacagttgaaccccaatttacctatgaagaaatgaagttcagtgtgtttaatgacttgcccagagtcacctggcttgactgcggtagtcagatttaaatccaggtcacctagttcagcatctattctaggggctactctggggaagggaggatatcaagactttcaagtgggttgggacagggctaccttctatgcttacagttgcctggtcccgagtggtaacagagttgctcatagcacaggggtcactttggaaagcaggactgagaagccccagcctaccaggggaattcataccacctgcgccagagccctcatgggccctgaggaagagcagaatggctcagcccaggcatactagatcccatcatgcagctccctca

SEQ ID NO: 137251 - DNA, 316 bp, Homo sapiens
cctgctgtcaccaggaagggacatgtgccccgaggcggggctgatgtcactgctgcaccctggtggggcgcaccagcccacggctgtgccacccgggaggtgcccttttgttggagggcatttgccaaaaccagcaaacttgggttctcattctgtggccttgaggggtcagggggacagaagtcaagggccagtcctgcccaaaatggggagcattatagaaaacccttcccaccttaagctgaaaacctaaaggtctacactcttagggtaagaatgaaacggaattagccctgctccctccacacgaaagaca

SEQ ID NO: 137252 - DNA, 534 bp, Homo sapiens
acccttcctccttttcaccatctgccaagtggagtgtatgactttgtgtttccacattttctcctttcatcctctgaattctctacaaagttagagactgcagagaaacagaggggtgttcaaggagttagggagtttaggatgggatgcttagggataggcctgcagagttaagagactgccgtaggtaccctggtgtttgtttttctttacctgaagcatttgtagccaaggaagttatagtagagggattctgtcaattcacatctacttgcagttatatggcattctatagagaagcgcatgattttttattatagcatggctgccaagcaacaagctggttttctttcctacatctttggttttcagtttgctgacactccatcgaaggcacttaattttaatgccaaatacagaaacacaaaggacatgtgacaatggtaagagggtggggttgttgtgtcttatcgctattgtaggttgtggaatcttcttattaaaacttacattatacaaagtacaaaaacaaaa

SEQ ID NO: 137253 - DNA, 603 bp, Homo sapiens
acccttcctccttttcaccatctgccaagtggagtgtatgactttgtgtttccacattttctcctttcatcctctgaattctctacaaagttagagactgcagagaaacagaggggtgttcaaggagttagggagtttaggatgggatgcttagggataggcctgcagagttaagagactgccgtaggtaccctggtgtttgtttttctttacctgaagcatttgtagccaaggaagttatagtagagggattctgtcaattcacatctacttgcagttatatggcattctatagagaagcgcatgattttttattatagcatggctgccaagcaacaagctggttttctttcctacatctttggttttcagtttgctgacactccatcgaaggcacttaattttaatgccaaatacagaaacacaaaggacatgtgacaatggtaagagggtggggttgttaattttataaatatagttagtgggggaaaattatatttacaaatgcatttaataagactctggtattttgaattttaacttcccctcaatattaactgctactctttttgggaaactccaaagggaagcactgtttaagaa

SEQ ID NO: 137254 - DNA, 254 bp, Homo sapiens
gtaatcctagctcctggggaggctgaggcaggagaatcgcttgaacctgggagatggaggttacagtgagccaagatcgcgccattgcactccagcctgagcgacagagtgagactgtctcaaagaaaaaaacaaaaaaaaaattgagttatctttttttcttactggtttataggagctctttcctaagtgctttttattatggttttaattctttggaaattggccgccttagtgccgtttatggaagctag

SEQ ID NO: 137255 - DNA, 762 bp, Homo sapiens
atcagttaccatgctctttaagttttaccttctaactatctcttgaatcttcccccttctttatgcccacttaatgcagatccttgtcatttctctcctgggttcaaaaaggtaattatttgagtgccccttaagtgtcaggccctgtgctagacactgaggatacagtggtaacagtatttgccttcagagagctcagtcttcacagtaaaggcagacactaaataagaagtcacagcagaacagaggttgctaaactgtggcctggagctaagaatgggttctgcatttttaaagggatataagaaaaaggagagtgatagcgtgtgacccacagagtgcagaatacttgctgtgtggcccttcaccgaaaaaatttgcctattcttgtgacagtgttatgaggaaaataacaaaatccattctctgttatacactcattctgcagaaacactcgatgtatgtgatcctatattttctggtcaccagcactcttcccagtccagtctcttaccattaccatttctcacgtccttgaacctcagccaccttgatctacttccagatctacagattcgtcactctttctcgcggccagggagtggcatgtgctgcagcctgaaaagccactatttcttcccttgctcccttgattcttcatctgactgcctcctgtgtatccttccttactcagctgggggaatcctttcttccagaaaacactccttccttcagtctgagtgaggcagccttctgtagcat

SEQ ID NO: 137256 - DNA, 708 bp, Homo sapiens
atcagttaccatgctctttaagttttaccttctaactatctcttgaatcttcccccttctttatgcccacttaatgcagatccttgtcatttctctcctgggttcaaaaaggtaattatttgagtgccccttaagtgtcaggccctgtgctagacactgaggatacagtggtaacagtatttgccttcagagagctcagtcttcacagtaaaggcagacactaaataagaagtcacagcagaacagaggttgctaaactgtggcctggagctaagaatgggttctgcatttttaaagggatataagaaaaaggagagtgatagcgtgtgacccacagagtgcagaatacttgctgtgtggcccttcaccgaaaaaatttgcctattcttgtgacagtgttatgaggtatgtgatcctatattttctggtcaccagcactcttcccagtccagtctcttaccattaccatttctcacgtccttgaacctcagccaccttgatctacttccagatctacagattcgtcactctttctcgcggccagggagtggcatgtgctgcagcctgaaaagccactatttcttcccttgctcccttgattcttcatctgactgcctcctgtgtatccttccttactcagctgggggaatcctttcttccagaaaacactccttccttcagtctgagtgaggcagccttctgtagcat

SEQ ID NO: 137257 - DNA, 1140 bp, Homo sapiens
tttctttttttaaccaactgggtctgtgcaagaattatcctgactgtaagtgtggattaaaatagctgttaaaaattgtcatcatggctgggcacagtggctcacctgaggtcaggagttcgagaccagcctggccaacatggcgaaaccccatctttactaaaagtacaaaaattagccaggcgtggtgggggctcctataatcccagctactcaggagcctgaggcaggagaatcgcttgaacccaggaggcagaggttgcagtgagacaacatcgtgccactgcactccagcttgggtaacaagagcgagactccgactcaaggaaaaaaaaaaactgtcatttggggtgtaatctaaatagtgaaaacccaattatggcaaataaacatacaatctataaaactgatatctctacatcatgatgaaaactgaagttgaatcttaaaatttaataaaggcatcgatctagtcggaacatgtgggcagaaaaaaataatacccaaatatataaggctgtgttttaacagttggctttaaacgtatacattaatttcaactttctattttatgagaaagaacaatagggaaataaagtacagccagccctctgtgtctatgagttccaccaattgtgggtcaaatacactggggaaaaaatgatgtctgtactgaacatgtgcagacttctttggtcattattccctaaacaccacagcataacaactatttacagagcacttacactgtattaggttttataagtaatctagagatgacttaaagtatacaggaagatgtgtacaggttatacgcaaatactatgccattttatatcagggacttgagcatctgtagattttggtatccatggaaggacctgggaccaacctttcatggatactgaggcaggaatgtatatataattatgtttagaaaaaagtgatggggtaaggaactttgacagttaaagtagaacattctcaatttataaaaagattattgaccgggtgcggtggctcacacctgtaatcccagcactttgggaggtcgaggtgggtggatcacctgaggtcagcagttcaagaccagcctggccaacatggtgaaacctggactgtactaaaaatacaaaaatt

SEQ ID NO: 137258 - DNA, 1639 bp, Homo sapiens
tttctttttttaaccaactgggtctgtgcaagaattatcctgactgtaagtgtggattaaaatagctgttaaaaattgtcatcatggctgggcacagtggctcacctgaggtcaggagttcgagaccagcctggccaacatggcgaaaccccatctttactaaaagtacaaaaattagccaggcgtggtgggggctcctataatcccagctactcaggagcctgaggcaggagaatcgcttgaacccaggaggcagaggttgcagtgagacaacatcgtgccactgcactccagcttgggtaacaagagcgagactccgactcaaggaaaaaaaaaaactgtcatttggggtgtaatctaaatagtgaaaacccaattatggcaaataaacatacaatctataaaactgatatctctacatcatgatgaaaactgaagttgaatcttaaaatttaataaaggcatcgatctagtcggaacatgtgggcagaaaaaaataatacccaaatatataaggctgtgttttaacagttggctttaaacgtatacattaatttcaactttctattttatgagaaagaacaatagggaaataaagtacagccagccctctgtgtctatgagttccaccaattgtgggtcaaatacactggggaaaaaatgatgtctgtactgaacatgtgcagacttctttggtcattattccctaaacaccacagcataacaactatttacagagcacttacactgtattaggttttataagtaatctagagatgacttaaagtatacaggaagatgtgtacaggttatacgcaaatactatgccattttatatcagggacttgagcatctgtagattttggtatccatggaaggacctgggaccaacctttcatggatactgaggcaggaatgtatatataattatgtttagaaaaaagtgatggggtaaggaactttgacagttaaagtagaacattctcaatttataaaaagattattgaccgggtgcggtggctcacacctgtaatcccagcactttgggaggtcgaggtgggtggatcacctgaggtcagcagttcaagaccagcctttttctactactgtttattctgctactctatgtctaaaccacaacagatcctttatttcctatttttcactatcacaacgatttggtaaatatttttatacacgagtattaggtaaacattttaactagaaagtaccaacccctggccaggtgcaatggctcacgcctgtaatcccagcactttgggaggccaaggaggacggaccacaaggtcaggagatcaagaccatcctgactaacacagtgaaacttagccaggtttggtggcacacgcctgtagtcatagctactgggaagactgaggtggaagaggaggatctcttgaggcccagagttcaaggcggcagtgagctataatctgcactgcactccagcctaggtgacagagcgagatcctgactccaaacaagacaagccttgaaatcaaagttgatttttaccaaagcctcaatggtaggagttttagatttcttaaaataatagcacactaatggagtgcgtgattttctttagattaaatgtttacatatttatacaactcgt

SEQ ID NO: 137259 - DNA, 247 bp, Homo sapiens
tatcacccacctggcttgctcaggtctcctgctcccgctcttacccatagagttgttctccacatcagagagatccttctaaaacctgtcacttctttgcttaaaaatcctccatgcctttccactgcccttaaagcaaggtcccatgtggccctacaagacctggcccctggtgacgtctcagacctgattcctaccactggcttactctactctggccatactggccagacctgagcaagccagg

SEQ ID NO: 137260 - DNA, 230 bp, Homo sapiens
tgtcatgaagctaagctggcttcaaccctcctgtcatctgaaaatcagcaacaacatgtcattcaggaaatcgtatcaggtctgccttcaaaatatatctagaattctttcatttctcactaattcccactgccctgatcaaaaccactattaaattgcagcagatttactgatttccctgcttctgatcttgtctgtcttcactctgttcttcacacagtggtcatatt

SEQ ID NO: 137261 - DNA, 303 bp, Homo sapiens
ttttccacaggggggataaagcatttagactgagcttctcagctaggaaaatctatctatctatctatctatctatctatctatctatctctatagataaaatgatttgttcaaccaaactaagttctttttactgtatcacattcagcagttcaggtgacttacctcagctgagtttcagtaccctgagaactctttttgcaaaggactggagtttagtaagaagtccatttcttgatctatgatgttttcctcaattcctggctaatgcctggtattgtgtgccctgttcatggaaaaata

SEQ ID NO: 137262 - DNA, 268 bp, Homo sapiens
gtcaaaacatcaatagttcctaataggactcagagaaatgtcaatggtctcttgctcttcactttgtcttgacttattagtattattttagtcaaatttctttcagatgagataatatgtctttaaactctcttatgtctacttatgttcatccataaatgacttgaaacatttaaatcaagcttgtccaacccacggcctgtggactacatgcatcccaagacagctttgaatgcagcccaacataaatttgtcaagctttcttaaa

SEQ ID NO: 137263 - DNA, 765 bp, Homo sapiens
cgcgatctcggctcactgcaacctctgcctccctggttcaagcgattctcgattctcctgcctcagcctcccaagtagctgggattataggcatgcaccaccacgcccggctgattttgtatatttagtagagatggagtttcttcatgttggtcaggctggtctcaaactcccgacctcaggtgatccacctacctcggcccccacaaagtgctgagattacaggcatgagccaccacgcctggccgaccccgtctatattttttaaaagaagaggaattattttaaagcagcagattaaaggctgacttactttccagggtaggatattatagcaattctgatcacctagggtgatacaggcacttctatttgtgacagttgcattttgtgacacatggaggtgacacagaggctttccctgttttaccagtgaggaaactgaagctcagaagtaaagggaatgatacaaattcacacactagtaagcaacagggccaggactcagaccagcactgtccaactgcaaaaaaggctacgctgtcagaactgctccttacagcagcactagcagtaataagacggtaatcacaacagctaccatttatcaagcacctgtcgtgtaccaagaatggtgctaggtggccggccgggcacggtggcttaagcctgtaatcccagcactttgggaggctgaggcgggtggatcatgaggtcaggagatcgagaccatcctggctaacatggtgaaaccccgtctctact

SEQ ID NO: 137264 - DNA, 286 bp, Homo sapiens
tagcagctgagccctttaatgagcagggctctcttcaattcaccatggcccagcctggcctgtttcactcactcaggtacctgtctggcctccagggggcagagattttgactgtagggcacccattggtcccactaggtcagaagccagcagcctccaaagaagaggaaaaaagggtgcttctattagaattggtggaaaacactgttcccaagacttccatgggaccctctcattcctcctccccgctgctactagtactgcctggtcccctctcccactccca

SEQ ID NO: 137265 - DNA, 195 bp, Homo sapiens
aactttgttaacagcttcttctgtcattaagctccattcccatatgatattcttatattagtccttgagttctcactttaagcggctatcagttgacttcttgttatagcagatgaagattttttctttttgttttttgttttcttttttgagacgtagtctcgctctgtcgcccaggctggagtgcagtggcgc

SEQ ID NO: 137266 - DNA, 430 bp, Homo sapiens
ggctcattgtttctcactctctcttcccattcatacactgtatgatggtgtacacaccatcaccttaaattaaggtatcatcaccttaaattaataaaatttactcattggggggaaaaagcaaattctaaaaaacaaaacaactgtcttattttctaaccaccataacaaataaaacagaagtttccatcctattcttgagtaccctaattatttaaggaaactcttttctccattcttgatcaaacactttaaagaacactaatataactatactttggtaactgaaagtctcaagtaaaaaataacttcaaaatatttgaaaaggtgatcttttgccatcagattggcttatcatagaaggatggttaccagaggctggaaagtgtagtgaggagctgggggcagaaatagggatggttaatgggta

SEQ ID NO: 137267 - DNA, 776 bp, Homo sapiens
tcaggagtaagccactgctcctgtctctggccattctgagacctgtgcataagtaatttatgtataaggcatagtttgagagactggagcaattatttagaatatgaagacgttctaaatttgtgctacagcaatgtcatccatctcatgggccccagcagaagctgatgaaacttaatcaaaaataaatcaagagcaagtccaaaccaaattggaagcacatcatgaatattcgtgaacatctggatgtgtgtgtgggggggtgtatgtttttttttagtgtgtgcaacagcagagacatgatttcttaacaaagatgccaaaaggaagacagattttcatctgtgatttcaaagggtgtctttgtttgtatgtgtgtgtcctttctccttagggtgtgggtttcttttctccgagatattcctttgatctctttcatctttcgggatctgtttgggtattttatctgaattcttcattggagtcagtcattttgattcatgaagattaaacatttccttctaaaggagaatttcaacttaaggaaagttttactatttaatatttttgatgaatcttttcaatgctagcgatgtgataattatcaattaagctattctgcatcattgatcatcagtttcacttcacatgtctaaacctcagggtacggtactttatctgccttgctacctaaagtactgccaaaaactaaagaggaaaaaacaaagtatgggaaggcggtaataacaaccatgctgataattatcacaaaaatg

SEQ ID NO: 137268 - DNA, 384 bp, Homo sapiens
agttctgttactaaaaatgaaggagagaatgggtattgagtagaccaacagcaatctctgcaagactggacaaaaaagaggcctgcagatgaagttgagaaggaatgaccagtaaattagaagaaccaatggtggggaggctgtttcctgaagggcagttccctgccttcctatgaactcaaaaggtagttagattttaatatagcccctgctgtgtagaaggccaagagtaaagacattagctctccacttccaaggtattctgatggagaaccaacttgggtggagcggggaactgcttcagctgacagggtcccttaggaaatcacataccttggctgtattctcttgtatctaatacaggcattggtgctaacctgcttc

SEQ ID NO: 137269 - DNA, 431 bp, Homo sapiens
agagaccttcctgcagggaaaaaggatgcaaacattcttggtaatgctaaaggaagaatacctgttaaatcagttcttcctaatcaaggctatacatcagctacccaaggagattttgctaatagctacacgcccaggccccaacccctggagattctgattaagtaggacaagaatgatgcacagatgtgtatattttcaaaaagctcctccaactggttgtgacacacaattaaaacctgatttaaaaccactgttttgaattcccgagaagatttcaggcaatctgtggacactcatcagtagttgtgttcaagtcccatccaatctaaaaggggaagcacttttcaaacaaatatactaagctgagagcaacggtttttctgactagctgtttaggtcattgcagaaaagctactcacctgcttaat

SEQ ID NO: 137270 - DNA, 641 bp, Homo sapiens
aatgtgtagtaatttgttatagaaacagtaggaaactagttcatcatgccattcccctaactattccaacatctcactacctgtatctcagccactgctcatccagctccagctgccttgctctgtgcatcataaccatacaggtagccgcttatttgcttacttcttatgtggcctgttaccccggtgttgagacccccaccccagagtatagtgttacttcttaatgttcacatttttgaaacctcatttttgccatggtaactcttccaaatctcattactcttactccctcagtcctgtctttagtccactacattttagtagatgaccttacccctactctactggtgatgttgacagcatctgtcttgagctccctttactttcaaaacctctctgtgaattccagtcatccatttctgggtttccatctctggacctctgttcagcatttcacagtgtcaacaccaccttccttttttccatggcctctgtgacattgcattcattttcccatccctctaattgcttttccccctttatatcagccatatttttttcagtccttaaatctaagccttccttagtttctgttctcaaacttcaggcctccttttaaaatttattcattctcttga

SEQ ID NO: 137271 - DNA, 194 bp, Homo sapiens
cagtgcaagtgccagccggggcccctcatcgactacctgatgctaccatgcccccagctgatgggacagagatgaggccctggaagctcagccctcgtccaagggcacccagtgaccaaccgcacccgctggacttcaaacttggagctctgtgccaccaggaagccccctcacccccaccactgaaggagctc

SEQ ID NO: 137272 - DNA, 155 bp, Homo sapiens
ctgaggttactggttagcagtgattgtcacctccagcctctatgtctgcatagtataatgctccagtggattttaatcttcctgctttttgcaaagttaaactgcttagataaactcttacgtgctttgtgcttaatacgaaattttagcatgag

SEQ ID NO: 137273 - DNA, 272 bp, Homo sapiens
actggaagctattgtttactactattattactagaattcttatcatcactgatagggagagagcacccaaaatttccgaggtagaggctgggacgacctctgggtccggcagagtttgaaggggagggtaagaaggcgaggggagctagcgccgcccacgtccagcccgtgcaccctctctcgccccacagcctgctggctgcacgtgtggctcttctctccgcagcgctggtgcgcgaagccaccgggcgcacagcccagcgctgtcgtct

SEQ ID NO: 137274 - DNA, 151 bp, Homo sapiens
agacaattttaataagtcatagagctgttagagaggatgattcaggccaatcaaatctgaccaaagatctacttttagtgggtggtgggtagattattaattttcattcataataaatactttaatagacaataaaaattcgtccacttta

SEQ ID NO: 137275 - DNA, 367 bp, Homo sapiens
atgggcaggttatatccatggaacagcagataactttgtgattcttctgtcagcgaagtgtgggtgtaggggagttcaaccttgtccatcagctgctagaggcctgaccctgcccttaacagctgcagagaataaaagtatcagcttgttcagctcctggcatgcagggtacaagcagttgagctgcatggaattggatctcatagttgagtttcttggcaccctagataccttgttctctcctcgattacgggtgtagactttgtcttggtggctgttctgggcctcctaatttagttgagattcttttcttttctttttttttttttgagatggagtctcgctctgtcgcccagcctggagtgca

SEQ ID NO: 137276 - DNA, 398 bp, Homo sapiens
tactagctacatgaccttgaacaagttacttgggccttaagtccttctctacaaaatagatataacagtaataacttctaaagttcattggaagactgaataatatatgaaaaattcatagaatagtacctgaaacacagaaaaaaattaatcattatttattaaacagcttgacaaggcctgttaaggataaaaattaaaattaaacatgaatattatcctcaggaagctgacagattgagaaaaatacatcatgtttagaaatagcaataattcaaagaagaaattgctaagaaagacaagtgtaatatttatgaagggtaatctcacttcagggagggatacatcactaccaccttcaggaataagaaagctccatttatttttaaaattttatt

SEQ ID NO: 137277 - DNA, 710 bp, Homo sapiens
ctagatctggatttcaaaaagatcactctggcagtaaaatggagtacaactcaggaacaggagggcagagtggctgtttggagaaaggcaagataattttacagtctagaagagagcctggaaatgctcccttccacagaagttccagctcctgcagcctagttccgtcctcatgcaaccttccttccgtgaggttctgcctaccaagagggaaggaggaaggacctgtgcaatgagctttaacccgagacagagaaagtgaacaaactggaagtccagctggcaaatgagtcctttttgtgtccatatgaatgagttcgcctaggtgaaataattcaaaagtggtttctgaatttgcaagttgagaactcagctctggattcttggtgaccccaagtacaggaggcctgaaaggccctgtctgagaatatgcactaggcagctccatctcctgtactcaccttttaactccagttaagaagctatcatgtacaccccatcactgagaagatgtggaaagtgaggcccagagaggtttagtaacttctccaacatcacacagtaacttttaagggccagtccctgaactgtcatcctaaaactcattaggtgtgtgatcctttcaaaatgctctactggccggcatgtttagggatgagtaatggagagagtcataaaaacatacttttaaattaaattcttttttcaaa

SEQ ID NO: 137278 - DNA, 569 bp, Homo sapiens
ctacctcagtcttccgagtagctgggattacaggcatgcaccaccatgcctggctaatttttgtatttttagttgagacggggtttctccatgttggtcaggccggtctcgaactcccgatcccaggtgatccactagcctcggcctcccaaagtgccgggaccacaggcatgagccaccgcacccggccctaattttttaaaatgtttttaaagaaacagggtcttgctacattgcccaggctgggcaacactaattgtataaacaggttgggcatcagtgtaagcctggctttcaattcaaactcaaactttgaaccaatggggtccatattatgaaggttccttttacatgtgaatctctgaatcataggttcactatgagattttctcctggctgagaggtcatcaggataagagttcctcagtgctccccctaattttccagggtagaaagcattctctttggtcccaaagaacgttttgtttgaccaaaagaaagagtccagctcaggaagaaactctctatgggatctgaaaaacagacccctagagagtctccgtcgaact

SEQ ID NO: 137279 - DNA, 172 bp, Homo sapiens
cagtgacacagggcatcaagcccagagtggcagctggagcacctgaccccatctgcaaagggtagatatatagcaggagaaaagggcacctctcaatccacacacccttagcaaaagcttttctcaagggaaactagtcaagaggcttcaggaaaatgaccaatagaaagct

SEQ ID NO: 137280 - DNA, 550 bp, Homo sapiens
ctagaggatcctcgctctcacccacccatgatcatgcatactgtactccagcctggatgacagagtgaaaccctgctctaaataaaagaaaatagaggcagactgtggtggctcacacctgtaatcccagcactttgggaagctaaggctgttggatcacccgaggttgggagtttgagaccagcctggccaacatggtgaaaccccgtctctactaaaaacacaaaaattcacctggtgtggtggcgcctgcctgtaatctcagctacttgggaggctgaggcaggagaattgctggaacccgggaggcagaggttgcagtgagccaagatggcgccattgcactccagcctgggcgacaacagcaagactccttctttaaaaaaaaaaaaaaaaaaaaaaagaatggaaacgaaaaaccaaaaacctgctttcctcctcaagaaaaaggcagagagaggcagcaaagaaagaggaggcttagggtgaagggtctccctgtctgctggtaaaaccgccgccccgcagagctgctgcctctgtggggctg

SEQ ID NO: 137281 - DNA, 283 bp, Homo sapiens
agttcgacggagactctcccttcatcagggaagggagagtgcagagaccctccagaatcaaaggaggccagcatggctggagcagagggagcaggaggtcccagaggccccaggggcaaatcagataaggcctttctagctcatggttgaaacttttgcttttagtcttagtgaggtgggaagtgaggggatttgagcaggagagtgacatgatttctctcttgctgtcttccatccttcacacgttaccaagacacatcaagagagtctccgtcgaactggg

SEQ ID NO: 137282 - DNA, 305 bp, Homo sapiens
atacatttacactatcttccctcttccctgaatcttagaaacataacttcttcagtaggctgataaaatatgaggcatggagaaattttttttgagtgcttgtgcagagttgggactttatgaatacattttgctgaaaactaggagcggggctaagagcttacattgaaaagttaatttacaactgtacagatagttgtacagttgaagttgagtgaactccaaagggatttacataatataaaggtatgcgtttacatttgaaaggaatataaggcctgtgatcttggagacatccctaggct

SEQ ID NO: 137283 - DNA, 364 bp, Homo sapiens
ctcgggagagctctttctccattcatcccccgcgcccggccaacagccccgccacccccgcccgcgcagccggggcactaaaagcaacccccggcgccccgctccgggcgccccgctcccgccacccccagcactgctcgcgtagatggcgctcctgggtcgcgaagtcccgcaaaagccagaggcgaggctgggctttaaccccaaagcccgaggaggttaaagcctaagcctgcaaagagcgggcagcgtccggcaggagcggcgtccccatccagccctccccggcaagcgcgggagacccacgtggccgagacacccactccgaggtggatcaggatgcgcgcccggactccagcagccc

SEQ ID NO: 137284 - DNA, 323 bp, Homo sapiens
ccctcttcctcatcatcactgtcatcaggtctgtaatctagaaacctaggagataacctgatagcacctctcttttacttaccctttcaagtctatccagtcgcctgtttatgttactccctgatggctgtcaaatctgtccaagtctcttctccacttatgtacctctccagatacgcaaggctaagctagcagagtcttgcaaatggactacaacgaggattgctgttagggactagaataatctccagactagtttttcacatcctcacttaaccattgtccacagtgcagccagagcaatctttttaaaacagtaattt

SEQ ID NO: 137285 - DNA, 191 bp, Homo sapiens
ggctgatgtggcagaatgacaaggaaaacctcgatttcctcagaggtcaacacggggtggggtggaagttggtcctgacatctccccacccccacctgttccaggtggattgtacataaatggaaaaggcaaaatagtaaaaacgtaagcaagtgttctctaagacactaaaaaatcaaataaggcagaca

SEQ ID NO: 137286 - DNA, 205 bp, Homo sapiens
ttaggttggtgcaaaagtaactgcgatttttgctattaaaagtgatatttccattacataatattattgtaacaatttcaaatatcttgagaacgataatggctttatgattaggatagagaatgtcctatcttcttagaaaatacaggctgaaatacttaggagtgaagcgtcataataacttactttaaaatggttccgcaaa

SEQ ID NO: 137287 - DNA, 165 bp, Homo sapiens
ccggaggacttgggctgtttgccaggagctgtgggccctggggacccacccaggcacttgttgctgccagcacagcttcaggtgctgagctccagcagagctaacttgtcctgggaaattaagtgccaagtggggacgcagctcgtgacagcagggagtggaacc

SEQ ID NO: 137288 - DNA, 909 bp, Homo sapiens
gcagactctcaccggcttctggagatgttctccagtccagaattgctttatgtttctgggttgagaggttactgcatgccttatctacagacctacaccagaatacaagcttatcaagagcggctgcacacttcctgccatcatgtcccctaaatgacaaacaaagatggtttacatgtgcaagttgtgtgtgctaccctgtcttaggcacacagttcaatgcggaaaggaatggaggccagatgtgaagtcaggattctacccagcagagttttaattgagctcctggggcaagagtgagggggtgggccagctggctctcttgctgaccttactgttatcttaactgtcaaaacctccccgctgtgtatatccctaaggactatggcaaactgtcctatcccatagcataaagggtggggatgtctctccctctgtttggggaatgactgatcacctagtttcagccaagttctcagtaatcttccttccgtcattttgccaaggcagcatttcacttcatctaaatgcctcgagctctccaaacagccccattccccttttgcaattttccaggggaaaaaagtcactattgaatgtccttacttctgcagcaggaggtcactcttcccattctcctgcctaaggcatctgtcatcaacatttggacagctagcacatcagaacacagaggcagtcccacgttgctcagcagcctagaaatacatgcccagaactgccagctttccgagtggtgctggctccacagccgcatgaagagaggaggaaggcgaagacacttatccaaagaacagacacaacaacacaaaatcatttgaaaaagaacatctctgtcagcagctaccaccgagcaacaagtcctccttgaatgtgctccatgctatgatt

SEQ ID NO: 137289 - DNA, 145 bp, Homo sapiens
ggggaggctctcctgtcagagtaggcattttttcatcctcactggtcttgcgagtggataggcagccagctcctttgtgcccctgagatataactgttcttggcattcttttggcatctgctgttggagcatgaggctggtgtaa

SEQ ID NO: 137290 - DNA, 368 bp, Homo sapiens
ccatggcttcatcccaaaattctatgcagataattctcagacccgtacctccagcccagacttctctcaacagccacttacatgactcaaaggtatttcaagctcaccatggtaaagaccaaattcgtgatctttcccagacaaacctcattgtcttcctgtgttgctatctcatggaatggcccaactacccatccatgcagcagaagcagaaagtccaggcattatcttttgtacccctcctgcattcaatcttgccctgtagccccctgctatagtctgtcttccaaaaagcaagagagaagtctttccaaaatgcaaggtgaatcacgatactagctatttaaaatatattgctcattggaaac

SEQ ID NO: 137291 - DNA, 454 bp, Homo sapiens
actctacccaaacactcccctttcttggggtggcttaatgctctgtctcattgcccttcctactgcctacccacatatcacatctaccaaccttccacgcagccatagacgtgttctatcaaagacagttccctccccaagaggacttctctgactaatcataatctgcctttggttgtaattttgtgttgtgaggccaccacaagggtgtttgctgaagaggtcctggagtcccctcagagcacgcttgctaccaggagtcagcatgtatgtaacttcatcagctggggcttctgcttctcttacaaacaggtgccagggcccaccttgggcactcctgcagaagtgagcagaggcttctgccatggggccataccttgtttgacctaggtgccagcactgggacagatggcacagcacagtcctgccgttcccacagggtttgtgtgtgcat

SEQ ID NO: 137292 - DNA, 802 bp, Homo sapiens
cagagctagatctggcagccagagtcccaggaggagggcacagcgagtgcagagcctggatgtgaggaggtaggtatctaagggaagagggtacgcgtgggccaaggagtagccttaagggaagttggacaaggtgccagggttagagcatggggtcttggagaccaaggaaggaacttgggttttaatcaaagtgtgctggacagccctggagagttgtacacagagaagtgacagggtgggatttctgtagtttaaatctctctggctgatgtgtggaaaaagaatggaaagggcaggggaaaggggaaacaggagacctgttgggaggcacctgcaattgcacaggtaagaactatcatgacttgaactgacagagagatatgggaaagggatggattcggggcacattctgaagatagagccaccaggtttactactatattggatgttggacttgggggaggcgcgtggttggtgaggaaagaataattaagaacaagattttggcctgagctattcctggagctaccatgagcaggacaggaagaccaggggagcaaggagtgtgggggatgttgggtggtagaggggagggacaggagggaaatgaagacctgtgtttctggtagtgaaaagcaaaggagatcaagatgctgcagtcaggaagctggaaaaataccaagccagggcgttggcatgggcaaaggagcgagggcctcagtcaaatgctgctgtgagggagaatgagaccaggtggagtaatgagtacaggggtgccaggcttcctggaagcggcagc

SEQ ID NO: 137293 - DNA, 336 bp, Homo sapiens
gtctctcaaggagtttataatctagtaggattgacaggtccctgtgtagacacatagagtaactaaagggcaaatgcatgtagagaggaggaagaaaggggaaaatggatagagggtgggaattaacaaaaactttatatagattcctttttatcataactgtggaaacttttctatacaatgcccaagatgaacttgatcctttttttttttgagacagagtttcactcttgttgcccaggctggagtgcaatggtgcactctcggcttaccacaacctccgcctcctggattcaagtgattctcctgcctcagcctcccgagtagctgggatta

SEQ ID NO: 137294 - DNA, 177 bp, Homo sapiens
ggagcacctgttttgtggcaggtcctgctgcagacacaaactacaagtccgtgggagagacactacatggttctcatttggggtacattcctggaaatggaggagtgttcatcagagctgtaccagttccttacaacgcagtccttagtgagatgtcttccctgacacaatgcttta

SEQ ID NO: 137295 - DNA, 239 bp, Homo sapiens
cgtggtataatgtatctgtgttttaagctaagtattattacaaaagtggaaaattagaaaatgttcaaaagtatataaagttaaaaagttacagactaagcttagttttattactagtagtagtaatatttttttgagacggagtcttgctctgttgcccaggctggagtgcaatggagtgatctcggctctctgcaacctccacctcccgggttcaagtgattctctcgcctcagcct

SEQ ID NO: 137296 - DNA, 294 bp, Homo sapiens
taatagagacacggtctcactctgttagccaagctgggttacagtggtgcgatcatagctcacagcagctgcagccttgatctcctgggctcaagcagtcctcccacctcagcctcctacgtagctgggaccacagatgtgtgctaccaccccacccactataggaatcttttttaatgcatttgcagtttaccaaaatggcttttcacatcttcaatttgaaaagtgttatcttgtccgggcacgatggctcacacctgtaatcccagcactttgcgaggccaaggccgaagg

SEQ ID NO: 137297 - DNA, 457 bp, Homo sapiens
caaagacagggatggcacaaagcagaagctgttgtcttataaaattttatgatctcaaacttatatttgttaagcctcttacaaagaagttgggcagacaggggaaaagataaggggacaaaagtaatatgagtccaaaatgaatattggccacactgtagaacaacaaagttcctgtgaccccaactgaagatcatcaaagagattgtcaaccagtgcaacatcaggaagccctactatattagagattaagaacttccctggattatgaacaaagaacatcaatgagataaatagacttaaaaaaaatcttcccttggccaggtgtggtggttcccacctgtaattccaatactttgggaggctgaggcgggaaaatcgctatgatcccgagtgccggaccttgctgagcgccaaaattgcactacttctctccagcccggtgacagagcgagac

SEQ ID NO: 137298 - DNA, 619 bp, Homo sapiens
gacttgtcttattagaatggagtgtctcattccattcacctgtcagcaccattctcttccctgcagccaagtgagctttcactaaagtggtctgttcttgctattttccctactttttttctcccctgctgagacggagtcttgctctgtcgcccaggctggggtggaatggaacaatctctgctcattgcaacttccgcctccctggttcaagcgagtctcctgcctcagcctcctgagtagctgggattacagacgcacatcaccatgctggctaatttttgtatttgtagtagagacggggttttgccacgttggccaggctggtcatgaactcccgacctcaggttatctggccatctcggcctcccaaagtgtggggattacaggcatgagccactgcacctggcctgttttccttactttaaaccagttttgacttgcccttctacctgaagtgaaatgtagacttattatcaaggcgtcggtgctttccaggatctggtccccaccgaggccattctttctcctcttcactcaccctagtcacactaattcatttttcactttgtgtaatatgccacattctctcttacttttcttacatttcctgtgctct

SEQ ID NO: 137299 - DNA, 336 bp, Homo sapiens
caaccctggactgtctgaccctaatgcctccaactctcatctaggggatggcaaaggaccccctcaggcccctgccatgtctactcctcctgcctggcattctggctgcatcctcccatggcttccttgcgtgcacaggaaagcccagctccatgcccagcagccttccttcctgcagccacctggccacctctggttccctgctgctctaggttccttccagcctcctggcctttgtccctgacataccctctgctgggagccatccctccgggctctttctgctgaaatctactcacccttcaggtctcagctaaataccccaaccccagggaa

SEQ ID NO: 137300 - DNA, 138 bp, Homo sapiens
gacgttcccctgctaagctgcatttcaatatcagcctcatgcattaaccttgaaacgctgtgcccatgatgtaggtagcgtcttcattttccagatgaagaaattaagacactgagaggttaaatgagctgcccaagg

SEQ ID NO: 137301 - DNA, 456 bp, Homo sapiens
cagggcaggggctggcatgtaataatcactcaatcaatagtaagcatacatgttgataggtttagagaaaacggtaacttccttcaaatgtcagtctttccgaatcagttcttcagaggaagaacagaagtaaggcggagaaagaaaaattgcaactttttgccatccctgggacccaccctggacccacactggacactggatgagagaatcttcggcttctgtattcccgctttcttccctaaagctctctgccttccagccagaaaggctgcctagctcatcctgcaaactgcggctgcattgcagcaatgacttgcctcctcctgatttaaagcgaagggcactgggttcatccttgcaaggtggaattttacagcggcaaataatggtggaatcctgagatacctcctcaatctatgacagattttgaacaaccacccactccagggatga

SEQ ID NO: 137302 - DNA, 421 bp, Homo sapiens
tcatccatctgtacttttgaggttaaatttaatctcctctaaaattcaaatccagggaatgtggattagaatctgagctgttagctggcatactaaagactaaatgaagctagtagcagtgatgatgaagagaagtgtacagattttagaaatattcagagttagaattaaaaagtggacagatttggcaactgattaggggtgggggcaggtggtagggagcgaggccaggattccaggctggggaactgggtgtgtggtgatgatatgtactgaggtggggaactcgggagaaagagaagacttggggaacaagatgttgagtttggtttgggacagagtaggctccaggtggtgaagggatatgccaatggaactgtctgctagctgttggacatagaggtctggagtgcagaagaca

SEQ ID NO: 137303 - DNA, 224 bp, Homo sapiens
caggaatctatcttggctatttatgcaccaatccattcttatttcttaaattattatcaagagaaaagtttcataaaacagaaaaacaccatgttttaaagtaaaaaaattttgcatatatattaatttttagggaaatcattatgaaagtgctttacataagtttatctggaatgtagattttcaacgtgtgaataatgctaacattattgtggctttatttt

SEQ ID NO: 137304 - DNA, 316 bp, Homo sapiens
taatacagggtagttaaaacaccttcaattggtgtattataaacttaaaagatgataaaaagcaaaaagtgaaattttattcctctacaacttgatataatttttatattatactttcataggaaaacaagtgatgctataactaaaataaatcccttcactgcagaaaaataaaaatttttaacaggaattttccacacagattaagatattctaccaggatcttaaaaatataacatctataaacccattctataagtgtcccactatataagaaatgtttctgtgcatttaagaagtcaattttaacaaattt

SEQ ID NO: 137305 - DNA, 270 bp, Homo sapiens
ctgaagttaatgtgtgttttaaatgaataatcttatttataacaacattttcagcgtggcaactgcagtttcagaatggtggaattataccagtcagagagagatgcaaatgatttaaaataggaagaaagcaggtgtctggcccagaggaccagattaagaagaccccatgagagttacaatagttagtgaaaatggtgcttctgcaaacctcatgtctacagaagctggtcaaagaccagatgccaccaggtagaatcccagcaaact

SEQ ID NO: 137306 - DNA, 450 bp, Homo sapiens
ccagtaacgtataatttaagcatgtggatatgccagtcagctttccacagcttaactggggtggagagaggtgtgcgaaccagtgctttgttctttcttgtctttttccccttacttttgtactcccactcctgccaaactagacatcgttttatcctggtgtgttcattaacctctactccaaaaattaagtgtggttaagggagtgaggtcgatttcaaaatgctgcatctgatttagaggggggtatagttgagtgaagaactaggcactgaagcagcagcttatgaggagagtgttttctctttatttaaagtccttacatatcgaggcatctggtgttcatgaaatagtctgttgtgctgttcaactttttcactcttttcttacctgacttagacaattaactcctagggctgggttttccctccacattgcgattccttcagg

SEQ ID NO: 137307 - DNA, 530 bp, Homo sapiens
caaggcagggtacctggcagggattggttggggaggctcccccatgctggagaagggtaagtgacccccaacagtcagcatccgcattcccattgtgaagtcctgcaatcccagccatggaagaaaccctcaacccacacaaacagggaacttggggactgcatgatggcactgctccagagagggagctcatccccccgagtcctaagcagctacagcagggcaccattttgagagccccacccccagcagactgcatcattccctgaggcccaacagcccctgcatatccacatctctgaagccccattaaagtcccccacccacagctgggtgctgccgcagggccaaagtatacaagctactggcagtgagccagcagagccactgtgcattgtcaagcctgattacaggctaccctgtcctgcagataccatctggggccaaagtgcatgctcccaacccacctgtttatgactgctgccacacaaaaacacccctacctaccacagccaagccctatacacacc

SEQ ID NO: 137308 - DNA, 259 bp, Homo sapiens
gaggcccttagttttatcccatttgagaatttcttttctatttagttaggagagcagaactaaactgtgaaaatcagtagtttatggaagtaagaatccttccccccaacccccaccccccaacctctgccattttctctgtttctataataacttgatagccaggacaagctcattctgagaaagtttggtgttttcatggcactctgtgtagcatgtgtgtgtgtgtgtgagagagagagagagagagagaaagggt

SEQ ID NO: 137309 - DNA, 532 bp, Homo sapiens
gtctcctttccatccgggggaaaatgggggtggaataatataaataatgtgcctactacagtgcctggcatatttggtaacgctgtcagtggtggctttaagtattaggcaagattgcatcctctttctttggataaatagcatggtctggttcagacactctattgtgagttgagttgtaacgcctctataccagagtttgcaaactcaaattgcaggaccaagcaggtagcacatgtgaactgaaaggctcccatggggattgtatcaaataagagaacatacttctgtctaaaaagggccgctaactcagggctacctaaaaataatctgacaggtgaaatcagcaatgaaaaagcccagacattagaaaatggagttacctgttcggcagcttttactgaacgaggggagaccattcagtgtggagacctccagtgtgcccacttgcctttgtaccaacttttctctgagcataaatgtaaaggacgtccgttggaaaggaacctttgggatggcttagtccagctac

SEQ ID NO: 137310 - DNA, 457 bp, Homo sapiens
tttcaagctggttttcttttttttttgggaaattaagtaacttgaaaagattaagtgattaatattcctgtggctgtgtcagggatccccgagccttctctcaggcttgatgattcactaaaaggactcagaagagctgttatagtcacagctgtgtttttactgcaaaaaggatacagattaaaattagcagagggaagggtgcatggagggaagtccagaggaaactaggcacacgcttgggtgtctctccccagtggcgtcacgtggatgtgcttagctctcccagcaatagtgtcacatcatgtgtgaagaatggttaaccaggccagcgcacctgagcctcgagtctagagattttgtggggggccagtcacatacgcaggcagtgcccctgtgactgacctcactcaggctccagtgccccagtgcaaaaacaagtgattgttccccgcta

SEQ ID NO: 137311 - DNA, 356 bp, Homo sapiens
gaacatggcggcccccgagtcagggccggctttgagtccaggcactgcagaggcctagaggcaaccaaaaacatggtgcatcctttatcatcacgaaagcaattcgagatcgtttattatttttacgccaatacatctggtacagcccggcaccttttttgctccctgatggactggttcgcttggttaataaacagataaactggcatttggtacttgcaagcaatggaaagcttttggctgctgttcaagatcagtgtgtggaaatcaggtctgcaaaagatgattttacatccattattgggaaatgtcaagttccgaaagacccgaaaccccagtggagacgggtagcatgg

SEQ ID NO: 137312 - DNA, 765 bp, Homo sapiens
caatcagtacatgaaaacaagaatttctcatttactgaaatgatatttgccttgtaattgctgtctgggaatgttgaaccaagtagaaaacattaaggaaactgcactcctccccacaaatttaagcttggtgattgttaaaaataaaaataaaaaagaccaagaatactgtagtcccagctacttaggaggctgagacaggagaattgtttgaacccgggaggtggaggttgcagtgagccgagatcatgccactgcacaccagcctgggcgacagagcaagactccatctcaaaaaaaaaagaccaagaatattatttggtagtctagctgttttgtcctggtttcaaggcaccacatgtcttttgatgtaaaataatatactaaaacatgcttacagcttaaaacctgaaataaatttgtggagtataaaaatacatggaatacctagcaagaaaggagttaaagaaataaaagataatacaggggtgcaaccaaaaagtctgggacttccaaaaaaaacaacgatcaggctgaaaacctgcagcccagacttaatggacaagctcgacacgctaacatcagaaaggatcgcaccacaggggactcctccctcctctccaaggatgacgcaggacctgtggcgttcgaacgaagcagagatgcgtgacccacgggcgggccaggccttggagaccaagaactgaggaaaagacgtctctggatggggcaacataacaagtggaatggcaaccccacaacaga

SEQ ID NO: 137313 - DNA, 746 bp, Homo sapiens
ggcctctcaaaatgctgggattacaggtgtgagccaccctccctggctgggattcagtattatgtctgctttgatacctggtaagatccaggggggcctcagatggccaaactgcaagtctccctccccactctgcttccacatataaggttccctaaccagatagctctccctatcaaggggagcaggcacagatttggaggggacaaatgcttgtcccctcagtagcaggcttcagttcccaccagtctgcctgtggaattatccagacaagccaatcacatcctctgtggggaaccagggctcatcccaccccctcctcttgttactgcaaagcctgcctgcgtggcccctgcccgaacactgttcccaggtgcaacccctatgtggccctgcatggcgagatgtcctcctttcccgggccacagtgtgtgcaactaataaacctcctccatctcatctgcccagtgtcgggtcttgtgtgttcagccatcaccatagccctcaggcagaagtccatccctcaccaacagggaagagaggcagtgatcaaaacacctcctccaggaagtcttccctgaagttcgtagtctggcttcagtgccacttcttccctgccctcatattcgctaaccgccacttactgcctggttttcagcctcactaggatgtgggccactaagggccaacatggtcctacttgcagctgcattatcagggcctaccataacaccttccaaatgctt

SEQ ID NO: 137314 - DNA, 111 bp, Homo sapiens
tagtcaaaacaacagatttttaactccataattatgcccatcatctcttgactagactactgtaatagcttaatagttctctcatgttttctcttgaaccccttgtgtatt

SEQ ID NO: 137315 - DNA, 307 bp, Homo sapiens
tcatggtggtacgtgcctctagtcccagatacttgggaagtgggaggatcacttgagcccatgaggtcagggctacagtgagctgtgatcacaccactgcactctagcctgggtgacaaagtaagactctgtctcagaaaaaaagaaaagaagtggttaatatggtaaatgttatgttacatatgttttaccacagtaaaatttttaaaactaagatgaaatggccagtttacagcagagtaaaaattcgaggcctgatattcaccccttatgtgcctaaccctgttctcaaagtattaaacccttg

SEQ ID NO: 137316 - DNA, 592 bp, Homo sapiens
caagagactcacctaacatataaggactcataaaaatttaaggtaaaggggtggaaaaagacattccatataaatggaaaccaaaagcgagcagtagttattcttatatcagacaaaacagactttaaagcaacaacagtaaaaaagacaaagaaggatgttatacaatgataaaaggattagcccaacataaggatactataatcctaaatttatatgcaactaacactggagctcccagatttataaaacaattactattagatctaagaaatgagactggcaacaacacaataatagtgtgggacttcaatactccactgacagcactagaaagatcaagacaaaaagtcaacaaagaaacaacaaacttaaactatatcctagaacaaatgaacttaacaggtgtttacacaacattcttcccaacaactgcagaatatacattctcctcatcagcacatggaacagtctccaagataggtgatatgatgggccacaaaataagtctcaataaatttaagaaaatcaaaatcctatcaagtatcttctcagaccacagtggaataaagctggaaatcaactataaaag

SEQ ID NO: 137317 - DNA, 392 bp, Homo sapiens
atttaagtaaggcattccatgtccctcattttcaaaatgataggattaaagaagaaaaaaatctctgaagtttctagcattttcagcctatagcttactttttctccctcctatgccagcctgggccacccaccaccttcccactgctgcagcaccttaccataattaggcagctttttaaagcttctaattaacggaacacagaaattaaaacctttaaactttcttttctatttctggctcactgcaaatgtgcaacagcattttattaaggagttgttaatgccacacagttcttgctatactggcttttctctgaaccccagtgacagttacacagtgacaagttgtaagcaaagaggttgttaccatgggaacccactaggattcct

SEQ ID NO: 137318 - DNA, 340 bp, Homo sapiens
cggagactctcattgcccaggcaatgccaatggcatgatattagctcaccgcaacctccacctcccaggttcaagcaattctcttgccttagcctcccaagtagctaggataataggtatgcaccaccacacccagcccattttgtacttttagaagaggaatatcctagttaaaagatactatgaagaaaaagatatgtgaggctgtctgattggccaaggttgtacaggtgttttccctttcaatttgattctataaatgaagctcggcaggatagaaactattacactgtctacggatagcaccgacacagttgtcactctccaatctcctatgagg

SEQ ID NO: 137319 - DNA, 758 bp, Homo sapiens
aaagcctccagattcaaaactatgcttgggtcaaattctagctctgccactttgtgtgtgcagtgttgggccaaacacttagctcaattccctcatgtattcagcaaacagttactgaatataatatgctactcttctagtcttgtagcaggacgagccgcagacaaaacctctcagacaccgagttgtagaaggaagggctttattcagctggcagcatcggcaagctactgccttaaaatccgagctccccgaatgcacaatttctgtcccttttaagggctcctcacagcactaaagatttcacatgaaagggtcgtgattgatttgagcaagtaggtggtacgtgacaggggctgcatgcaccagtggtaagagagaaacagaacagggcagggagtttcacaacgttcttctatacaatgtctggaatctatgaataacatcggtttctaagttatgagttgatttttagctactgggtgtgaggcctctgagcccaagccaagccatcgcatcccctgtgacttgcacgtatacatccagatggcctgaagtaactgaagatccacaaaagaagtaaaaatagccttaactgatgacattccaccattgtgatttgtttctgccccaccctaactgatcaatgtactttgtaatctcccccacccttaaggtactttgtaatctcccccaaccttaagaaggttctttgtaattctccctacccttgagaatgtacttcgtgagatccaccc

SEQ ID NO: 137320 - DNA, 376 bp, Homo sapiens
atatatgaaccttagtccaagctggaggtaactttgccttgaaggatgaaggaccattacccacaacagcctcaagagcttagggaagaagcctcctgctttatccccacagcagtcctggcacttgccagggctctctgtggtctccagaggctggaaaacctgtttgttgcaagatctctcgggagagcaattaggcagccaatgatacaagtcataaatgtggtcacaccctttaacccaggaatgtcactctggggaatatgatccaagaaatcattaaaaaggaaaaaaatagaatgcaagttgtggtaggaacaggaagaagctgccaacagcccacaggcccagcacagaggaagggaagctaactaac

SEQ ID NO: 137321 - DNA, 344 bp, Homo sapiens
ccagaatataagcgcctctggttttgtttttctgatggctattcagaaaatagtatgctttggctatgtttttctgatgaacattcattagataagttttacatgttcttttcctgatttttaaaatatctttgaagtgatattgtgccagttaaaaaaaaattattactcatcataaaatgagttggagttcactgccctagctatttgtggggctagtcctctggatgtcagttttgtttttttgttttctgcatgtaaggcgtgctggggccagggcagccttctgtagttaacagtcgcagtactctctgcttcactgtttccacagacattctgcttcc

SEQ ID NO: 137322 - DNA, 489 bp, Homo sapiens
cgggccagtacggatgtgcgggccagtgggaaatacagagtttgaatggagacaggggtggcacctgggcagaagtggtgaccaaagggtgcaggatgtgctggtgacctgggatagaagaggagcctggtgatcccaggcctgagcgatgtgggggtgagggggaattgggaggacaaaagaagagctcaggagtgcggaagcatcagaaactttctggcagtatctgtggtcactaagtcaatcaacaaacattaccctgaagtccttcaagccatagattatcatctccccagcctggcgaggccccttagccccccagtaatggagatggggtgctggagggaatcccacccttccactgacccttcccctctggcctctctgcgtggtaggactcagttctcttacctgttaattgggggtgagaatccttctcccaccagctgggaagagggtagggagcaggggtctactgaactttttttt

SEQ ID NO: 137323 - DNA, 931 bp, Homo sapiens
caacggtgtctggggcagcagcgagtactcactcggctcgagatgcgtcaaagtggatcagagagcagtctcgtcaatgtgtcagaatccatagcagtatcaggtacttccagttcaaccaacccttggggccgatggtgtgatattatacaaccagcctatagtcaacagaaggcgagggaggaggaggaatgtagaaggtgttgacatcttcttgcggagcagaagtaaacgacgcgaatcgatgtgtcgtaacggcttaactcgtacctcacagatatccacagggataaatccagtacgatcctatactcaacctcaaggaatccctgatacagaaagtccagtgccgagttattaatcttagagatggaaggagagttgcgaggagatgatgcagcaaggagaaaggatagggacaacgggctcagggagcacccgggtcatgtggaagattcgggagctattattcctagaatgcagctacagtgagggaagacccaaacaaaaaagacaccgttgcagaacaccgtcgaagctcgacggtgttctgggatagaagaggagcctggtgatcccaggcctgagcgatgtgggggtgagggggaattgggaggacaaaagaagagctcaggagtgcggaagcatcagaaactttctggcagtatctgtggtcactaagtcaatcaacaaacattaccctgaagtccttcaagccatagattatcatctccccagcctggcgaggccccttagccccccagtaatggagatggggtgctggagggaatcccacccttccactgacccttcccctctggcctctctgcgtggtaggactcagttctcttacctgttaattgggggtgagaatccttctcccaccagctgggaagagggtagggagcaggggtctactgaactttttttt

SEQ ID NO: 137324 - DNA, 496 bp, Homo sapiens
caccgctggcttgtcctgcgccatactcgcgggctcatgtgggtgggcaggcagacccccaaggagccatcacgggcaagggctggagttgattacgtcagatctgtgtgtgtgtgtgtgtgtgtgtgtatttgtatttgtattcttgggtctataacatatagaaatataatatatttgacaataacagtacaaaggagatgggtgataataaaactgtattgatattaattctttaattatttggttgaattcagcagtgaaataaccttgtcataaacttttccttttgagaactttttttgatcactaattctatctctttacctgttataggtctactcgtatttaccatttctttttgtgtcagtttttatagcttgtatctttctaggagtttgtctatctcattgaaatgatcgaatttgttggcatacattgttcataatattcacctataatccattttattttggtaatgtcattggtaatgttg

SEQ ID NO: 137325 - DNA, 257 bp, Homo sapiens
aaataatttttaatgctttaaaatttagtaagtgcacacaatacatgttttagcagaagaatgaaaatgtgtgtatggcatttaatacaaatttacattacaaaatgagaccatgttaggaaaacattagaagtaaacatttaagtaaaaaccaaataaacaacatgctaagggatacaatttaaaaaatcctagtaaatgtagttgcctaaatccagacttgaaacattgagattgactttgccactaaaaaaaaa

SEQ ID NO: 137326 - DNA, 448 bp, Homo sapiens
tggtttgggaatggagcctgctgtcacggtctgactaatagctgaggaatccctagttatggcggcagaatgtatcataacgatgtttactttagggcttggcagtgacctcgtttattatctcaggctttagaagaaatgaagaatgggcaactctttgcatttgggtagggagctggctttgaggtggaggggccacccatccctgtgtatctctcctcattgaaggttcttggggccggctgacaaaatggagatcaacacttcactggtgtgtcttgaatacttctgtaaactgctttgatcttgaaaatgtgcagattattggtgaattttttcaagttgtgctttctccattgctggcaaagaaaacagagtggtagcttttccaggaccgatttcttttatgtcctgttaggctaaagaatgaactgaaatgaaggataaa

SEQ ID NO: 137327 - DNA, 399 bp, Homo sapiens
accagttattcattcagtaacacttactgaatacttaatattccagagaaatgaaaaagccaaagtcctcgccttaaagttgctcacaatctcatgggggagaccaacacataattataaccaattcttatttagcacttactccatgagagatatacttaacaataattcttcagaggtagaaaggattaccatcccttcttagagaattgaagcacaaattgactaagcaaccttctcaaggtcacacacttaataagtggcagagccagaatttaaacccaggcagtctggttagtttgtgctttaacacctactttatgtagctgttctgattattaaaatacagtgtaaaaagtgcaaaataaagaggtaatacacaatgagatcaaaacctaa

SEQ ID NO: 137328 - DNA, 489 bp, Homo sapiens
cgtcaaaaaaaaaaaaaaaaaaattacatgtgtggcttacattggtgactggaattatatttctgctggacagtgtagtgggctgaataatggccccaaagatttccaggtcctactccctggaaaccgtgaattttattttacaaggcagaaggaactttgcagatacagccaagggtatggatcttgagatgggagcttatccagaattatctgcgcagactctaaatggcatcacaaagtaggcagaatgcgatttgacaagagaagagaaggaatttgactgtggaagcagagatcaaggtgattgatgtgggcagccaccattaacaggaagaaacaagcaaaagaatctttctcccccagagcctccggaaggaaccagtcctgatgacactttgactttagccccataagactcattttggacatttggcctctggaactataagagaataaatgactgttgttttacgctgctaaaaaaaa

SEQ ID NO: 137329 - DNA, 451 bp, Homo sapiens
ctgggaagaacctcagttgttagagcaaccatcacaatagccactgtgtgcccaggctattacatgccaggctccacgccaagcactctacttacacaccctctctccctgggattcccaacaggctacaagagggggacgattgtcaccctttttacagatgcagaaacaggatgcccagagaggttataccactagcttggggtctcacagacaggaagtggcagaagagaattagatttgggctcggaccccagacaccacctcctgctattctgttggccatgaaaaccaagaatcattctaaaggagcgccagggtaacagaagctggaggaagaatgacaaattgccaggactccatgcagattggccaaagccattcattactcatgagccctggaccagcttcccagtaaatcaacccattcaaggtttgattgtgtttggga

SEQ ID NO: 137330 - DNA, 476 bp, Homo sapiens
aggtttttaaatctctttcagatattttaagtatcttttttgtgtctggattcagagaggtatgataatgagattctcttctagaggggaagtgggagtaggtaaccatactactctttctacggctacagagccgcatactcgaaggagggagatttttatttgtaaggacatttgtattatctttcattaaagtagagtcccatgggcgtggcaaatggctgtaaataaagtaaaagtggctaaagaaaacagtgcctgctattagcttgatgctggcattttcttctttccctggatgtgactgttattgtctttattgggtccccttattatctgctttgatatccatctctggaactttgatctctaattttttttttttttttttgagacagagtctcactctgtagcccaagttagagtgcagtgacacgatcttggctcactgcaacctccacctccggggctcaagc

SEQ ID NO: 137331 - DNA, 222 bp, Homo sapiens
ttgtggtccattcatagattcttaaatacatttagacattttgatctagttttagttacacattttgttagaaattggcttatttaaaaataatattgtattgcatttatatccaaatatcttaatatagtttcaggagctttaattagaatttacatttatacacacacacacacacacacacacacacacacacacacacacacacacatatatatatat

SEQ ID NO: 137332 - DNA, 173 bp, Homo sapiens
gaggatactgccctacggcagtgaagagcactacatctcagccctccaaatctcagctccccactagcaggtccacctatacatccccctactatcttcttacccaaaccaatagtccttctggcccttatttccaaaaacaccacaaatatttccccagtcactcaagttca

SEQ ID NO: 137333 - DNA, 292 bp, Homo sapiens
tgctgggattacaggcgtgtgccaccgtgcccggcccattctgttctatttttaaaagcagtactgctcataacctactaaattgatttcaaaacctataatctacgtatttttactttctttttctttttcttttttttttttttttgagacggagtctcactctgttgcccaggtggattaaggatttgcaatttattcaaatgcagtgagaacccactgatgggttggggaatgccgtgatctggtttatattgttaaaatatcactcactcctgggagaagaggggat

SEQ ID NO: 137334 - DNA, 242 bp, Homo sapiens
agcaggcggtacctcataatgttgccaggaggttgtggctgcagtgagccgtgatcacaccattgcactccagcctggatgacagatcaaggccctgtctctcaaaaaaagaaaaaaaagaaaagaaaagagaaataaaaacctgggaccttcttcttacccttggacagagcagtctcttaggaagaaaatctaggagctctgaagaaaagagtgcccacatgtgggcacacattatggag

SEQ ID NO: 137335 - DNA, 179 bp, Homo sapiens
gtaatgcatgattctgagaggaggatgttttcttgacttgagtatgttgggtccatttttctcttggctgtgtggacggcagtctcagtggttaacagcataaaatagggttcttcccagggtggcttgaggtttttctatgttttgataaggacttggttttcaggctggtgcttgtg

SEQ ID NO: 137336 - DNA, 461 bp, Homo sapiens
agaactacagagttccaggactgagagcggcctcaagcctccggtgacttcatcctctcccacgtgggccaggacatctgggtctcattttttgatcagagagaacaaatgttctacaactcccattggcaagctgattcagtgcttactgtactcctccctcctgctcagaaaggtccccactaaggtttgacttcctgctacagctgagggctctttcttccataccgatgaactgagagttacttcccatgcgtaggcctcatctctaattgtccaaggagagagaactctgaaaagggaacccctccttccccaccaccccacctttacaaagaaatcataagggcagattatgtttctcacattaaacacaacacagaaaggaatcaaccacaatagtgagattttgaaaaagggaaaaaaatctcgataacatcagcaactagtgatgggagttc

SEQ ID NO: 137337 - DNA, 352 bp, Homo sapiens
gacccactgttttatagtctctggtaggacattttaaaatcttgtttaggagcattattttttaatagcatttaaagaaagtattgtactgatacttcctctcccagagggaaaacaattacaacacaattacagttttattaattcaatcagcaggaactgtattctgattaagaagcatcattaaggccaggcacggtggctcacgcctgtaatcgcagcactttgggaggctgagactggtgaatcacctgagatcaggaattcgagaccagcctgaccaacatggctaaaccccatctctactaaaaatacaaaaattagccaggcatggtggtgggcacctataatc

SEQ ID NO: 137338 - DNA, 491 bp, Homo sapiens
aaaaaacccaattaaaaaatgagcaaaggacttagacattttctccaaggaagatatacacatagataagcaaattgaaagattttctgtataactaagtatcaggacaatgcaatcaaaaccacaataaggtattactttacatctgttaggatggccactataaaaaaagtagaagataaaaaattttggagaggatgtggagaaaacagaatcctgtgcattgccgttataatcgtgaaaaagtaaaactgtgatggcaaacagtatggagcttcctcaaaaaattaaaactggaactaccatataatctagccatcccatttctggatatatattcaaaagaattgaaaacaagattttgaaaagatacggttacacttgtgttcatttcggtgtgattcacaacaaccaagaagtagaggcagtgtaatatccacggacagatgaatggataaagaaaatggggtatatatataaaatggaatatt

SEQ ID NO: 137339 - DNA, 125 bp, Homo sapiens
atgctcaacccatacaaccttacagaggggtgacatctatcagtcaagcaagagtcatcctgcagtaccttcctttataatggggccgaccacaggggcaggcactgggtttcctttttcaggtt

SEQ ID NO: 137340 - DNA, 239 bp, Homo sapiens
gtacatagttgccaatgatgattatcttgtagaaatcaacttttagttaggaatgcactgcaaaattattagattatttcattagatctttttatgggacaattacagtaaaatgtaagtgaattgtgatatcatttgtaaatttaacttatgacaaaccagacattttactgtaaacattagttattaaagtatcatttcagctaattgcttcttgtagggaataagtcagttttata

SEQ ID NO: 137341 - DNA, 305 bp, Homo sapiens
actaaatgctgacctcgtccaaggcattgttccatccagcgaaaatatgattcaacccacatgtaattttagattttctagtagccataaagttagaaaaaacagatgaaattaattttaataatttaacccaatatatccaaaacattatcagttcaatatgtaattaacatcaaagaattggttcatgagataacttggcagggtgcagtggctcacgcctgtaaccctagaactataggaggctgaggaaggcagattgctggagcccaggagctcaagaccagcctgggcaacacagggag

SEQ ID NO: 137342 - DNA, 524 bp, Homo sapiens
caaaaatgcagaaaattgcaaaaggaaaaaatagttaatgagctcaatacacacagacagcagttgacattaccagtttctcaaggttttactctatcacatattttggtggctattttcgccacaaaaactgttctgtagtctacctctccactcagtaccaggtcttgaatgtcttcctatatcggtaagaaccagctgttttcaataataatttggtaattggttataaaatgagtaattaattgcactacgttattatccctttggtggttaaagccaccttcagcagcaggaacaagcatcagatattaagtgatttaaggatcagtttcctgagatgctacatgctgaaattctgtggatttctagattctgctttgttttttccatgtaggtatattctaggtggttttgttagggtgaaggcacagctgtctagaagcagttggggctggtgccagtgtttgactccagtgagtcttatgatttggtcttgactcttgaatctggactgtgtttcc

SEQ ID NO: 137343 - DNA, 201 bp, Homo sapiens
tcactgctggtgggaatgtaaaatgacgcagctgctgtgggatgatattgagaagatatttgcgatgatgatgcatgttgctgaggcttggagtgaagacagtctgctaaaacaatggataagtatagagtgtaagaggaagagcacgtctttgactgatttggggaatgggaactaatagatttcattttggatatgttg

SEQ ID NO: 137344 - DNA, 173 bp, Homo sapiens
caagaactcctgtgtttgaggcatacttatcctctcgaatggggcgctactgtttctcgtatcaaatctaaatgctaccatgtggccctgaacgtctgcactccttgtccctaccctaatggaccagtgttatctcccatgactccctaactcaaaccttctgcttcaggcgg

SEQ ID NO: 137345 - DNA, 142 bp, Homo sapiens
agttcacctacctcataggtttattgtgaggattaaatgacttgatacatgtaaaatgcttagaatagtactttagaaggcgctatgtaataaacagaaggtgctaggtagaagctcttatttcatcttttgttgccttcct

SEQ ID NO: 137346 - DNA, 259 bp, Homo sapiens
ttcttgaggatcccctgcggtttctacctgacctgtggatgctgaggaagtgctggtgacaggaagaggggtgacgtgacctgtagatactgaggaagtgctggtgacaggaagaggggtggtgtgacctgaggatgatgaggaagggatggtgacaggaagagaggtggcgtgacctctggatactgaggaagtgttggtgacaagaagaggggtggtgtcacctgtggatactgaggaaaggctggtgacaggaaga

SEQ ID NO: 137347 - DNA, 893 bp, Homo sapiens
gcctcggcctcccacgatgctgggattacaggcgtgagccaggcgcctggccttcccctttgcttttataccctggaattagttgttgctattcttatttgatgaagtctgcttatttgaattcactcacctgcttgccaacttttttgccttcccttccttcttttatcatacttcatccttttgagttaaatttccttcttccagaggtaggctttaacactgttttttagtgagagtctattggtgctaaactctttttgcttacctaaaagtgtttttatttgtcataaccattggataatttagctagttataaaagtctgggttggcagttactgtttctcagcaattagatgatgttattgtgtttcattatcttctagcttttgatattactgcatttgaaaagtcttctcaactcttagagttaatgtttttttctcttggctgctttatcttgtctttactcatggtgctctccaaatttactgtcatatgttccggatttaatttatttttatacatctgtttgctatttgtccttgaatatcaaatatcatgtgtttcacagcacctaagaaattatcatctagttatctcttcaaattttacctttcttttattctttcccatccctccttttgaaaatcctagaaattttatattgggccttctgtctgccttcctgtttcttaaactcttttgtattttccagttctttatatgctttactatgggtaattccttatctctgttttcagtacactaatccttccgtccgtccatccatccgtctcgctctgttgctcacgctggagtgggctggcatggtggtgggcacctgtaatcccagctacttgggaggctgaggcaggagaatcacttggacc

SEQ ID NO: 137348 - DNA, 345 bp, Homo sapiens
caacagggctgataccaactcaccaaggtgggttgtgcctgctgcctccagttcctctgccctccatcagtccttcatccttgcaactgaatttccaccctctctactctacaggcatccaattcccatggctatcactaataccataattacaaaacccaacagttcttcaggctttatttgccccaagtttctccttcacatttgacaacttggtatttctttcattcttagaattcctcgtcccagccttaagacactactatctagaatctcacccttttgcagagtcttcctcttcttcctgcccctacataagagggcccttcctaggaaactgaagac

SEQ ID NO: 137349 - DNA, 530 bp, Homo sapiens
ctcttcctccattgttgccatggggatgtaggggacccaggggcagcagtccaggtgctctaggcagcctgggacttacaaagctggagataaggaatgaatcttagtcactgtctttctattaggttactttaaacaactctaaaagttgtgcagacataatttgtctatgatgtacttgtttgcaagagagtttcataaaatcattagtaaaaacaacctgctacttcagttggaatattggcagcccgggcgtgattgatggctcatgcctgtaactctgacactttgggagaccaaggcaggtggattgcttgagctcgggagtttgcgaccagcctgggtagcatggtgaaaccctgtctctacaaaaaatataaacattagctggacgtggtggcatgcacctgtagtcgcagctacttgggaggctgagctgggaggattgtttgagcctgggaggtgaaggttctagttagctgaaatcacaccactgtattccagcctggctgacagctagactgtctcag

SEQ ID NO: 137350 - DNA, 296 bp, Homo sapiens
gttgatgagttcttggactaagatatggttaaagtcttaatgcgaaatagcaacagctggtcctgaggagaggtgcaataacaaccccttaacatggctgatttggcgcatatcagtttgccctgcagtgttgtgagtaacagtcagtgataatgtttgcaattccataattcagcagtctttccttggcaccagatgagagcagtccttgcatgcaggaatgagtcatgtaatagcagagatcattcttacaagtaatacacatctctttccattagtccaaaggcaggacattg

SEQ ID NO: 137351 - DNA, 447 bp, Homo sapiens
agcgcctgatccagcctggctggtgtgcccaagaggaggagaagtgactttatgtcagcctgacctgcaggcagtcagtaaacagattctgttatcaggtctacattccacaccacaggcagtgcagatggaaatccgagacaaatgtctgtggtcatctgtgacctttactttcaccccaaagcttgtagtatcaagagctgggactcctatgaagggaaaagcccaaagaagctttaagagctaatggtctgcactccatgcaggagcaaacttcagggccaccactctgaccagcggtaaaacccagtccagcgcgaaggacagtgggcaggtctcagctcctcagcccccaccagccactggccactctctcggcaagcagacatcctgtcagttcggccgatttgtagcccagacacaaactctcacgtcttatttaccaaa

SEQ ID NO: 137352 - DNA, 433 bp, Homo sapiens
cgcccagctaattgtttgtgttttttagtagagacggggtttcgccatgttggccaggatggtcttgatctcctgaccccgggatccacccaccttggcctcccaaagtgctgggattacaggcgtgagtcaccgtcacccggccctggatcttttagctataaaaaaagtcattggaaactttgattttctgcctcttctcctcttttaatgtcgtttcttcacagtagtttaaatgatggctaattgtgctgcagcatttggtaaatgtcatatatctacttttctaaaagcagtgaagtagtgtaaacatgtggcatcttttttcaaaagatctatccagtaattatcctgaaggctattacagtatgcaaatagcaaggggcgtccttgtctcctaaattagaatatcaatattgattcaacatgttca

SEQ ID NO: 137353 - DNA, 426 bp, Homo sapiens
tctgttatagcgctagcaaatcccttccaggaaggctcctcagagcctcgacaggtacacagtggactccctccctctgcggggacttcttactgagaaacttgattgtagatggaagcttctcagcacattccaaactgtgaccatggatcagtgtgggccatgttccagttgaacatactaggaagtgctttgctctgtctcagtccccatggatgcagaactctacagcttttgttttccttacactctaaggaacttgaatagcatgtaagtgcatttccagatacacagagactggaggtaactgtacaggagaggtctgcttaatcactcctctttgcgtatgtttgagacaggtgctcagtaatccagtattacagatgatttaaatgggtaacctattttcatttgtctcgcttatat

SEQ ID NO: 137354 - DNA, 405 bp, Homo sapiens
cctgctgggcttaagtgatcctcccacctcagcctcctgagtagctaggattacaggcccacgccaccatgcgcagttcgtttttaaaatttttttgtaggacgaggtctcactatgttgccgaggctggtctcgttttatcttcttaatactacaagatatactcacactgttgcattagaaatgcattttggatcctagaacttgctataaactaaacctgacgaggaatggtttgtacatttccttttaaacgtttccatacactttgtgtgtcactttggatgtgctttactcatgcatttatcctcgcaggccctcatgacgcccgagtgtcaggaatgttatgggtttgtgttgtgtgtcatctgcttgttcccccatctccatatgtgcttcctattc

SEQ ID NO: 137355 - DNA, 859 bp, Homo sapiens
ctctgagacaaagacctggtcatttcagaatcccaatggccactaaaatagagggattccaacctaaaaaggaggaagaggaggctgctggaaagcaaaggactctgtgtaagaatcataatagcaggagtggagccaagatggccgaataggaacagctccagtctacaattcctggcgtgagcgacccagaagacaggtgatttctgcatttccaactgaggtacttggttcatctcactggagagtgtcagaaagtgggtgcaggacacttggtgcagtgcaccgagcatgagccaagcaggacaaggcattgcctcacctgggaagtgcaaggggtcagagaattcccttccctagtcaaagaaacgggtgacagatggcacctggaaaatcgggtcactcacaccctaatactgcacttttccaatggtcttagcaaacggcacaccaggagattatatcccatgcctggctcagagggtcctaaacccatggagcctcactcattgctagcacagcagtatgagatcaaactgcaaggtggcagcaaggctgggggaggggcgcccgccattgcctaggcttcagtaggtaaacaaagcagctgggaagctccaactgggtggagcccacctcagctcaaggaggcctgcctgcctctgtagactccacctctgggggcagggcattggcaaacaaaaggcagcagaatcctctgcagacttaaatatccctgtctgacagctttgaagagagaagtggttctcccagcacacagctggagatctgagaatggacagattgcctcctcaagtgggtccctgacccccgagttgcctaactggaggcacacccc

SEQ ID NO: 137356 - DNA, 180 bp, Homo sapiens
aacgtcgcaaagattaatatagtacaaagaaaacctatatttctttacccagattcatctgttaacattttaccccacttgcaatatctttttatgtgtatgtatctaagatataaatatacacaaatgtgtgcacacttttttcccccagaaccgtatgatgataagttacatcttagc

SEQ ID NO: 137357 - DNA, 349 bp, Homo sapiens
aggccctggggctctacagtaagctgctggtaaggcctttcaggcctgtgttcttcccttcaagatggcgaatttccccaggccccaggtatgtccagatgtgccatccaggagccagagactagcattaaataccttagatgtctaagtggtattctattgtacggcaactgagctggcactcaaaccacaagatgcaatccttcccactcttctttcctttttccaaaggtagaggagtttcaccctgtggccactgccaacatgaggccatggagaatactgccaagctattgctgatgtttcctttaggtccaaagtctcttcagtcagcttgtgatgattgata

SEQ ID NO: 137358 - DNA, 487 bp, Homo sapiens
taatagaatgggtctgattcaaagtcaccttcttatgccatgacacatttttttacaagctgattagtatgcaaaccatttgaaaatgaaatcattgtgtttattatcctagtgaacacattcagaaaatcagaggtggtttctctgagggcaagatgctcccagagacagatgcagtaactatgggagcattaaggtagtgcagtagccttttgtgggccatgacttctgcatttttgactgtttagacttagagccatctatgcagatgcctgcacatttcaccctatcatactcattattcacaccaacacacttaacactgtcatagatactattattagctttaagctaaaagactattacaatccactctttcaattttaatatgaattcaggttacactctattcagctgtacctaatgaggaaattaaatacactgtatgaaggtactatttgacgtagttatcttttctatattggca

SEQ ID NO: 137359 - DNA, 251 bp, Homo sapiens
gcaatgggatgtgcacacacacaactaaacaaattgcatcactttataatcacgtctaagatatccgaggagggaaaagaagaggattctacgtcctattgcaatatcaagggaaacggaggcacctggaaatgcctctctacctggaattcttgccagaaagggtccacatttcttgcctctcaccccatctatgtgatgcagctccagctccgggcagagggagaccttctgggagctgctgggggtgt

SEQ ID NO: 137360 - DNA, 338 bp, Homo sapiens
tcagggagacaggaattgtaggtaaaatcctaaatcaacacatggaaagtatacattggtttggcccaaaaaggtgggccatctctaagtaggggctaacaagtcatagtgggctttaggaattttttagctggcagtcggttgaaagagttaagctttgtgtaaagacttgaagccagtacaaaaatgcctaagttaacggagtctgttgtctgtcatgtgatgctatacctgagtcaggttggaaagaaagccacattaacaccagttaatttttttaaaaactgatgagattttatggtttatagggtgagatttaaccttgtctggcatggcct

SEQ ID NO: 137361 - DNA, 587 bp, Homo sapiens
agatggaaaactaacttcagtaattatttctagaaatagagcgcaatgctgggtatgtgagcgggtgggaggtaagggtaagctggcagatgaacggcaggagaagaggaacttctagacaacaggagcagcgagggtccatatgtgggcctcctctcagtcttactggatgatgcaatccgctcaaaactgcatgcctgggaagaaaaagctctatcgtaggggaggggaagctgagcttccaacactggaatctcagaaccatctggcttaacttgttgtttacagatgaggaaactaaggcccagagatgtgaggcaaattggttatcaaccaaccaactagcatctagggaggagccatcaatctctaaagacttggcttggggccatttccccccaaaggctatggcttcgttccctgtaagaattgatttgagaatcctccaaagccaagagaatattgtttcctcacactgggctatagaacacagctttggtgtttgagaggagcaagcattagaagtaatgaggaaagtgagtcatgttttatccagaaagtcagctctgactattctagttctctga

SEQ ID NO: 137362 - DNA, 293 bp, Homo sapiens
ctggcctgaaaatatactttgaatgatatttgtgtagtttaatttcctagaagacactgttaactgacttaaagaattttgttcattataagttgtgagttgcattataagttttggcattgccaaaatgttttccttaaaaggtggtaccaacataaacttccatcgactgagtgtgagtaaatattgttgctcacactgtgttactattactctagtctaaggtggacaaatgacataagtatctttcagtccatttaggttgtacagttagatgagttttgacagatgtc

SEQ ID NO: 137363 - DNA, 265 bp, Homo sapiens
cctgcaaagagccctctgatgcccgacttggcacagatccacctctgagcaaccaggtagagtccgcatccagggatgtcacttccacggcttccatcactccgagtgtggcctggtgttgagtcttcatcacgacaaaggttagggtcagcactgtagccagcatcatggtgatgctgccagctgcaaagctgactcctatggttgtcatgggaccatggagttcctttggcctgagcccattcagccagctcttcactagctc

SEQ ID NO: 137364 - DNA, 464 bp, Homo sapiens
  misc_feature (43)..(43): n is a, c, g, or t
agtccgttcgactgagctaagtggaaaacgtgtgctcttcagnaattcgccaaaatgctcgtgtcctcaaagggagggagcgaaggatcccagcatgaacgtgcataactgaaccacctccaccagtctacctcaggcatggcgggcacaacagggtcctctggagctgagaagcctgatgagcagggagcccattcttctcttcccagaactcttagaaggctatgcaggatgcattctcaaagcatgacacagctttaggagaaatgcaaatgaagggagttctttgcagaagatatagtctttagttcccatgtcctcaatgttagacattccttgaggtcaggggtccctttcctgtcactcggtgtagactcaggcatatagtaggtgctcaatgaattcttattaaacagagatgcctgggtctgggacacctcttggctcagtcgaacggactgggg

SEQ ID NO: 137365 - DNA, 449 bp, Homo sapiens
tcaacctgttctcagtgggtagaaatatcacgccaaagaaacagctgcaatccctatggtatggatgcgagcctataccacgtgaagttagactaagcatcaggagacgggcatacgactgcccactgtaatgatcagttaagcagcgtaacaggagccgggctatgaccaggcactgatgctgagaacacaaaggcgtaatccatgtggtggggacaaacaaatctacaaggtaactccttaacaaaaagggctggctgtatacgtaaacatatacagataagacacttctataagattggagaagttgtatggcccttgttgcccaggctggagtgcagtggcgtgatcacggctcactgcaacctccacctctcgggttcaagtgattctcctgcctcagcctcctgagaagctgggaatacaggcacatgccaccacacttggct

SEQ ID NO: 137366 - DNA, 298 bp, Homo sapiens
ggtggtgactctagaggaccccaccaccagtgggcattttgctggcaatgaatataagccctgatgcctgggcctgaaagcttcctgacctgatctggcttgaactaaggctgaattagagggctcttaactttgttttccttcagctctgtagccccaggcacaagggagggacttgccagccagggggtgggggatccttaggaggggaagactcattatcattaggaaatggagttatttaggtaaaatatattgtttgtttggtacatagagatgtgagaaggctgggggctta

SEQ ID NO: 137367 - DNA, 498 bp, Homo sapiens
tggcagcctgcacgaccaagcatgcgcctcgtgtcctctagggcaggcacccccttagccatccaagctcatccctgagaattcgtggaaacaaaagacacagaatggctcgttccccagccgtttatttttaatttttttagagacagggtgcagtggcatgatcatagctcactgcagcctcaagtggtcctcccaccttagcctcccaaagctctggaattacaggtgtgagccatcacgcccagccacattctccagcttttatagtggggtggctcacagagtcacatcgaccacagccttctggatgtgggggctgaacagtgtctctgttaaaccacacccaggccgaccctcaggtgaccagggtcccaagttgccgtaggtcatgcggaatgacagggctggagacctaccccatgccttcccactgctcagatctgtgagctggatcgtgtcctgttcggcggcacatggctccttctggctgaacct

SEQ ID NO: 137368 - DNA, 456 bp, Homo sapiens
ccccaaagtgcaagggtactgatgctgacatattgctgtaattgttacattttattattgttgttgttaatctctttccgtgcctcatttataaattaagctgcatcatgggtatgtatggatagaaaaaaaaacccagtttttataggatttggtactacctatggtttcaggcatctactgggggttttcaaacatatgtcccacggataaggggggactaccatacaattaattcatttattcattgattgctgattaatttactcattcagcaaacactattgagcacttactacatcttaggcactgttctagttccaagattacagctgtggacaaaattctatatataaaatgtctgctttcatggaatttacattcaagttggaatggaggtaaaataaataaatatagaaataagggacatatgtgtcagatggtggtaatgctatg

SEQ ID NO: 137369 - DNA, 176 bp, Homo sapiens
agaaccttcaggacagcccacaagaaagcatctctgtgatatgacccagacacttcttcctggcccctcatccatccctgcacacatgcctacatccacccactcatctgtgtgttaagtagtctttcaacaaacattcattgactattccaggcactgagctaggcccagctgat

SEQ ID NO: 137370 - DNA, 306 bp, Homo sapiens
tatacctctccaaggaagcttttcttgatcaattttcttctctaatcactgcttctcccagcatttcttctgaatctatttaatgcgtaggatattattttacctatggtgtcacaatactttgcaactgatcttagtttattcatctgtgtgttttctctgtcaactagaatttaaagttcattggaggcaggtacaatatatttaattttttcatactatcttcaaagtcttacatgcagtaagacttgtacagagttttatacatagtgggcatttgcttatttgaattaaaaataatctacg

SEQ ID NO: 137371 - DNA, 444 bp, Homo sapiens
gagcacctgcagcacataatttctggacaactggataggagtccaaaaagggaaagacactaaaagatattggcattcagaaatttctgtaatcccaaatccttgctcaagctgttcacctcctagattgctttccatgacccttttcatttggcaaactctcattcacccttaaggagtcacctgagatttttattctcatgggaaagttttcttccttgcctctcactttcactagaggaccatcttgtgtgctttcatagcaccctactgctgattccaactgttccacttagcactctgcattgaaagtgcctctttgtctccacccagtagagtaacttcaagatcaagctgatcccttttggagtaacctcaaaaaaaaaaaaaagttaatttgatatgttcaatgggatcctaacatactgaaacagtgggctaaaa

SEQ ID NO: 137372 - DNA, 353 bp, Homo sapiens
ctgcctcagcctcccaagtagctgggattgcaggctcctgccaccatgcccagctaattttttgtatttttagtagagacggggtttctccatgttggccaggctggtctcgaactcctgaccccaagtgatctgcctgcctctgcctcccaaagtcctgggattataggcgtgagccactgtgcccagcccacttcttgaaggctataggatcacctgctttgagtgaaatgggcattcacttcaaacagctgctcgattcaagtgttggttgaagcaagttgacttactcagtgcctactgtgcgccaagctccaggctggaatggggctcgtggaggtaacagaatcagc

SEQ ID NO: 137373 - DNA, 237 bp, Homo sapiens
gctgcaggacttggggttggtttctctgggcctggagacttgtcttaggaacctggccagtcctttcagaccgactggaatggggccttgccttgttcttgagagattcaccattcctactccccatcctatgccacaccaggaactggggttgctgtggcacatgtcctgccctcctggtgcctattaggctgcctttgaccaccttctctgaagctaaatgctcacctgagccgc

SEQ ID NO: 137374 - DNA, 610 bp, Homo sapiens
gtactgttatcgatgcacctctggggggtactgaagccagtcagcttgtactcagttccctgctgagtaaaaaacagggctcgatgttccaccaatgaaggggtcagcaatttgagggctgtttaagacagagacataggccaggtgtggctcaggcctgtaatcccagcactttgggagactgaagcgggtggatcacttgagctcaggaattggagaccagcctggccaatgtggtgaaaccccgtctccactaaaaatacaaaaacatgagctgggtgtggtggtgggcgcctccagtcccagctactcgggaggctgaggcacgagaatcgcttgaattcaggaggcagaggttgcagtgagctgagattgtgccactgcactccagcctgggcaacaagagcgagactccatctcaagaaaaaaagaaaaagaaaaagctgctgtggagcatgggcgagcactgctgcctggacaaagaccgagggtcctcgggagggcagtactgatgtacaggtttccagcaggtcggcgtgtgtgttctctcctgcaggtctgcagccaggcgtgccaggagagggggagtctgagggattgatgtaggttg

SEQ ID NO: 137375 - DNA, 351 bp, Homo sapiens
aattcgatgacgcaagtattatgctgtatcaaaaccagaaaaagatagagaaaaataaaactagaggccaatgtctcttacaaaaatatatgtaaaaactgtcaggaaaatactagcaattgaatccagaaacataaaaagattacacacaaagatcaagtgcaatttcttccaaggatgcaagagtgccataacatcttaaagttaattgatgtaacacacactatctcaaaagacacagaaaaaatcatttgacaaaattcacaccccatttatatcaactatataaagtgtccagaacaagcaaatctatagaggcagaacttttatcagtggttgtctagagttgag

SEQ ID NO: 137376 - DNA, 365 bp, Homo sapiens
agaagaaacaaggatattccaaggtttggctgaataactagagtgatcatttcttgacagaggagtagtggggtttggatgagaaacccaaaaaccagcttctttgccagccctcgtcaactgggctctatcaagacgccaggcacagtgctaaacactgataggcagcgtctcatcctcctgacatctcatcctcccaagcacctcatcctccccctggtcaaaaaacatgccaaggccaggcgcaggggctcacacctgtaatcccagcacctttttagtagagaaaaggtctctccatgttgcctcggctggtctgaactcctagctcaagacatccgaagcagtgcacggggatcctctaa

SEQ ID NO: 137377 - DNA, 349 bp, Homo sapiens
agaagaaacaaggatattccaaggtttggctgaataactagagtgatcatttcttgacagaggagtagtggggtttggatgagaaacccaaaaaccagcttctttgccagccctcgtcaactgggctctatcaagacgccaggcacagtgctaaacactgataggcagcatctcatcctcccaagcacctcatcctccccctggtcaaaaaacatgccaaggccaggcgcaggggctcacacctgtaatcccagcacctttttagtagagaaaaggtctctccatgttgcctcggctggtctgaactcctagctcaagacatccgaagcagtgcacggggatcctctaa

SEQ ID NO: 137378 - DNA, 326 bp, Homo sapiens
aaaaatcgaatctgtttaaagaaattggaatctgtgaaaaacttataaggcaaaggccaggaatagaaagaaatccagggatataagccagcatttggggctgctttccctaattgcatgtcactatccaagaagagatggagagaggtttaaaaactgaggtgagcttgaaacaaatttacagagctagaacaataaaaattgaaattcagcatccatcacacttgtggataggtgtgttaggatcctcaaaatgccactgtacttttaaatgtataatatctagctcatatctagcacaaaaagaattaggaacaggaagattg

SEQ ID NO: 137379 - DNA, 314 bp, Homo sapiens
tatcgatattgttatcaaggacttagctagactctatagttgacacaaagaaataaatgaaacactgttccttaaatattttataatctaggcgagtaggtaagacagagttaggaaatgattaatgaataaataaataaataaccatacaagctttaaatgctgagtccttatggtgttaactatgaatgtagaggaggtaaaatttgagctagtataagaatttataattggtatgtgtgagaaggagtcttagatggagaattgttcctgcaagtctttgcacacattgagactaacaactgtaaagtact

SEQ ID NO: 137380 - DNA, 699 bp, Homo sapiens
gcctcagcctcccaaattgttaggattacaggcatgagccaccacacttggctaaggaaaacattcttaataaaatatttaaattatttttatgacctattgcatattctgctaaatattctgactttttgatgagcatgattataaccctgtcccaagagaatccatcaacttcattagaggtactgcctgcactaatagacatcacatgtagtacagtctcgtgagtaataatataacaaaccacgtgaagggtaggagtgactgtttctttcctctgcgttgcaccctgtcccttttactctacattctgatgaatggaattacaaggccttggaataggtggctggcctgtacaacaaggtaatatccttgttgccgtttcatctccattctgacagttgcctagccttgggtaaagataaattattggtgtttgtagattctcactagcatatatattagagagtttgatcgtcagagttttttcactggtctaatactctcctcattatattcattcttgtttacagaattgctgacactcttattcttttttgaaactgaccccttggtttttctgccctagacactgcctattcagcaactaatcttctgcaagctttttctgactttttatatgccttatatatctggagttatagtttgatatagttaatttgtcttattttgaatata

SEQ ID NO: 137381 - DNA, 186 bp, Homo sapiens
tgaaatcttcagcctctacatcaggagaatggcacgcacatgccaagggacgtggccaaaatggctggtggagctttgtgggaggcagagtgcatggtcccttccccaaagggattagatgcagagacatcaggagagcaagtcagcttttatggggagggtaacagtgtagtcagaagcggcaag

SEQ ID NO: 137382 - DNA, 276 bp, Homo sapiens
gctgggctgtggaggatatgcctgctccacttcctgagacaacgagaaatcgttttctgtcctcctgaaaggggaaggctcaaaagcaaatgcccattttggagaaaacattttgaatctgccaaaggagaccctgagtaatgagggacagggctgggggtccaggtccggctgcctggccgcgtggtcggcctgggctggtggctccactgtgaccctccatctcctcttttggtgccactcgcctcccagagcccctaccaaaaccctaactca

SEQ ID NO: 137383 - DNA, 488 bp, Homo sapiens
cggtaccccagtccgttcgactgagctcactcccagttccattgtaccagtggaaggctgagagatagcagacaggcacccagaagggcagatcttggacaagcccctaaatgtgtaattgcctgatgggctcttcctgactgctgcatagacaaaatcaacttacagagatcacggcactgcaataaagagtttaattaatgcaaggccaactacatggaagaaatggctcaactgactgagtgagactgatttgagtgagaagcgactgatttgagtgagactgatcactgcccaaagtctcagaggctaaagcttttgtggacaatttggtggacaggggggctagggaatggagactgctgcttagttggggatgaaatcataggggtaaagaaaacggtcctcatatactgagtctgcctcatatactcaactgggccacaggaccagatgagtcatgaggcaggctcagtcgatgcatgtgg

SEQ ID NO: 137384 - DNA, 189 bp, Homo sapiens
ctcctcagtcctgctcaccctctcctcacatcagacataaaacaactgagcaactccacacacacacctcctgcagctgctccatgagaaaacagtcgggcccggagagaagcacatctcagcacagttcctccccacctttgcactcagtttctcctccgtccctcaaatcttatctcaatcatgcca

SEQ ID NO: 137385 - DNA, 289 bp, Homo sapiens
atttagcggcctaaaaagcatccgttttccaagttctagcgccctttgccttttcattgaaaatatcggagaaggacgtgattaaaagtatttgttcaggttgtgaagagttgacaaaaattacaccacccaaagttagcgaaatactgctaggaaaatacatttaaggataatatatttttctcactttgaatttcggatgtgcaactgaagtctttatggcatcaagctttctatttttgtttctttgaacagtggacttaatttgtaagatgagcctcatcgtcaa

SEQ ID NO: 137386 - DNA, 203 bp, Homo sapiens
ataaaccacctacgttcataatagaacttttgggaccttactgattgggaatgcttgtgaaacaccaaatatgtcataaggagggagaattaaggttaatctaaaataatgagaacacttgttcaacaaaatatttgctacatgcctattgtatacaaggccttggtgacaaaatgttgaccaatacagacatgatcctagcc

SEQ ID NO: 137387 - DNA, 326 bp, Homo sapiens
tgcaacaagaggatgtgaaagaaaggtggcctgtgtcacacaagtattccttaaaggctgcatccttgtgtatggcgcacaagccacttgctgctatgatatttggctaattatgtctgttgaccttgctttcctcatgtatcatctttatataatagtaacacctacctcatggggtgctgtgcacatgatggctaactcaagtaaggaacacagactttgggatcagtcagtccagtgtcttatccttgactgtaccactaaataattacatgaccctaagtacgtttcctaacttcccagcctgtttcatcatctgaaatatg

SEQ ID NO: 137388 - DNA, 234 bp, Homo sapiens
ctgccctgacgcatgcccacagtgccgcccagagccaagctgcaggacgccaaggtaggggctggcaaagcgtttgactcccaagaatgcaccttctccgggggtggagctgcgccgtgccctgctgcctggcccatactgggggctgctggcgatgctttctggtgaatgcagcaggtcctcatcatgtgctgggctcggagggtgtccagctgagccctcccaggttagggg

SEQ ID NO: 137389 - DNA, 130 bp, Homo sapiens
cagtttacgacatcatcaaagacatgtagagagaaaatacatacacaggtaataataacaatgataattctaatactattttgttagattagaagcatttttcctggacagaagcaacatcacctggggt

SEQ ID NO: 137390 - DNA, 135 bp, Homo sapiens
acaccatggtcaggacggtgggacactggtggctgaacaagatggggaggaagctacctggggtcctgggcccttaacactatttccatctgaggcgtctcagatcccagcatctagtaacaaatgaggcacagc

SEQ ID NO: 137391 - DNA, 249 bp, Homo sapiens
taaattttccaagagaaaaaatgaataggccacaaaatgcctaaaagcaaatgctaggaattgtttggctcaaataacaaaacagagacccttaactaagctgaggacagtggaatattattttgccttcttgcctgttggaagcactaagaagacatttccaattccaacgttccatagaccaaaaggcttaggtgaagagggtttccaggctcacagctcaatgaaaacaatgatgatccaggggag

SEQ ID NO: 137392 - DNA, 589 bp, Homo sapiens
tgcatcaacaggataacgatgatgatgactgagaagcacttgtaaggtcccaaggagccatctggtgaccagggaaaatgttcagtagggatttagggttgaatatattatatttgcactctttgctacagatggcaattttcaaataaccacgttattatgatcccatttccaagaatgggagttgaataagttgtaatcgcctctaatgacacattgatgctatgcagacttgcaagagagcagagtgagaggattgcagtcacctttcatgcttggggtggtcctcaggaagtgaagctgaaggagcaggcaaggttttgacaatgattgtttgacggttttaaggtcatttaaaaaaatgttcccccgtaggctttttataatgaatggtaaactcagttctggaatctttgaaggtttgtccatgactgttctagcagtccccaaaacgggttccaaagaatgcaaattttactggccatcaaaggtttcactatagaatgattgggaaatacagatatctttagtataggcctttcataatctttaatatgttaacatgaattttaaagcttcaagaagaaaa

SEQ ID NO: 137393 - DNA, 281 bp, Homo sapiens
cctatgttgcccaggctggtctcaaagtcctaaactcgagcaatcctcgcatctcagcctcccaaagtgctgtgattacaggcatgaacccatgccctgccaggaatgagctaatttataaacacattttaaggtactatgatacagtgatttaacactgataaaaattctagacgccactccactcaaattctaactgctaatttcaagaaaatttatttgatctagagtagcagtttagagagctttagatttcactgaccagcaaaaacaacaacaac

SEQ ID NO: 137394 - DNA, 371 bp, Homo sapiens
acaggcacttgtgctggaatacatcattttaatcaggattcaaagcaaccagagagaacacgggttgggatagtgtaaaagcactcacattggaccggagttgctgtacatatatcataggtagccaattcaagagcttagagatacatgtaactgtttaaggctgcaaataggtctttaaaggaagagaatattattaaaattttaaattatgcatcaacttatacctaaaatatgtaacaaatatatgttggttttacttgatgctataaattattagggatcagaatttggagacaaattactataacccttagttgagaagctggtaaattcttgatataactccttaaccagacaagaaccacacg

SEQ ID NO: 137395 - DNA, 268 bp, Homo sapiens
agtgcccagaatatactgcttgcttctgtgttttctctatctctactcactcccttgaagatcttctccagtaagatcatgactttaaatactacttttagatagttgatcatgactcctaaatgtatgtctctggcccacacctctgtctaaacttgtatacccaactgcttgttatcaccactcagcaagtccaaaactgaactcctgatcttcttcccccaaacctgatccactgacagacttccatgcaaactacatccttcaa

SEQ ID NO: 137396 - DNA, 479 bp, Homo sapiens
tttgaaaccagcctacaaaccctgtttctacaaaaaaatagaaaaattagctgggtgtgacggtacgtgcctacagtccccagctacttgggaggctgaagcaggaggatcacttgagcctgggaggccgaagctgcagtgagccctaattgcaccactgcacaccatcctgagtgagacagggagaccttgtctcaaaagcaaaaaagatatgtactttaaagatatgtaaacaatacaaaaaaaggagaattttacatttatccacatattgaccatttctggagatcttcattgttttgtgtaggtctagatttccatctttcccaaaaggtatcattttcctcctgcccaaagggcttccttgaacatttcttgtagttcacatccgctggtaagaaattcagcttctgaatgtctgaaaaagtcattattttgcccttgtttttagaagatattttgccagttgtagatttgct

SEQ ID NO: 137397 - DNA, 299 bp, Homo sapiens
  misc_feature (215)..(215): n is a, c, g, or t
  misc_feature (217)..(217): n is a, c, g, or t
  misc_feature (222)..(222): n is a, c, g, or t
ccccaggcctgacctggagctggcctgtggtaaaggcctggccatgactgatctaggatgggtgtcctcctcaccaagggccaccctcaccagacgcttggcccagcagctgtggcccctcctggatctttctcctatgggggacagaaagaggaagaggagccgctgagtggcaatgggtgcctgtgctccctgtgtgggggaagggcaccccnancagtnctagactgtgtcagagttcaccccaaagcccccgggccctcagagttccaagctgggatcagtaacgacaatgataa

SEQ ID NO: 137398 - DNA, 122 bp, Homo sapiens
taagcctttgtggaaagacccacctggttcaagtgtctgtttttagaacaccaatttttcctctctagccaccactctcatgctgtcatctaagtccctccatgaatttaaactcaaccaca

SEQ ID NO: 137399 - DNA, 439 bp, Homo sapiens
gggattacaggtgcccaccaccacgctcagctaattttttgtatttttagtagagacagggcttcaccatgttagccaggatggtcttgatctcctgacctcatgatccgcccctcttggcctcccaaaatgctgggattacaggcgtgagccaccgcacctggcctcacaaatgctcttgatcatgttaaggaagtttacttctattcctagtttgctgaggtttttgtttgtttgtttcagtcttaaaaagatgttgaattctgtcaaatgctttttctgtcagttgaggtgactgtgtgggtttttttttttttttttgagatggagtctcactttgtcacccaggctggagtacactggtatgatcttggcttactgcagtcttcacctcccagggtcaaatgattctcctgcctcagcctcccaagtaggtggg

SEQ ID NO: 137400 - DNA, 420 bp, Homo sapiens
agaacgtatgggtttgtactggcatagcattgttgaattgaagtaaaataggtatattttttaaattgaatcaacatgggggatacagtgaaaactggaaagaaaaaaatgttaagccagataattctgcaaattcagattcatgttctctatctggccataaatacaaatgtatcacatttttcaattaacccagccctactctgattaatcattccctcagcatccaattaaaacttagatattcaaagctgggcatagtggctcacacctataatcccagcattttgggaggccaaggtgggcagatcacttgaggtcaggagttcaagaccagcctggccaacatggcgaaactccacatctactaaaatacaaaaattagccaggcattgtggcgagtgcctgtaaacccagcta

SEQ ID NO: 137401 - DNA, 376 bp, Homo sapiens
gggatcagtaccccagactgtgagataacaggatcgaattcaggggttggttggtgatccaggaaccatacctacttggatgtgatactgagtggcctagacgttgtaggactctcataagttttagacattttgttatactgtaaaaatgaagcatatacggcctcagtagtaacattgcactaataggtaattattactctagagaattttgggttccatggctggaatgttcatcagtatctcagcaatttcagttaataaccagattaagctgacctcttgagtcttttgaaatctgctgggtccctataataagacagggtctggattttttaatcttttgggaatttccaccaaggatttagggaaatag

SEQ ID NO: 137402 - DNA, 397 bp, Homo sapiens
  misc_feature (22)..(22): n is a, c, g, or t
  misc_feature (35)..(35): n is a, c, g, or t
gaaattcggcacgagccgaacntaaagtggggcanacataaccttgctgctatgccttcgaagctgtagtctgaatcaacctaagttttaaacagaaggtgaacctctgagaaaatccagttcttagaggaaaagataaaagctaacagtaagatgtcagctgtggatttatcatatatggccattattatgttgaggtactttccttctgcacctaatttattgagagtttttatcacgaagggatgttgaatattatcaaatgatttttctgtcctttaaactcttgaaataatggttagaaatgtcatccttttttttttttgttctagagacagagcgagacctccccccaaaaaaaaataataaaagaaagaaagaaaagttacccttaccc

SEQ ID NO: 137403 - DNA, 796 bp, Homo sapiens
atccccggcagaacacactctaatgaaacataacaaagggaataaggtcgactaggttggtaagtcccaaggagagaccggtttaataaaagataatgaattctatggcagttaagttgaaatagaaatgttagtaaaatatccaaatgaaagtgtgcagcaggcagttgggattataaatcttccaagttgcagattagatttggatgaaggcataaacattactatcataaaattataaaatgaacatattagagattttatttgagtcattaatgaatgagggaacagtaagatcataaacagaggagaactcaaaaatataacacatttatagttaaagaatgcagaagtaaatttataaatagaaacaaaagtggccagtatccacagggtgacaatcaatggtattccacaggaaacaatttctggaaacaagaattatttgcagctactacaagttttctataagttaactaatgtccatctctgcagtgttgtaaaatagcctcatcaaagaaacggaagtggatgtaactaacctaaatggaggttctagccagggcactcactaagtttcaggctttcattgtttttccttaaattggtatggaaattttaaactcaagagccttcctactactggagtgtttggtcagcagtagatagaaagaaaaacaagcaatggggaaaggattccctatttaataaatggtgttggaaaaacgagccagccatatgcagaaagctgaaactggatcccttccttacaccttatacaaaaattaagatgggt

SEQ ID NO: 137404 - DNA, 453 bp, Homo sapiens
aaatgtcgtctctggagttctcatttacaaagcacacctggatatacatctcaagcctttcatgctacaaaagacttcactaatttcaagacctgagacccttcagttatttgcatgttactttcatataaaaaagtctgctgttgctctcggtgtttcaactgctggcatagctttccctggtgctcacacattcttggaattgttaccaacttcccaaggaattcttttctaattgggcctctaggcttaattagcttttagaatggaatccaacggtgtgaaaagaagttggtcctttggcttgactttccgaggcagaagaggcaagccatcaattaaaaagcttccaaagggcagtggacaaagagcttaggagagccttagctgtgtgcatcacccctgcaactatgtggtggttgtcagaaggctgacaggtgggggcggggccag

SEQ ID NO: 137405 - DNA, 534 bp, Homo sapiens
tgtctcggaagacacctgggaggggctaacaccaccagcccagaaagcccctggcttccccagcccactctggcctctcctgggtctgcccagcccaggcctccctcactaccctgccccggccaatgcaccatcaaaaatcccacagggagcggggactgctgggacgccatcacaggccacgcaggagattggccaagctgagaaagaactcaggagggggtggaagggcaggacaggaaaacagcaaaggagaggctcagggccatgggggaaaacaggcagagaaggcctctcaggttcaaatgcaaggtgagaattcaaacctcacatcagccactcaccagctcttggaccggtgacttcacctttctgtgcctcattttccccatctggggagggggagtaataagtagcacccatggccgggtgcagtggctcaggcctgtaatcccagcattttgggagactgagatgggcagattacttgaggtcaggagttcgagaccagcctggccaacatggtgaaacccc

SEQ ID NO: 137406 - DNA, 151 bp, Homo sapiens
tctcgttccatcagtgtcaacctgccccactctctcaaagacaaaacaagactttgttaatcccacctggccctccagctcccctcctcctaccaactgccaaaccaagagggctgtccatcctcacctctgtctcccagtcactccccga

SEQ ID NO: 137407 - DNA, 274 bp, Homo sapiens
aactcccaggcccccaagttgtgacaaccaaatgtctggttgacaactacatgtggatgtgtttcagcaacttgaggcttcagttttgaaatatagcatttcattctttcttaaacaattggatgtccctattttatgccattagtatccagtacaatccttaatgagatctgttgtctttatgtgtctgaacactgaagttggttgattctttttttgaaaatgactcaggttttgttgaattcactggttgtctgtcttgataacagcatga

SEQ ID NO: 137408 - DNA, 407 bp, Homo sapiens
aaagaaaacagggaataaagagtttcctttaaactagaagttcagttaaagaaattaaaaagtacctaaggatttttaatgcagtgttctgtgcagtgttctgcagtgtgttattaaaatttacttttcaaaatatatacattaattttgtttttgcttttttatcaaaaactttgattctgctttagaagttttacataaattaaaatctttatcaaatgttaatatgaagggaggcacaggatgcaacatatatagtcaagttacctctctgtatatttagaaattactttctcctccaaggtatttgcaacagaaagctctgtctgtcctgcttaataatcagtagtacaggttggaatcaaagttcctcttggggaaatggcaagtctttaggacaggcgaga

SEQ ID NO: 137409 - DNA, 324 bp, Homo sapiens
acttttcttcagtcctgatgcgtgggggccaattcatcaggaagttttccaaaccgtttgaggaggtgtgggttatgcagtgatcagggtatacacaaaacaaaacaacattgcctttaatacacatcagaattgacagtaattcttctatgtttttcccctacctgggtcatccagatgaccttatctcaggttacaagttgaatttggtaataataaatggttgctttgtatatctagtatgtagaattaattccgctttgtagagttccatatggcctggccactgacccaagaggatcatactttttcaaagacaggatt

SEQ ID NO: 137410 - DNA, 310 bp, Homo sapiens
attgtagagtcagtgatgagattgaaaaggtaagtagggtctcatatgacaccttaaggaagctgaactttatcctgagggtgcagcagagtcttctgatggttgtaggcaggaaagtgacttgcgctgctttgtatttgaaaatgctcctcttggttgcaatcaaacagctgaagaataaattgatctctcgggttagagacagtcagaattattgtgaccgaaacttagctttagtttggttattgggatgaacacaacagggccaaataaactgaagaggccaaccagacaggatttggtgattgat

SEQ ID NO: 137411 - DNA, 184 bp, Homo sapiens
gtcttcaccaaatggaataagtggttcagaaagcattgtaataactacatgataaactgcttacataagcaatgcgtatcttttaggattgggtgaagacagttgtttttggaagatattttattatgtagaaggtaggcacaatttcatatgattcatgattgtttaaaaagaccgtgagttt

SEQ ID NO: 137412 - DNA, 281 bp, Homo sapiens
aatggatatcttaacccagtaaaaaccattaacaatttactacagcattttaaagaaacaaagcagaaatatacctcagattcaagttattagctaaagacaacagcaacaaatacatatatccaaggctaccctcagcataagaccattgtgaattagagaagctaccttcctcggggctaaacaagtttaaggcacagtgaatcaagctcaggttggattttttttttccccagagtctcgctctgtcacccaggctggagtgcagtgacacgatcttg

SEQ ID NO: 137413 - DNA, 263 bp, Homo sapiens
ggcggctggggcctggtggggaaggagccactgcatgttttccgacatctttgaattccgcatcatacacacgcattactgagttcaaaacattagagtagctaatagctattcaacactgactctatgccaagcaaggcattgagaacttttcatgattattaacctttttgatttctttttaaatagagacagggtctcactctgctgccctggctggagtgcagtggtaaggtcacagctcactacaacctccaactgta

SEQ ID NO: 137414 - DNA, 385 bp, Homo sapiens
tccccatgcccagcctgatttctgagtggaactcaatagaaagtaacaggcaaccaaccagagggaagatgaatcagctactaggattaatgggatgagaagtttaaatctcttaaaattctcaggaatgtttgtgtttgtaccagatgttcttgacagtcatctagtacaaatcaatcatcttgacaatcaaaccagaatggatgcagaagtccctatggcctatgagaactgtgtttgcctggcatgtgcttccttgaaagtcttatgttaacttcttgctttcctctggccagtttctctaccatggaatgattagcttctacctgcctggctctatttcctggatactgccttttgctccttactgttttcctgagcagaa

SEQ ID NO: 137415 - DNA, 176 bp, Homo sapiens
ttcaccatgttggccaggcaggtctcaaactcctgacttcaagtgatctaccacctcggcctcccaatgtgctgggattataggcatgagccactgcacccacccgacgtgaatactcttcatttttttctctggcctgatttccttggcctgaacttccaatcctatgttgaata

SEQ ID NO: 137416 - DNA, 729 bp, Homo sapiens
gtatggtgtatttcactgtgggttttaactgacatttccctgatgactaacaaagttgagcacgtttcatgtgctaagtttccatttgagtaagtgatggtcttgatttcctataggattgtctaccttttttcttaataatttatgagttccttatatattctggatatgagacttttgccatgtatatgaattgcagatatcatctgccaccctatggctttgccttttcattctcctagtggtatcttttggtgagtagaaattcttactttcaaggaagtccagtttatccttttcccctccttgtgattagtgcttttgtgcctcttgtttaagaaacctttgcctagcctaagattatgaaagtactctcttgcattttcttctaaaagccttatggtttactgttcacaattagatctgtggtccaactgaaactgtttttatttttgcatacagcatgatctctagggtcatggttctttttgtcctccccatgtagctatccaaataacctagccccatttattataaagagcatcctttcctcactgaatttcagtgtcatttttgtcataaatcaggtgaccatatatgtgtgggtctgtttctggccactctattctgttccattggttgttttctattcttctgacagtgccaccactggcttaattactatagtttttggtaagttttatactaagctttgctgttggaagtcca

SEQ ID NO: 137417 - DNA, 216 bp, Homo sapiens
atgctccagaagccaccctcaatcattgtggggtgggggatggaggacaaataccctagcttcctcacccctcaacaggacaattctcaggtatggttcatagagtttctcaaaggcttcccagaacaactcatcccacgtttcccatagcagtaacttgctggttaatgtactttttactggctttctcccttcccaagtgattgatctccgctc

SEQ ID NO: 137418 - DNA, 479 bp, Homo sapiens
atagttctctccatgcacgtcactgcgtcctcgtctgattgcacagcggatcatctagtactcccacacacctgcccacttgaccgtccgttgtccatacaaaccccagcacacctcccatctgttacacataggagtaaacctctcagcacttactacgggctggacactgagcatttaatacttagaataaccatattgaggttgagaccactagtacctccattttacagatgagaaaactgaagcaaggagggtaaatgacctgcccaagatcacacagctgcccaaactcggattcctcacctgcctcaggaccctgccaatttgtgttcacacaaggccgatcctgggccaagtctggggcttggttagggaatgtgacgtgtgcagagagctcagcgggcacattgtgggtgccagggctcacggaccaatggagcccactggggggctccaagcacacctggtgtcacaga

SEQ ID NO: 137419 - DNA, 369 bp, Homo sapiens
acccagacatcactgtgagggctgtgggtccccaatgaccctggaagaaggaggggcagggacagtgtattcagctcttgttgggcaggaaatgctcttgcccctgctcaaggaaagaaggggcagaattaggatgcctggagcaagggtatctgtccatgggagcccaggaacccggagggaatcaggccgcatgagggctagaagacgaaggctgagacctgaagctccccagccaaagtgtgcagacttttactcttctgtggctctgatgttattacttggcctttttttccccttgctgctgttctgtgaccctctccttctccctctccctctctctttgtcttcctctctctttaattaaga

SEQ ID NO: 137420 - DNA, 421 bp, Homo sapiens
aaacactagtgtattctatacaacttacttctcatagcaaccctatgaggtagatgttattttcatcttcgttttatccattaaagaaaaagtcacattacactttgaacatgcgatactaaaagtatgtaagaggaatgacagtgacacaaagactattttgaaatttaataaggtagaaccacagtggcattttaaaattcatttaaaaagtgccttctttatatttccctaacttctaaaacaacaaaacagtgttgacagtatagttgtattacataaatgcaaatatgctgtaaggacaggcactttatgagcttaaagcaaagtaaatatttgaattatttggtttaagttgacatgccatctggctttaaataataatcaaactctagattattaatttagacttgcttttgag

SEQ ID NO: 137421 - DNA, 594 bp, Homo sapiens
  misc_feature (14)..(14): n is a, c, g, or t
agttcgacggaganctctctgtggcggacagacaggcacagagagtgtctgagaggtggagggacccctccagagaaacaagagtgaccttgtgctcagcctgagggttggggagtgacccagagcagggcgagtatattctcaccagcctaccccccttctcctttggccagctcctactaaaaggggtctgtgtcgtaccttgtctctttcttgtggggcatctccagcttgggagacaggaacaaagctctgacctagtccctgccctctttgactgctcaccctcttccagcccctctacccagcctcaatctctcattcttcctctactttgaagtctggcttctgtcttggcccctgtgggtttgatgacaaagggcagttcaggaatgacactatctacacatacatggccatatggacaatttcaggtggtgggacttgcagcagctggggttcccaggactgctgacattctgctgagtgttattagaagatcagggacagagcttatcatctggctgtcactgcccctttccaagccacagcgagcctccacagaggggccctgggggatagccagctgccctg

SEQ ID NO: 137422 - DNA, 782 bp, Homo sapiens
gcaaaatggtacagctactttggaaaacagttttggcagtttcttataaacatacaacccagaaatcatactcctaggtatttactcaagagaaacaagaattgtgttcagacaaaaaacattatggaaatgtttacggcagctttattcatagctgccacaaactagaaataattgaaatattcaactattgaacagataaatgcactgtgatacactcatataaaggactgctactcagcaataaagaaactactgatacaacaacacagatgaatcttaaatacattatgcactgtacacgtataaactaaaaaattaaaatacctatttaaaagtcaaacgggccgggcgcgatggctcacacctgtaatcccggcaccatgggaggccgaggccggcggattacctgaggtcaggagttcaagaccagcctggccaacatggtgaaaccctgtctctactgaaaataccaaaaattagccaggcgtagtggcgggcgcctgtaatcccagccactcaggaggggaggttgtggtgagctgagatcgcgccactgcactccaccctgggcaacaagagcgaaactctgtcgatagacagacagatagatagatagatagatagatagatgatttagatgacagagaccatttctttgtttccagtgctttctgcataagaggtactaaataaacctgtattgaattaatgaaaaactgaggtcaagaattctttttgaatgactttcgggtctcaaaaccgttccagttacgggggga

SEQ ID NO: 137423 - DNA, 301 bp, Homo sapiens
gcctcaggccttaagacacatgtgccaataaaatcagacaaattatcattgctggagcccaccttgcacttcctcatgttagctcatttattctttcttcccagaaagtaacctcaactccatttctcccaactatttaaaactaaaattggctgttttaagtcattaatgttttcccctgtaattcctccgatcaaatgagttccttttcctcaaaatctccatgtaatatttatctcttactgcttgacataatcataatgattcttgccatgtcttacctacccctttggcatgtaaa

SEQ ID NO: 137424 - DNA, 813 bp, Homo sapiens
tcaatgaatgtaagtagcagtcactgggaatgcaggtagagactccagttgttcctcagcatatttaaacttgccactaggcaggagcactcagcactctaccctcaaatgcgtacagcaaatgtaacgagccccaagcaataggcttgctaattcttacaactttgacaagcaaggggaaataatgaatatcagtactgtgatcacttgaaagtggagaagaaatgaattgaccccaagtttaagaaatgtcatgcatagagaaagagcagacttctgtgagcagtgaaaatctaagcttgcggccttccccttcatctccccactgtcataacctgcaccccaccgtggagttccttgacctcctcatttccagccaccttctcctctactgcactgctgtcactagaaactccacccaaaccttcatttccaggcagccatactcacagcacctccttgccactgactagtccaccctttccaccatgataactcttcagcctcattggaacctttcagcctaccatgctttctctatcattgcccttctttcttcagttcatggggttggaggtggaggtgagagtaactatgaaataattaagatcatacagaaaatccacttcccaaggaggaccacacttttaaaatcagctgaatcataatctctatttttatttaatattggggctggatacatttttgtagctgtattattagtatgctacatacaaatcttttttaaattatttttttaaattgacagataaaattgcatgcatttactgtgtacaacatgatgttttgaag

SEQ ID NO: 137425 - DNA, 267 bp, Homo sapiens
actttcatgtgctctggggaagctagatgccatgttgtaagggagctcaagccagattactgagtgatgagacaccttgtgaagagagagggtatcattgagaagaactaaacatgtgagtgaagtcttctagagctttgtagcctggtcagtaaccaaatgcatctgagtgattgaccccagccaaagacaaataaagcagaaaaactgcccagctggattttctgacccattgaaatatgagaatagtggggcttctttgtcaca

SEQ ID NO: 137426 - DNA, 118 bp, Homo sapiens
ggccagggccagaaagtgcagaaggttatggtgcagcccatcagcctcatcttcagatacttacaaaatagatcgcggattcaggtgtggctctatgagcaagtgaatatgcggatag

SEQ ID NO: 137427 - DNA, 278 bp, Homo sapiens
gaacctcccacctcagcctcccaaagtgctgggattaactgggtgagccactgcacctagcctaaaatttctttcagtacttacaaaccttgccactttcttgtattcagtgtttctattgagaagtctgatgtcaatttgattcgtgttcctgcaggacagttctccccatggccttggccttatccagttatctcccctttatcacttggagctctcaggaataactgtagaatgggctgagatacaacatcccgagataaagagggactggtgaa

SEQ ID NO: 137428 - DNA, 190 bp, Homo sapiens
tgcaccgtcatccatgtgtctccccgtgagggaggcctggttcctccacttcctcctcttccacctctaagacctcttggagggcctctacttcttggaggtggaggcggaggaagtgattgttccccgctggaaggagaaatggagaactatggatgcacaattgtgcttctatagttgtgtgatttag

SEQ ID NO: 137429 - DNA, 640 bp, Homo sapiens
gtgaataatggtgtggtaaacatatgagggcaggtgtcttttttatataataatttcttttcctttgagtagataccaatctgtgggattaaatgcaccaattttaaatttactgtttaatgagttttcacaaatgcttgtattgtaatccaaatccataccaaaaaataaaacattatcattactttataaagtccctggatgttccttttcttctaattactgacccacccatcagagtgaagttttcctacaaaagtctagttatatctgttctagagctttacataactaaaagaatgtgtatatttggtataaaattttcattcaaaatataaatttttcaaattaacccattttacatgtaaatactaataattcctttcttttaattactgaataacacttcattgtataaatatatccaaataagattaaacaaagaaaaccacagctatgtaaaacatggtaaaactgtgaaaaccaaaggcaaagagaaactctggaagtcagccacaaatagaaaacacattgcctcctggaaagtaataataaggcagatagatgagttttcaacagaaagtatataaccagaatacaataaaatgacatatttaaagtgctgatgtatgttatttaa

SEQ ID NO: 137430 - DNA, 207 bp, Homo sapiens
ctgggcacggtgctgggccttgtgttttctgggaaatgagtcctatgggctgatgcctctcccaactctggccttctgtgctcctaaggagggttctggggccctgcctggaggtgggctggcaccacatatctttccgtcccatgccaggttcctcctgagtcaggcttagcacggcttccccaggccactctgagctcctcgtgg

SEQ ID NO: 137431 - DNA, 368 bp, Homo sapiens
cactcagccttcctggctctgcctgtcctttttagctgggcaagtgggcaaataacctttctaagtaaataattaatcagcagcaacagaagccataaggctttttactcatatattctgatctacgtgtttggttttgcctttttgtttttgttttgttttttggtgggctgctcatggccatagaatgcatacaactttggataagcattttagtcttctgagcctcagtctcttgttttgcttgattgtagtaagtgtgaccttgttctccaaatacgtggtaccatgtcctgactccaggcctttgtgtgggctgttcttgggtgtggactacctgccacctgtccttcctctttgagcataat

SEQ ID NO: 137432 - DNA, 429 bp, Homo sapiens
ctacaaaaaaataaattagccgggcatggtggcacactcctatagttccagctacttgggaagctgaggcaggaggatcacttgcgtctgggagatcgaggctgaagtaagccatgaagtgattgagccactgtactccagcctggggaacagagtgagatcctgtttcaaaaaacaataaaagctaacgggtggttcagcagcatattggtaatgaggctaaccactggacttgcattaacattaccaaaggctgtaccataaagcagcaccttctcaaactgtggcctcttccaaggcaccctcatcataatacaaaatttgcataataccaccaaaatatttcctgcttttttcactcattcactccccagtgatatcacaaaagactgaacacgctgggcatggtggctcacgcctgtaatccca

SEQ ID NO: 137433 - DNA, 223 bp, Homo sapiens
gattttcataagggactgtgcaacctaaatccctcacatgtgcagttcacaatagggttcacgcatctatgatcatctaatgctgctgctgatgtgtcaggaggtagagctcgggcagtaatgtgagccacaggaagtggcttacatacagacaaagtatcgctcactcacctgctgcttacctcctgttgtgcagcccagttcctaacagatcacggactgg

SEQ ID NO: 137434 - DNA, 260 bp, Homo sapiens
catgacagtcttaaccttgcaagatcagatatttacctaattatcctttacctgtagactacaaacatctatagaattacaatcttccctccactacccaaacaccgaaatcaggactgtgtacaatgcatttatacagaaaattataaagagaagctcctttctaattttttaaaagagaggtgtcagggtatgttcatagctaatactctttcaggctgggtgcggtggctcatgcctgcaatcccacactttgggag

SEQ ID NO: 137435 - DNA, 501 bp, Homo sapiens
attttgtgtggctcttgtgctcctgacatttgctttatgttactactaacctattgcctgggcctagaaaacaagagcccaggttgctttgggataaaaataaaaagaaaggagtaggaggtagtaggtaaaagaaaaaggactgtaccttgagtttttaagtgtagtttccatgtggcaccagcctacctatgataaagctattgcagagaagtttgaagagtggagatgtctgctggggattctgggggagcttaggaaggaataatattttaagaacattgaagaactgggtctgcccacactaaggtgggagagcttggagatctctgtaaaccataaattgaagggtatggtctctttgtagggtatagcaggagaacccaggctcactctctttcaaagttttatccttggtatccttatttgtctctctgtattatattttgtcttcagggtaaatctaggttttttaggtatggttttcttctattcaagagc

SEQ ID NO: 137436 - DNA, 326 bp, Homo sapiens
gacagaaaagttctccaggtccccacccgactcagaagcccagccagcttcacctctcaatggcactggctgcgggactttgtggcacctagcctgggcactccagcagcccagagggagcttgtcccctgattaagcccagcaggcaccagccagtggcaccgagtgctgggcctgctgagcccgtacacacccggaacctgtgctggcccgcgtgcgctgcgcgcagcccggctcctgcccgtgcctctccctccacacttccccgcgagcagagagccagtccggcctcggccagccacagagaggggtccccacagcacagc

SEQ ID NO: 137437 - DNA, 592 bp, Homo sapiens
tatcaagggggttgtggtatagaatctctaaagagctttctagtctgaaatgtctaggtttgtgacccttgtgaaggaagaaaggaaggagggtttgggtgctagttttcctatataatgcacgaggaatggagtttagtttggagttaagatccatggacgtctagcccaggaatctgtccaaagcacagacatcaagtttgtgaattactgttggaggtgatgacagtttaacagattgtgagacactgtcattaggtcagcaagttacggtgtatgcctgggtagaattttcccccataaagaattgtagaccccagttccccattggaaccagagaactgagagtttttagcccttagctgagtaatcagcggaagctgagtcaagtcagttggttgtggataacagcctgggaatgtttgggaattttgcccttgtttcatgggggaagggagagaatgcctttccttgtcagatggaggttgcagagctccagatcttcgaggacactttgggattgtccaaagtagttttctagtaactggagtcactgcattgaaagaaagtggttttattatcttagatgata

SEQ ID NO: 137438 - DNA, 512 bp, Homo sapiens
gggcccaggaacaagatgtatcctgttaaaaaaaatttaacaccttcatcaagtatactccaaatgacagcttacagtgctatgaatgtacctctagctcatgggtaaggagcagtgtttatttttgggtgccctgaagaaaatatttgggggaaggagtggggagaagctcaggcagctccatttatggttgagcaatgcttggtattctacagaagggaccatatggacagtggaagagagtttagcattctgattgttcacctcttgctccttccattctgatggctaattagggacacctcattagctatcagagtggaacaagtatttgccaggctgacatgagcctcagccctgcatcctgcatcttctgctttcccaacctgctgagtcaccacctaggaatggcagtagccaggttaccacctggagcacctggagcactcttggcataatgcactgttgactggttttggtctcctagacacagcttgggcctctccaagcct

SEQ ID NO: 137439 - DNA, 251 bp, Homo sapiens
gttatctacaccttcgagactgagcaatagatgaacgaatcgagtctatttgggtatgaagtgactgtgtgtgactcctcaaaacaaagggattgtggagaccccaccgtcagctgtgtgtgtactttaaactcctccaacagaaggggcaggatgaactgacccagtcactccctatgctggcctacgatgttcttccacatcccctgtacacagtcccgtgcatcactttcttgaagatcaagtgtgtg

SEQ ID NO: 137440 - DNA, 737 bp, Homo sapiens
caaaacaaaacaaaaaatatgctgctagtaaattaattcattcttaggtctgagtatttatgaaagaaataagcagtcctcctttggaaacagggaatgtttccttccagtaaacaaatagataagagatttcttctttccctttggcttcaacatgaaaatggtattagaaaataccactgaaatgtatttgtgtgaaatttcatgagtcagaataggtaggaagaagtcaacattgctctttttcccagagggtcaagtataaagattttatacagtgcagttagaatttcaaaagcccccagtagtcactttcagatgttgtctgagtccaacacccaccagtgtaaatattctcccttcaccaggtctggacttgatcagaatactcctagagcactaactttgagtatgattgacatccttttccctgtgatcatttttccgacgaggaagacagtaaggttggccagaacttaggcgttgcctcactcacaaatctatgcctaggtctcagacatgaagtcttgtgatttatgaggtcagtagtgggtgctagctaaccactcctttgcccttcaatacaagatagagaaaagctgacttagactacgatgatgatgtaccaggcatgtatattgttgatctactgaaatgtctctaaaagttactttcagaaacaacttgtattgcagcttatgcaacttcagatctctacatacccaaatattactgtg

SEQ ID NO: 137441 - DNA, 282 bp, Homo sapiens
ctgccatagaggatcccggcagctatccggttcaatgataagtttaaattataaagaattttaatctttacataagagcttcattgcaactaataaaaattttcaccaggaaattatattcatatttgtgacaattttctgttttataaaccaatcagtgtgaaagagaatcattcctttactcaatgtaagtaatttcaagcttaattctaaaactaatgacttaattcttgttagcatcccttttcctgtgcccctttctcccttcacatcatggaattg

SEQ ID NO: 137442 - DNA, 108 bp, Homo sapiens
atgaaagaaatttcttttttccaggaaaataatacatcataaaagaaaggtcaaacttcgatctgtcacattaaatttctaaaacagttccaaggtataatatctaag

SEQ ID NO: 137443 - DNA, 147 bp, Homo sapiens
ctaaacataccggtttgtgccatgtttctgaaatgcttggtgcagaggcttacacttaaaaacagatccagcaggaggggtgggagcgttcctgttactgtttgtgagtttcttttgcactccctggagtcagtgaggtggtggctt

SEQ ID NO: 137444 - DNA, 482 bp, Homo sapiens
aggcgtgagccactgtgcccggcctaaaattattcttttaaaaatggtaacagggtctcactatgttgctcaagctggtttcaaactcctgtgctcaagcagtcctcctgccttggcttcccaaagtactgggattacagatgtgagccactgtgcctggccccgagtagtttttattgtatacgtatactgtgactggaagttaggactgtttttaggaaatacactgtgagattttgaagtttgccgcattgtctttgttgtgatcagtgtgaagttttgaacatagtggattttgatttaggggatgaaaattcattcaagatgatactgtcagttttcagaaataatgaagttgtatagtgttttctgcaatggaaagctgaacttttacaaaggctcagttagcatttctgaaatgatggtgtgctaattatctgttgaaatttaataatgaaaaataaaattttcagtccatggac

SEQ ID NO: 137445 - DNA, 123 bp, Homo sapiens
ttcacacaacaaattaatccacctaatggtaaattacgaagtactaacatttgaccagtctaaaaaccacaggggagaaaaaagaaactaagtaacatctatccccgtatttacgtagctcca

SEQ ID NO: 137446 - DNA, 422 bp, Homo sapiens
agtctccctagaatagactgtgagtccagtgagacgaggggccttgtcctttacctctgactccctagcttctgacacagtcttggctcttggaaaatattggataaatgaaaatgaatttctttagcaagtggtataagctgaaaatatacgtatcacatatcctcattctaagacacattcagtgtccctgaaattagaataggacttacaataagtgtgttcactttctcaatagctgttattcaattgatggtaggccttaaaagtcaaagaaatgagagggcatgtgaaaaaaagctcaacatcactgatcattagaaaacttccattcaaacccccaatgagataccatctcataccagtcagaatggctattattaaaaagtcaaaaaataacagatgctggcaaggttgtggag

SEQ ID NO: 137447 - DNA, 752 bp, Homo sapiens
gaggggccattcaccttagttaagtgtcatctctccgtggctgagaatgcagaataagatggactttggaaaggggccactgtgcatagaaacttgcaagagcagagcggtgctatggatcctctcctgtaaaatggtggtaataaactacccatctcaacacagcggagagtgaattacgtgagccaagaaatgtaacacactttagaacagagcctgaaacagacttatatgctcaaaaaatggttgctgttcagtgttttaaccacaatgaaccaaaaatcaagcactctgtatgtgctaggcacattcctaagtattttctaagtaatcacttaatctctactcatcaaacctccagtgggccacttctgaaatgccccccaccccctagggtatcccctcctttctactctggtctgagccacctaaccccaaccttttgcccagactatgcaacaacttagctggtcttttgctcccactacagtctacgtccacacagcagctggagcactacttgcaatggcagtcacatcatttcactcctgtctaccaattctagaaggcccaacatgatctgtcccttttccactgctctgacatcatcttttatcatcctccccctcactcagggcagtcacacatatcttctgtgcctcaaatacaacaagctaatttctgtcttagggtaacatacttaatgtacttcctagtctcttttttttccccctttaaatttcttaacaaca

SEQ ID NO: 137448 - DNA, 199 bp, Homo sapiens
aaataaacagatgacattgaatttgctcctgttgcttacatgctgcagacaaatggctgatctcattagacaaatggatatggttaaactataatctaaaaaaataagagcagagaaacaatttaggtaggcaactgaggtctgaaataattatgtgctatgcttaatcatagggtagtttgaatttttcaagtgtatt

SEQ ID NO: 137449 - DNA, 678 bp, Homo sapiens
aactttcatcccaccatttgccgaatgctgtgcgccagatgctcttccaggcgcttgacatctaacagcagagaagagagaggaaatgcttgcccaacaggaactcccattctagtggaaggaaacagattctcaacaataaacataaaaataaagggaggccaaggtgggaggattgcttgaacccaggagtttgaggtcagactgggcaacataggggaacccttgtctctacaaagaatacaaacattagctgggcgcggtggctcacgcctgtaatccgagcacttcgggaggccaaggcaggcggatcacgaggtcaggagcacgagaccatcctggctaacacggtgaaaccccgtctttactaaaaatacaaaaaattagccggacatggtggcccatgcctgtagtcccagctactcaggaggctgaggcaagagaatctcttgaacccaggaagcagaggttgcagtgagccgaggtcatgccactgcactccaggctgggcaacagggagacgctctcaaaaagacaaaaaacaaacattaaccacatgtgttggcacatgcctgtggtcccagctactcagaaagctgaggtgaaagtatcactcaaggctggaaggtcaagactgcagtgagccatgatcatgctactgtactgcagcctgggcaa

SEQ ID NO: 137450 - DNA, 642 bp, Homo sapiens
actagaggagtgcatgcaaagcatcaacctagtgcccagttcatgacacatgaaatccatgtaaaccacagtataagtcattaggtgagatataaggagaagatcattatcatgttaagcaagaaataatatgactcatttgctaattatttaatcaaacttgagggaaaccagattcagttgtattggagattctgcacatttagctctaaagattcttatctacgtccatttctagtcattcacttaataaacttttattaagtgcccagtatgtttcagtaactattctaaaccctaagtatacaaaaatgaatagaatagggcttaactctcattttgctcccattccagtgggagagacagattcaaacaaaatgcattaagtgtaactatggaggtgcaggcaagggctgggagagcttaaggagcaagtattgaaatccacttagaaaagtcaggagaatttttaagaagaggtaaggaattgagctaaattttacaccgtgagtagcagtttgccaggcagataaggtggagaaggacgtacctgaaaaagagtccagcatatgaaagcaggaagttgaaaaagaaaaaagcaagggagagagacggcatgtggctgagtacatttttatcaca

SEQ ID NO: 137451 - DNA, 263 bp, Homo sapiens
gataaatataaagttaccaaaactatgtaaaaagtggctataattctttgtaactgcatgtgtaacatgttcttattgagagagtgattctaaaattactagtggacacagtgggcatgctgtggtaaatatttttgctccacagaagtggaatcccaggctttactggcaatagtaaaaaaaaaatctatttagacttaatacttgaaatttcttgtggcttattctgagttcctttctgtttcctattgccacaaatagca

SEQ ID NO: 137452 - DNA, 458 bp, Homo sapiens
atcaccaccaccaccaccctgtcactatcactaccaccatcactactgccaccatcatcaccacgaccacctccatcaccagtattaccaccatcaccaccaccattgttaccactatcattatcaccaccaccgccgccactgccaccaccaccatcattaccacatcaccactatcacccctattaccatcactaccatcaccaccatcatcaccaccacacccatagctactaccattaccaccatcatcaccaccaccactgctttcactatcaccaccaccactaccatcaccatcactgttgttgaggaagtctgcctgaagctgtgctagaaccctactgcaccagtcctgagataccacagccaccacagcctctgatttgaagcccgaatggaacggacaatccatctagcttttgggagctggacctggagcatttggtatctgaatg

SEQ ID NO: 137453 - DNA, 250 bp, Homo sapiens
aggactactatatgaaatattacgtggcagagtctcgttctgtcacccaggctggagtgtagtggtgcgatcttggctcagtgcaacctctgcctcccggcagagcgattcttgtgccccagcttctcgagcagctgaaactgcaggcgtgtgtcaccatgcctagctatttttttctattttttagtagagagagggagttcaagaccagcctgggcaacatagcaagaccccttctgtaccaaaaaaa

SEQ ID NO: 137454 - DNA, 376 bp, Homo sapiens
aggactactatatgaaatattacgtggcagagtctcgttctgtcacccaggctggagtgtagtggtgcgatcttggctcagtgcaacctctgcctcccggcagagcgattcttgtgccccagcttctcgagcagctgaaactgcaggcgtgtgtcaccatgcctagctatttttttctattttttagtagagagagggtttcaccgtgttggccaggttggtcttgaactcctggcatcaagtgatccacctgcctcggcctcccaaagtgctgggattacaggcatgaaccaccacacctggctggcaaaaagggattttaaaattaatttaaaacattaaaacaaaaatggttttatcactatggtaatattaa

SEQ ID NO: 137455 - DNA, 419 bp, Homo sapiens
ctcattttgcatatttgtactacctgttagtaaaatttagacttttaaaactatttattggaaagatagtgatctaagggtcaagacatccatactctagtttaactcagttaattatataatcatatgattgtgaacatgttttgcctctgtaacttttttctcatgtagagtagaaataataaccaccaaattataaagaatggatagaaaaaaaatactgcacagatgctaatacatttttatgactgtttacagcttcctttcatataagattcatacctaagtcattaaacaagcccatgatgtgagaagggtaagtatcatgcccattttacacatgaaaatatagaaaactgatgttcagagaggttaagagacttccccaagaccacactgcaagttgcacaatcaaaagc

SEQ ID NO: 137456 - DNA, 361 bp, Homo sapiens
agtcgaggttgcagtgagccatgatcgtgccactgcactccctggataatgggaaggccaagacaccattgtccactgcagtatggcagctagagctcaatgagtttaaaagtgagctcattgtcctcccctccaaatgtcctctcctctcccaatttctgccatagtttctttagggccccaactttctctaccagtcacccaaactcaaaactctttcactcaagtcctaatgattctttcttcaaaacatttctcacatctacagacaatatgaaaataaaagtggcacaggtaacctgtaagtagtaacttacagctttcattggtgcttacttcttaggagagggggaaagacaga

SEQ ID NO: 137457 - DNA, 367 bp, Homo sapiens
ctcttcccaagatatcagtaataataggtcatgttgatgtggctcttaagatgggccaagctctagtgcaaagaactttctatgcattaatgatttaatcctttcaaaaaccctattgggtgggtaacagtgtttccctccaagttgaggaaaccgagtgttacaagctgaattgtgtgtccctaaatgctatgtggaagtcctcaccccagaacctcagggcgtggccttattcagaagcagcgtccttgctgatggaatgagttaggctgaggtcaggctggagtgggcaggggctactccaacatgactgtgtctttctgtgtccgaattggtgggttattggtctcactgacttcaagaatga

SEQ ID NO: 137458 - DNA, 588 bp, Homo sapiens
ttttcactcccattatctaagtagtcaccataaaatagcaatatttaccaaaaatatctctcatatctgttccatcttctccaattcaatagaattgtcagtgctaaaaaatctactatttagcttaagcctccttcaattatttatttttcataatgggagacactgtagcacaactgttaaatacacaagttctagacttagactgtgcgtggttcaaattaacgtctgactagtggtgtcatcattgccaaattacttaatttctctgacccattgcagaattaacaaaaagtacaataattatgatgcctactcctgcaagcattaaaacaaacatgcctatatacacatatatgtaaaatgtgttttataatatctggaacaaaatgtccattcaataaatattagctactagtattattgccattattatctccaaaatttagctcaaatatttctttttcagttacaatttgaatatctctgggaaaaatgtcaatcattttactctgtcttgtgatgtcgtcttgtgaaatgtattctttttttggcactgataatattaaatggatgaaatttaaaata

SEQ ID NO: 137459 - DNA, 634 bp, Homo sapiens
ttaagcataacgatggctaaggatacaacctgcagacgccgtagagtgagagacgtgtctctctttgctgtgattagctgcgtgcttttggacacgttgctgatcttctccgagcctgtttccttgtctctacagaaggaataataatacatacacctgaaggaagctactgtgaaggtgaaataaaataatgtaggtaaagcacacagtgctcggctcatagtcatcaccactcaggaaatggagcaggaaggacgtcacataactcgcccagatgagaggaggagccagcgttggagctctggccttccaagatccccatctctgctgcagtgtctggtactgagcatgcacttaacagatgcttttttttttttttttttgacatggagtttttgctcttattgcccaggctggagtgcaatggcacgatcttggctcgctgcaacctccacctcccgggttcaagtgattctcctgtctcagcttcccaagtagctgggattacaggcacccaccaccatgcctggctaattttttgtatgtttagtacagggagctctaaagctgagatgcctttcagagttgtcccaagttggggtgagaggttcatggctttacgccacagcatttt

SEQ ID NO: 137460 - DNA, 551 bp, Homo sapiens
ggaataaaaacctatatgaagaaaagagactcacattatgctaagtgaaataagccaagcgcagaaggataaatattgcatggtgtcacttgtaggtggactctaaacaagttgaactcatggaaatagtagaatggtgattgcaggagtaggggttgtggtggggaacagggagttgctggttaaagggtacaaagtttccgttaggatgagtaagttctggaggtctaatggtagaacatggtaattactgttaataatgtatacccaaagatttctaagagcgttatcttaaatgttcttaccacaaaaaataaaatacttatgtgaggtgatagataagttaattcacttgatggtggtaatcatttcacagtgtatacataaaaacaatatgtcgtacatcgtatatatatatgtgtgtgtatacgtgtgtgtgtgtgtgtgtgtgtgtgtgtgtatatacacaattttaatttgtcatttatacttcttcaatagacctgagggagaaaagaaaaaaaagaattttacttgactcccaatcttta

SEQ ID NO: 137461 - DNA, 496 bp, Homo sapiens
cggcgccaagatcaatacacgggttagaccggcagggagagccgcaaaggtcaggataaacagtggagtttctatgaaagccccctcggcacctgggcaggatcagccacattcaatgatggggagccacagggctgcagcagagctgctgtttccactcgtatcctgtgcctctgggggcgtgtgtgtgtgtgtgtgtgtgtgtgttcagtcaggttaatactcagacctctccaggatgcatgtgggttaaaccaccttatctataatccatatgcctcatttatgaatgggggatagtaaagagctgctaaaaattcaataaggggcacgacagcgggatacccgggaggtagtctatcaaacacagcagccagcgtgcagccactccttcctactctgtcctggggctgttaaacagcctctttgaaacttttttttttgagacagagactcactctgttgcccaggctggagtgcaatggcaagatctcag

SEQ ID NO: 137462 - DNA, 424 bp, Homo sapiens
ccgtcctaagctgttttataattttcttggctatctattatattattatgcaactgcaccttagagatagctgaatttgagtagtcactaaaatacattttaaattgataaaattgccatggaattttgtagcataaaggtaaaatataaatttggaatctttataatacatataattaactaaattatgagctgaaattatcgttgttgcaagtttataataccaacagctaactgagagaatttttataagtttacaatagccattttccctttaaaactgagtacaatccagaaaattgatttacagcataatagtatactatttttacatataaatactggttatctactcccaatgttcataacagaacttaggttctcttcaaggtatgatagttgtgaaaacctctagacgcctctt

SEQ ID NO: 137463 - DNA, 385 bp, Homo sapiens
actagcgaggagctacaccaccagataccaaataactgctcaggtcattgtttttcacttaatggacattgtctgtccatagtgggcagtcagtttgcgaagctcatgactgagatgtgattgaggggaatcgactagctggtgacactggccgctttgtggctgatataactgatgatgtgtggcttgttttctctggtagaaatgtgtgggattgtcacctctgctgaacttccacagcagtcttttccaggactcgtcatccttggcagccccaactcctgcctgtcagcccaagtctccctttgcggttgctacaaccaccaagggctcatcctcttctcctgtctgccctcatgtcctgccaatcaggagccttttaaat

SEQ ID NO: 137464 - DNA, 372 bp, Homo sapiens
caggattaaaacccaggcccagagctctcacttcagcgtttttattttacatcatgatctcaaaggctcgtctgacctccatgtctacatccaataactaggaaggcttaatagtatactgcccatgactgtgttatgtgttcgttttaagaatttctaaaacttaggctcttattggaattgtgtagaaggaagtgatttttttatttagaacattctttttctggccaagactttagcagaggagagatagaaagtaacaactgatcattggttagaacatgcttatttagatttgagaagatggtgcttactagatttggaaaagaccctttgtgtgcaagcagaaagttagaagcatggcagaaacat

SEQ ID NO: 137465 - DNA, 447 bp, Homo sapiens
tgcctccagataacagaggaaatcaaatcttgtgagccgggaagcaaagttgccttcactgtcatcatcaaggggatgatttgtaagaatattgggcatgaaataaattcttgccaaagttgtctacaggagtgtccaatgtgggaattgttgtcatctctttcacccttctaacattaaaaggaacttactgaaaaagttctcagactggattttgctaaattgtgtctgctttggaatctttgtccatcagtcaagtctctatgactattggatagtgcttttaactctgtgtggtcaaaactttggaagaagtaagagaaatatctttcattccaaagaacaaaagaggaccattagtcagagcatctttatttttcataaaaagaaaagtcagttagattgatcattcatgaatatttataatatatcagatattctttgggg

SEQ ID NO: 137466 - DNA, 223 bp, Homo sapiens
aaaaatcagatctatattgtatggatacatcacagtagtaaaatagcacagaaatgataaaaaataaattcagtaatatgtcaagggagggaaaagggggattgtgcaaagatcatcaaaggccaccaactttatctttgattctgttttccactaaaatgaaaaaaaaatacgcagcaaataatgaaagatgttaagatcagacagatatgctttggtggtt

SEQ ID NO: 137467 - DNA, 335 bp, Homo sapiens
actctgttgtccaggctggagtgcagtgacatgatctcagctcactgcagcctccaccccccaggttcaagtgattcttgtgcctcagcctcctgagtagctgggaccacaggtgcataccatcacgcccagctaattttttatttttagtagagatggagtttcactatgttgcccaggctggtcttgaactcctgacctcaggttatctgcccacctcggcctcccaaggtgctgggatttcaggcgtgtgccagcgctccgcctcctcttcctttttctctcaagcaacaatcccagctttaggacttgctaacctcacacccctgggccgt

SEQ ID NO: 137468 - DNA, 350 bp, Homo sapiens
tgtttcacaatgttggtcgggctggtctcaaacccctgatctcaggtgatccacccaccttggcctcccaaaagtgctgaaattacaggtgtgagccaccgcgcccagccgaccttgatgttttgccagttattttgtaggatgcctctcaatctaatcctgtgttcccgtcccctcccccaactcatgttttctcactagattgaggtcatacattttgggcagaatatgacaaaaatgatgttgtgctcttcttagtgtgaaatatcaggagacacagaaagttgaattgcctggtggtagttaactttgatccagtgtggtgctgacaaatgtttaacaactcaact

SEQ ID NO: 137469 - DNA, 191 bp, Homo sapiens
aagttatctgaacttgggacgggagagaggcaaatggatagccgcggaagcatgagattgtcctgtctgacagggagaagcaagggattgagcgtattcacgctgaagtacatggcatgaggttggctggatattaggaaaggatgcttgtggttgttcaggtgttgagtgtgaggccacaagctcgtgca

SEQ ID NO: 137470 - DNA, 277 bp, Homo sapiens
catatatagtttgcagcactcagaatcaatacaaagtaccttcagccactttggttcacattctgaagattcatgtaataaacacccatagtagttgtgggctcacattatctaatgagaatgttttcttgatgacttgacatttctccgtcactgttggataatcagagaaaaaaaggacgttcagaacaccaaggtgcttggtacaattatgccaagtgccctgtctttaaagggagtagcctaattctcagcatttgggagtttttgactaaat

SEQ ID NO: 137471 - DNA, 649 bp, Homo sapiens
agatgaatcagagaggttaagaggaagtagagagcagaggctaaagtacctgtcccgagaaaatgagaaagagagagagagagagagagagcacaaccttgcagcttctattaaaggtagtccaggctcctggccattttccagtccccagcagtcctggctgtactatggattctgtcctttgatttcagtaagtgtcctttgtgtgactttataataaatgtccccattttgaagctgacttgagggactttccattctagtcatcaaaaagattccaaatacaaattagttgcagacatgtctctctccacctctaaactatagactgtgatcatctttaagtaaagcatgaaatcacttttctattacttataaaatatttcaaacataaaaatgaaaaataatgaatgtgcatttacgaatccatacttagttttaatgattattaaataattttgccatatttgcctcaccatttttaaaacataaatgagacatttcagatgaaacctttcagatactcctcctcaattctattccccattctcttcaaaagtagccactattttgaatttggtatttatcattcacatgtgacgtgtgtgtgtatgtgtacacacattaatatgcacacacacacatacat

SEQ ID NO: 137472 - DNA, 327 bp, Homo sapiens
tgtattacaaattgtctcgggtttgtaattgcacagcaaatcactgagccatccagcatatcttccaacatgaagatctaatcgccaaagccttaacttagattgttacttatgtttctaaatctgtggaagcacatttccttttcttcttcttttcttttactgttaatatccttattctctattttaccagtggagaatgtttagtattaatttccatttagctcaagattcaagaaatgcaaagtgctatttttatcaaatttctgaaagcctactgtcttctgctttggaagtcccacaacagctctttaatttccttaagcc

SEQ ID NO: 137473 - DNA, 338 bp, Homo sapiens
atccagtggggggatttccgatgatgtccttcttgatctttctgatccacttgagagttgaccacaccatctctcctaaacccttctgcattcttggtgtattagtccattttcatactgctatgaagaaatacctgagactgggtaatttataaagaaatcgaggtttaatggactaacggtttcacatggcgggggaggcctcacaatcatggcgtaaggcaaaggaagagcaaaggcatgtcttacatggcagcaggcaagagagcatgtgcaggagaactgcctttataaaaccattaatcatatcagacttattcactatcatgagaacagca

SEQ ID NO: 137474 - DNA, 646 bp, Homo sapiens
tgtttgcatgtgtgtcccagcggatcctcctgctgctgtgtctaaaatccctaaaaatctttcagacgatctagagctgtctgggtaattcacaggaaaagcacctacagaactcttaacctcacactgcataagaataaagtggggcagtgctaaaatagagaccaagaaggcatctttattaattttttacccagctggagatgagggagagtaacagccaatcaccagcagattactatctaagaactcattgatctaagaagctgctgagccagcccaactacctgtggtatatcaacaaaaaaaggaaactaaatgatgagaacatatggacacacagagggacacaacacacactgggcttaatatatggatgatgaaataatctgtacaataaacccacatgacttaactttacctatataacacacctgcgcatgtactcctgaacttaaaatttggttacttaagtttacctatataacacacctgtgcatgtactcctgaacttaaaatttggtttgagagttatttgaagaaacaaacctaacagatgttcactttttgccccttcctttctgttctgcaaagaggcatattcctcgaagatacgtaagaatctgaaagcatccagcacaggact

SEQ ID NO: 137475 - DNA, 310 bp, Homo sapiens
taaaatggtgttttgttaagatgataagatcatttcacagtaacttttctaaaattaaaacatagagttagagttgattttcctatgtgatagtccttagattctggattgcttaatttgatcttttttttactgaaatattacattttttggtattttaaatagaatattgcattcatcgggacctaagaggaaggtaatggagagaaacatgaagaaagcctgaagatttattttggagagggcttctgtaatgaaatggaaaaaggaaggatagtaatgagagaacagttacagaactaggagtaaa

SEQ ID NO: 137476 - DNA, 430 bp, Homo sapiens
tcagagcatgggaatgcctaaatgacagtatggctatattctctccatgcattctggaaatattataaaggctggagttgagttgaataaagagacaagtgcactaggaaagctgattgagcttctgccatccagggaatatatatttaactcagatgatatcactaagaagtaagtgtattttttaaaaaagttttgactgttttcctcccatcacacaatcagtcattatatgctgctctttctgtgtctagcacagtgacttttaattcttgctgaaattagaaaccacctggggaggggataaaactcttactgcccagttgggataccagaccaattaaatcagaatctctggggtgggaaataagcgtcagtattttttgaagcttcctgtgtgattctcatacatagctgagtctgagtacca

SEQ ID NO: 137477 - DNA, 476 bp, Homo sapiens
atgcccagctaatttttgtattttttgtagagatggggtatcaccatgttggccaggctggtctcaaactcctaacctcaagtgattcacccacctcagcctcccaaagtgctgggattactggtgtcagccactgcacccagccaatatatttcattttaaagcaagcaataaaaacttatttcgctgtttaatatttttattgactttaaaaagactttgaacttagtgaaagagaatcagtcacctagaaatgtactgctctcatctagctgggaaggtcattgtaattttcttctatatagatttgtttgctctagataagcggctcaatttgaatagatttttagtgatgaaagggacattgggagctgctgccacccattcctttttcagatgcagaagccacagcctggaaaaattgtgatttgtcctgaggcatacagttactagcagagaaagccaagaccagaccc

SEQ ID NO: 137478 - DNA, 288 bp, Homo sapiens
ggtctttattcttttggtttaggaaacatccaaaatagcctctctcggtgggtatgcgccctctgaaagagcttgtcttgcacgtgttggagctgactgtttaggtactgctggaatggcactgagacagtccagttgggactgctaaatgggggcagcagctcacacagggatatttttcatagttgacattatcctttatgggaaagggccttatttagaggagcatttccattttaatggttcagaaacctgaactgttgctatggcctcattttcatcgtttgg

SEQ ID NO: 137479 - DNA, 491 bp, Homo sapiens
tgccctgtaattaatttatcaaaagccatttccgggtaacaggattaatttcactccacacttgagtgccagccagtgtcagatgcctgaccagggcactgggatgacctgtcattcaccaggaaccactacggctccgcattcaggggagatcagtggccaccagcacttcaagggccaggcaccctgctaagccctcatgtgctctactccccttcataacagcactttctggaagatactactgcctgtttgacagagaaggacattaaggttcagtcaatcaggatagaaaagtaacacacccggcaggatgcgggtgactcacgcctgtaatccctcctttcccacagaagccactcagagacactgccacggggaggtagagcattctgaaacttgccagcctaaaagaaaatattgccattaggcagatgaaaaaggggcctaacacccatatgaagatagatttgggaacaaatcaatggaga

SEQ ID NO: 137480 - DNA, 252 bp, Homo sapiens
ttttttatatcaataggttaggggtcaggtggttttggttacatggatgaatgtatactggtgaagtctgaattttagtgcaattcctatgggttaaccattgggctcctttcaaatgcaaaccctcatgaaagagactacagtgctgaatagagacctccaaattccaggccaagctcaggatagtcatgagggaattactaaaaacctggtatatagggcaaaagcagaattaggaatggactgatttca

SEQ ID NO: 137481 - DNA, 190 bp, Homo sapiens
tactacaacgatatgtactgagttcttggcacaaagctgtccttcatagagttgtttataactgcctccaaatgaaaactgcctaattactcatcaagaggagattggttcaatcaatgatggtctatcagtcagccattcaaaatcatgttggggctgcgcaccgtggctcacacctgtaatcccagca

SEQ ID NO: 137482 - DNA, 518 bp, Homo sapiens
taatccacaaggctaatactgagggtggagggaatccaggaggaactccatgcagacgaatatgcctactacatccaggtaggtcagcctgctgggattcaaacacacggaacaagtgtgctcagggcctcgtgtggctataattatacttttaatgtgcaaattatgggtagcacttaaaacaacctaccttcttcatatcctcacccttaacatccaaccaaaaaagattttggagggagaccagacttggagcactgcattcaattaatgtgagccataatttcctatttcaggcttataaagattatccctataaggtttctcttaagaactgtaatcttgttctaataactaatctatccccatggaaacttaattggactcgattaaaacatttaaaaatactgtacttttcagaaaactgcctttcttaccagaaaaccgaaacttaacaaggatctccctgaagggggagttgaaaggtaaactatgggcccacggtgaggatttctgaa

SEQ ID NO: 137483 - DNA, 518 bp, Homo sapiens
caggatggcaagcctttgtagtgtctcctcgtcaacctgaacgtcagctataccatgcctccaccctcatgtggcctgaccggagatggttctggtggagatgccctctgtcaccggcccagctcatgagagccattaccaaatatgtgagtgttctttagagtgagggtgactcacgggaaattcacatggttctgctttctacggcaaagtttgcattttcctcacctgcactgtttatgttctgctgtggtcctttgtgctggtggtcatggtcctcccgtcacagcatgggatagtagtggattaggaaacgaggtgttggttctcagaaaaggcatgatggaaacccagagcaggaagtgctttgtgcagacgacaaagaacctttttttgctttttcagttgttttctcttttctacttacctctcatccctttacagtgttatctgtttgctttacctctttcttacctccaagccccaaaacatggcaggagaggatgtaactgaggttc

SEQ ID NO: 137484 - DNA, 378 bp, Homo sapiens
agagttttttttaatttgagacagggtctggctctgtcacctaggctggaatacagtggcgcaatctcagctcacttcaatctgtgcctcctgggctcaagccatcccctgacctcagcctcctgagtagctgggactacagtcctgccactatgcctggctaatttttgtattttttgtagagatgttgcccaggctggtctgaaactcctgagctcaagggatccatccacctgggcctccccaagtgctgggattacaggcatgcgccaccgtgcccaacccagacatcacttttatctgaagcaacaactatctgctctttctgtttccttactaattatccaggaacttttacaggtgaactctgaggaggac

SEQ ID NO: 137485 - DNA, 724 bp, Homo sapiens
cacgcttcgcctgcctcacaccaggcagcggcctgagaagcctggccacgccaccatgcctgggtcctcactcccactgctctcttgcagggaaggacatggagcccaacggcccgtcgctgcccagggatgaagggcccccgaccccaagctctgccacgaaggtgccaccggcagagtacaggctgtgcaacgggtcagacaaggaatgtgtgtcccccaccgccagggtcaccaagaaggagactctcaaggtgagcccgggcccggggagggtgcagcagtgtcactgtcagaccgacggccacctgagccagggaggtcaccctccccacctgtcaaaaggaggggacaaaccgcacctggtcgcctccacaccccctacttcctcctacttcctctcctgcccctgcccctggacccatccctgggctggacggtgggaggagctggggcagctcggtgccttctcccatgacccaccgcgggtgccccgggcccaggcgcagaaggagaactaccggcaggagaagaagcgcgccacacggcagctgctcagcgctctgacagaccccagcgtggtcatcatggctgacagcctgaaggtaggtgatgcccggcctccggccacccaggacacgggtcagcgtgctgctgccataacaaaggaccataaaccaggtggcctgaaacgatggaaattcacttccctgcatctagccgt

SEQ ID NO: 137486 - DNA, 3861 bp, Homo sapiens
ggacttctcagccagggcacccccaccatgtggctctgaagccccttccggggcggtgacctcctgctgcccctccttccttccttccagaagcccccgagcgcccacagcatgaaggaggaggccttcctccggcgccgcttctccctgtgtccaccttcctccacccctcagaaagtcgacccccggaagctcacccggaacttgctcctcagcggagacaatgagctctacccactcagcccagggaaggacatggagcccaacggcccgtcgctgcccagggatgaagggcccccgaccccaagctctgccacgaaggtgccaccggcagagtacaggctgtgcaacgggtcagacaaggaatgtgtgtcccccaccgccagggtcaccaagaaggagactctcaaggcgcagaaggagaactaccggcaggagaagaagcgcgccacacggcagctgctcagcgctctgacagaccccagcgtggtcatcatggctgacagcctgaagatccgcggcaccctgaagagctggaccaagctgtggtgcgtgctgaagccgggggtgctgctcatctacaagacgcccaaggtgggccagtgggtgggcacggtgctgctgcactgctgcgagctcatcgagcggccctccaagaaggacggcttctgcttcaagctcttccacccgctggatcagtccgtctgggccgtgaagggccccaaaggtgagagcgtgggctccatcacacagcccctgcccagcagctacctgatcttcagggccgcctccgagtcagatggtcgctgctggctggacgccctggagctggccctgcgctgctctagcctactgagactgggcacctgcaagccgggccgagacggggagccagggacctcgccagacgcatcaccctcatcgctctgtgggctgccagcctcagccactgtccacccagaccaagacctgttcccactgaacgggtcttccctggagaacgatgcattctcagacaagtcggagagagagaaccctgaggagtcagataccgagacccaggaccatagccggaagacggagagtggcagcgaccagtcagagacccctggggccccggtgcggagagggaccacctatgtggagcaggtccaggaggagctgggggagctgggcgaggcgtcccaggtggagacagtgtcagaggagaacaagagtctgatgtggaccctgctgaagcagctacggccaggcatggacctgtcccgcgtggtgctacccacgttcgtactggagccgcgctccttcctgaacaagctctccgactactactaccacgcagacctgctctccagggctgcggtggaggaggatgcctacagccgcatgaagctggtgctgcggtggtacctgtctggcttctacaagaagcccaagggaatcaagaagccgtacaaccccatcctgggggagaccttccgctgctgctggttccacccgcagactgacagccgcacattctacatagcagagcaggtgtcccaccacccgcccgtgtctgccttccacgtcagcaaccggaaggacggcttctgcatcagtggcagcatcacagccaagtccaggttttatgggaactcgctgtcggcgctgctggacggcaaagccacgctcaccttcctgaaccgagccgaggattacacccttaccatgccctacgcccactgcaaaggaatcctgtatggcacgatgaccctggagctgggtgggaaggtcaccatcgagtgtgcgaagaacaacttccaggcccagctggaattcaaactcaagcccttcttcgggggtagcaccagcatcaaccagatctcgggaaagatcacgtcgggagaggaagtcctggcgagcctcagtggccactgggacagggacgtgtttatcaaggaggaagggagcggaagcagtgcgcttttctggaccccgagcggggaggtccgcagacagaggctgaggcagcacacggtgccgctggaggagcagacggagctggagtccgagaggctctggcagcacgtcaccagggccatcagcaagggcgaccagcacagggccacacaggagaagtttgcactggaggaggcacagcggcagcgggcccgtgagcggcaggagagcctcatgccctggaagccgcagctgttccacctggaccccatcacccaggagtggcactaccgatacgaggaccacagcccctgggaccccctgaaggacatcgcccagtttgagcaagacgggatcctgcggaccttgcagcaggaggccgtggcccgccagaccaccttcctgggcagcccagggcccaggcacgagaggtctggcccagaccagcggcttcgcaaggccagcgaccagccctccggccacagccaggccacggagagcagcggatccacgcctgagtcctgcccagagctctcagacgaggagcaggatggtgactttgtccctggcggtgagagcccatgccctcggtgcaggaaggaggcgcggcggctgcaggccctgcacgaggccatcctctccatccgagaggcccagcaggagctgcacaggcacctctcggccatgctgagctccacggcacgggcagcacaggcaccgaccccaggcctcctgcagagcccccgatcctggttcctgctctgcgtgttcctggcgtgtcagctgttcattaaccacatcctcaaataggagccctgggggcagagctcctggccagtcccgagccctccctcccaggcacccagcactttaagcctgctccatggaggcagagaggcccggcaagcacagccactgtgacggggagtccaggcgcaggagggacccggggccacaagggcgctgcgggcccaggtgtgctgggcccctctcaggggcactggcctctctgcagggccttccgcccagcgctggccttaatgctaaagccaaatgcagcttctgctgtgcgacgcactcctggccatcttgccgtgtcaccccctgtccggcctccacttgccatgggggatggatggatttagggtgggagggcctgtgggggccctggacagtcacaccccagcagcagtgagtgggcaggtttggaggagcagccagggagccccgagtggcccaggagtccccccacacacagatgcataggcctgccttccggagaccctgtccacattgccgggaccaccctggtggggccactggtgggtgccagggacaggttagggccactctggggaaggcattttggttttttattccacgctgtgctgtttggatgggagccccacagaggcaggtcctggaaccaccccacccccacacctggacgctcgctctggtgggggcacacgcaggtggaggtggttgtgggtgcaggtgtgtgcaggggtgtggggggcgcaggggtgtggcttagctggccccgcacccaggccggggaggctcaagttcgccactttactcagaccgatgcacagtcttcccattttacacttttttaataaacataattgcaatattttaggtgggctgcgagctgcagtcagccttcacgtctggcctcagtccccgtgtcagtgccgctctgcgtgtgcgtgtgcgcgtgtgtgagcctctacacatatatatacgtacagagccttaaaccacatcgtggcggtgccgtctgagctgtagcgggtggctttgtttccagtttttgtacccgtgtccttgtctcccctcctcccccatctggggatgtgtctgtgttccacaccttgaaataaacagacacatacgtgttctcttcttgcggga

SEQ ID NO: 137487 - DNA, 3704 bp, Homo sapiens
cacgcttcgcctgcctcacaccaggcagcggcctgagaagcctggccacgccaccatgcctgggtcctcactcccactgctctcttgcagggaaggacatggagcccaacggcccgtcgctgcccagggatgaagggcccccgaccccaagctctgccacgaaggtgccaccggcagagtacaggctgtgcaacgggtcagacaaggaatgtgtgtcccccaccgccagggtcaccaagaaggagactctcaaggcgcagaaggagaactaccggcaggagaagaagcgcgccacacggcagctgctcagcgctctgacagaccccagcgtggtcatcatggctgacagcctgaagatccgcggcaccctgaagagctggaccaagctgtggtgcgtgctgaagccgggggtgctgctcatctacaagacgcccaaggtgggccagtgggtgggcacggtgctgctgcactgctgcgagctcatcgagcggccctccaagaaggacggcttctgcttcaagctcttccacccgctggatcagtccgtctgggccgtgaagggccccaaaggtgagagcgtgggctccatcacacagcccctgcccagcagctacctgatcttcagggccgcctccgagtcagatggtcgctgctggctggacgccctggagctggccctgcgctgctctagcctactgagactgggcacctgcaagccgggccgagacggggagccagggacctcgccagacgcatcaccctcatcgctctgtgggctgccagcctcagccactgtccacccagaccaagacctgttcccactgaacgggtcttccctggagaacgatgcattctcagacaagtcggagagagagaaccctgaggagtcagataccgagacccaggaccatagccggaagacggagagtggcagcgaccagtcagagacccctggggccccggtgcggagagggaccacctatgtggagcaggtccaggaggagctgggggagctgggcgaggcgtcccaggtggagacagtgtcagaggagaacaagagtctgatgtggaccctgctgaagcagctacggccaggcatggacctgtcccgcgtggtgctacccacgttcgtactggagccgcgctccttcctgaacaagctctccgactactactaccacgcagacctgctctccagggctgcggtggaggaggatgcctacagccgcatgaagctggtgctgcggtggtacctgtctggcttctacaagaagcccaagggaatcaagaagccgtacaaccccatcctgggggagaccttccgctgctgctggttccacccgcagactgacagccgcacattctacatagcagagcaggtgtcccaccacccgcccgtgtctgccttccacgtcagcaaccggaaggacggcttctgcatcagtggcagcatcacagccaagtccaggttttatgggaactcgctgtcggcgctgctggacggcaaagccacgctcaccttcctgaaccgagccgaggattacacccttaccatgccctacgcccactgcaaaggaatcctgtatggcacgatgaccctggagctgggtgggaaggtcaccatcgagtgtgcgaagaacaacttccaggcccagctggaattcaaactcaagcccttcttcgggggtagcaccagcatcaaccagatctcgggaaagatcacgtcgggagaggaagtcctggcgagcctcagtggccactgggacagggacgtgtttatcaaggaggaagggagcggaagcagtgcgcttttctggaccccgagcggggaggtccgcagacagaggctgaggcagcacacggtgccgctggaggagcagacggagctggagtccgagaggctctggcagcacgtcaccagggccatcagcaagggcgaccagcacagggccacacaggagaagtttgcactggaggaggcacagcggcagcgggcccgtgagcggcaggagagcctcatgccctggaagccgcagctgttccacctggaccccatcacccaggagtggcactaccgatacgaggaccacagcccctgggaccccctgaaggacatcgcccagtttgagcaagacgggatcctgcggaccttgcagcaggaggccgtggcccgccagaccaccttcctgggcagcccagggcccaggcacgagaggtctggcccagaccagcggcttcgcaaggccagcgaccagccctccggccacagccaggccacggagagcagcggatccacgcctgagtcctgcccagagctctcagacgaggagcaggatggtgactttgtccctggcggtgagagcccatgccctcggtgcaggaaggaggcgcggcggctgcaggccctgcacgaggccatcctctccatccgagaggcccagcaggagctgcacaggcacctctcggccatgctgagctccacggcacgggcagcacaggcaccgaccccaggcctcctgcagagcccccgatcctggttcctgctctgcgtgttcctggcgtgtcagctgttcattaaccacatcctcaaataggagccctgggggcagagctcctggccagtcccgagccctccctcccaggcacccagcactttaagcctgctccatggaggcagagaggcccggcaagcacagccactgtgacggggagtccaggcgcaggagggacccggggccacaagggcgctgcgggcccaggtgtgctgggcccctctcaggggcactggcctctctgcagggccttccgcccagcgctggccttaatgctaaagccaaatgcagcttctgctgtgcgacgcactcctggccatcttgccgtgtcaccccctgtccggcctccacttgccatgggggatggatggatttagggtgggagggcctgtgggggccctggacagtcacaccccagcagcagtgagtgggcaggtttggaggagcagccagggagccccgagtggcccaggagtccccccacacacagatgcataggcctgccttccggagaccctgtccacattgccgggaccaccctggtggggccactggtgggtgccagggacaggttagggccactctggggaaggcattttggttttttattccacgctgtgctgtttggatgggagccccacagaggcaggtcctggaaccaccccacccccacacctggacgctcgctctggtgggggcacacgcaggtggaggtggttgtgggtgcaggtgtgtgcaggggtgtggggggcgcaggggtgtggcttagctggccccgcacccaggccggggaggctcaagttcgccactttactcagaccgatgcacagtcttcccattttacacttttttaataaacataattgcaatattttaggtgggctgcgagctgcagtcagccttcacgtctggcctcagtccccgtgtcagtgccgctctgcgtgtgcgtgtgcgcgtgtgtgagcctctacacatatatatacgtacagagccttaaaccacatcgtggcggtgccgtctgagctgtagcgggtggctttgtttccagtttttgtacccgtgtccttgtctcccctcctcccccatctggggatgtgtctgtgttccacaccttgaaataaacagacacatacgtgttctcttcttgcggga

SEQ ID NO: 137488 - DNA, 2371 bp, Homo sapiens
acaatgccatacgcccactgcaaaggtatactgtatggcacgatgatcctggaactggctgggaaggtcaccatagagtatgcgaagaacgacttccaggcccagctggaattccaacgcaagccccttctctacgggggtagcaccagcatcaaccagatctcgggaaagatcacctagggagaggaactcctggcgagccgaggattacacccttaccatgccctacgcccactgcaaaggaatcctgtatggcacgatgaccctggagctgggtgggaaggtcaccatcgagtgtgcgaagaacaacttccaggcccagctggaattcaaactcaagcccttcttcgggggtagcaccagcatcaaccagatctcgggaaagatcacgtcgggagaggaagtcctggcgagcctcagtggccactgggacagggacgtgtttatcaaggaggaagggagcggaagcagtgcgcttttctggaccccgagcggggaggtccgcagacagaggctgaggcagcacacggtgccgctggaggagcagacggagctggagtccgagaggctctggcagcacgtcaccagggccatcagcaagggcgaccagcacagggccacacaggagaagtttgcactggaggaggcacagcggcagcgggcccgtgagcggcaggagagcctcatgccctggaagccgcagctgttccacctggaccccatcacccaggagtggcactaccgatacgaggaccacagcccctgggaccccctgaaggacatcgcccagtttgagcaagacgggatcctgcggaccttgcagcaggaggccgtggcccgccagaccaccttcctgggcagcccagggcccaggcacgagaggtctggcccagaccagcggcttcgcaaggccagcgaccagccctccggccacagccaggccacggagagcagcggatccacgcctgagtcctgcccagagctctcagacgaggagcaggatggtgactttgtccctggcggtgagagcccatgccctcggtgcaggaaggaggcgcggcggctgcaggccctgcacgaggccatcctctccatccgagaggcccagcaggagctgcacaggcacctctcggccatgctgagctccacggcacgggcagcacaggcaccgaccccaggcctcctgcagagcccccgatcctggttcctgctctgcgtgttcctggcgtgtcagctgttcattaaccacatcctcaaataggagccctgggggcagagctcctggccagtcccgagccctccctcccaggcacccagcactttaagcctgctccatggaggcagagaggcccggcaagcacagccactgtgacggggagtccaggcgcaggagggacccggggccacaagggcgctgcgggcccaggtgtgctgggcccctctcaggggcactggcctctctgcagggccttccgcccagcgctggccttaatgctaaagccaaatgcagcttctgctgtgcgacgcactcctggccatcttgccgtgtcaccccctgtccggcctccacttgccatgggggatggatggatttagggtgggagggcctgtgggggccctggacagtcacaccccagcagcagtgagtgggcaggtttggaggagcagccagggagccccgagtggcccaggagtccccccacacacagatgcataggcctgccttccggagaccctgtccacattgccgggaccaccctggtggggccactggtgggtgccagggacaggttagggccactctggggaaggcattttggttttttattccacgctgtgctgtttggatgggagccccacagaggcaggtcctggaaccaccccacccccacacctggacgctcgctctggtgggggcacacgcaggtggaggtggttgtgggtgcaggtgtgtgcaggggtgtggggggcgcaggggtgtggcttagctggccccgcacccaggccggggaggctcaagttcgccactttactcagaccgatgcacagtcttcccattttacacttttttaataaacataattgcaatattttaggtgggctgcgagctgcagtcagccttcacgtctggcctcagtccccgtgtcagtgccgctctgcgtgtgcgtgtgcgcgtgtgtgagcctctacacatatatatacgtacagagccttaaaccacatcgtggcggtgccgtctgagctgtagcgggtggctttgtttccagtttttgtacccgtgtccttgtctcccctcctcccccatctggggatgtgtctgtgttccacaccttgaaataaacagacacatacgtgttctcttcttgcggga

SEQ ID NO: 137489 - DNA, 3429 bp, Homo sapiens
cgcgccgccagtggagcccccgcgcgcccggccggcccggagcaccgagctcgcggcacggtaggagaagcccccgagcgcccacagcatgaaggaggaggccttcctccggcgccgcttctccctgtgtccaccttcctccacccctcagaaagtcgacccccggaagctcacccggaacttgctcctcagcggagacaatgagctctacccactcagcccagggaaggacatggagcccaacggcccgtcgctgcccagggatgaagggcccccgaccccaagctctgccacgaaggtgccaccggcagagtacaggctgtgcaacgggtcagacaaggaatgtgtgtcccccaccgccagggtcaccaagaaggagactctcaaggcgcagaaggagaactaccggcaggagaagaagcgcgccacacggcagctgctcagcgctctgacagaccccagcgtggtcatcatggctgacagcctgaagatccgcggcaccctgaagagctggaccaagctgtggtgcgtgctgaagccgggggtgctgctcatctacaagacgcccaaggtgggccagtgggtgggcacggtgctgctgcactgctgcgagctcatcgagcggccctccaagaaggacggcttctgcttcaagctcttccacccgctggatcagtccgtctgggccgtgaagggccccaaaggtgagagcgtgggctccatcacacagcccctgcccagcagctacctgatcttcagggccgcctccgagtcagatggtcgctgctggctggacgccctggagctggccctgcgctgctctagcctactgagactgggcacctgcaagccgggccgagacggggagccagggacctcgccagacgcatcaccctcatcgctctgtgggctgccagcctcagccactgtccacccagaccaagacctgttcccactgaacgggtcttccctggagaacgatgcattctcagacaagtcggagagagagaaccctgaggagtcagataccgagacccaggaccatagccggaagacggagagtggcagcgaccagtcagagacccctggggccccggtgcggagagggaccacctatgtggagcaggtccaggaggagctgggggagctgggcgaggcgtcccaggtggagacagtgtcagaggagaacaagagtctgatgtggaccctgctgaagcagctacggccaggcatggacctgtcccgcgtggtgctacccacgttcgtactggagccgcgctccttcctgaacaagctctccgactactactaccacgcagacctgctctccagggctgcggtggaggaggatgcctacagccgcatgaagctggtgctgcggtggtacctgtctggcttctacaagaagcccaagggaatcaagaagccgtacaaccccatcctgggggagaccttccgctgctgctggttccacccgcagactgacagccgcacattctacatagcagagcaggtgtcccaccacccgcccgtgtctgccttccacgtcagcaaccggaaggacggcttctgcatcagtggcagcatcacagccaagtccaggttttatgggaactcgctgtcggcgctgctggacggcaaagccacgctcaccttcctgaaccgagccgaggattacacccttaccatgccctacgcccactgcaaaggaatcctgtatggcacgatgaccctggagctgggtgggaaggtcaccatcgagtgtgcgaagaacaacttccaggcccagctggaattcaaactcaagcccttcttcgggggtagcaccagcatcaaccagatctcgggaaagatcacgtcgggagaggaagtcctggcgagcctcagtggccactgggacagggacgtgtttatcaaggaggaagggagcggaagcagtgcgcttttctggaccccgagcggggaggtccgcagacagaggctgaggcagcacacggtgccgctggaggagcagacggagctggagtccgagaggctctggcagcacgtcaccagggccatcagcaagggcgaccagcacagggccacacaggagaagtttgcactggaggaggcacagcggcagcgggcccgtgagcggcaggagagcctcatgccctggaagccgcagctgttccacctggaccccatcacccaggagtggcactaccgatacgaggaccacagcccctgggaccccctgaaggacatcgcccagtttgagcaagacgggatcctgcggaccttgcagcaggaggccgtggcccgccagaccaccttcctgggcagcccagggcccaggcacgagaggtctggcccagaccagcggcttcgcaaggccagcgaccagccctccggccacagccaggccacggagagcagcggatccacgcctgagtcctgcccagagctctcagacgaggagcaggatggtgactttgtccctggcggtgagagcccatgccctcggtgcaggaaggaggcgcggcggctgcaggccctgcacgaggccatcctctccatccgagaggcccagcaggagctgcacaggcacctctcggccatgctgagctccacggcacgggcagcacaggcaccgaccccaggcctcctgcagagcccccgatcctggttcctgctctgcgtgttcctggcgtgtcagctgttcattaaccacatcctcaaataggagccctgggggcagagctcctggtccccccacacacagatgcataggcctgccttccggagaccctgtccacattgccgggaccaccctggtggggccactggtgggtgccagggacaggttagggccactctggggaaggcattttggttttttattccacgctgtgctgtttggatgggagccccacagaggcaggtcctggaaccaccccacccccacacctggacgctcgctctggtgggggcacacgcaggtggaggtggttgtgggtgcaggtgtgtgcaggggtgtggggggcgcaggggtgtggcttagctggccccgcacccaggccggggaggctcaagttcgccactttactcagaccgatgcacagtcttcccattttacacttttttaataaacataattgcaatattttaggtgggctgcgagctgcagtcagccttcacgtctggcctcagtccccgtgtcagtgccgctctgcgtgtgcgtgtgcgcgtgtgtgagcctctacacatatatatacgtacagagccttaaaccacatcgtggcggtgccgtctgagctgtagcgggtggctttgtttccagtttttgtacccgtgtccttgtctcccctcctcccccatctggggatgtgtctgtgttccacaccttgaaataaacagacacatacgtgttctcttcttgcggga

SEQ ID NO: 137490 - DNA, 705 bp, Homo sapiens
gggcccgtgagcggcaggagagcctcatgccctggaagccgcagctgttccacctggaccccatcacccaggagtggcccttcttcgggggtagcaccagcatcaaccagatctcgggaaagatcacgtcgggagaggaagtcctggcgagcctcagtggccactgggacagggacgtgtttatcaaggaggaagggagcggaagcagtgcgcttttctggaccccgagcggggaggtccgcagacagaggctgaggcagcacacggtgccgctggaggagcagacggagctggagtccgagaggtgaggcctgtcagcgcccagggaccgcacccaggccggggaggctcaagttcgccactttactcagaccgatgcacagtcttcccattttacacttttttaataaacataattgcaatattttaggtgggctgcgagctgcagtcagccttcacgtctggcctcagtccccgtgtcagtgccgctctgcgtgtgcgtgtgcgcgtgtgtgagcctctacacatatatatacgtacagagccttaaaccacatcgtggcggtgccgtctgagctgtagcgggtggctttgtttccagtttttgtacccgtgtccttgtctcccctcctcccccatctggggatgtgtctgtgttccacaccttgaaataaacagacacatacgtgttctcttcttgcggga

SEQ ID NO: 137491 - DNA, 392 bp, Homo sapiens
ctgctgcactgctgcgagctcatcgagcggccctccaagaaggacggcttctgcttcaagctcttccacccgctggatcagtccgtctgggccgtgaaggtgctgcggaggggtggggttgaagacagaggccccgtagggccaaggggctcattcctagggccctggtggagggtggagccaaccagctgaactgcttggggccttgggcaggtctctcaccttctctgagccccacatgcggccaggggatcagatatggccactggtgctccatgtgaagcacacagtaggctgcaaggaggtggcatcaaggtcaccccagcccctcacccagctgctgtccaggagggacaacagtggctgctccccaggggtggccgaggaacagc

SEQ ID NO: 137492 - DNA, 3838 bp, Homo sapiens
cgcgccgccagtggagcccccgcgcgcccggccggcccggagcaccgagctcgcggcacggtaggagaagcccccgagcgcccacagcatgaaggaggaggccttcctccggcgccgcttctccctgtgtccaccttcctccacccctcagaaagtcgacccccggaagctcacccggaacttgctcctcagcggagacaatgagctctacccactcagcccagggaaggacatggagcccaacggcccgtcgctgcccagggatgaagggcccccgaccccaagctctgccacgaaggtgccaccggcagagtacaggctgtgcaacgggtcagacaaggaatgtgtgtcccccaccgccagggtcaccaagaaggagactctcaaggcgcagaaggagaactaccggcaggagaagaagcgcgccacacggcagctgctcagcgctctgacagaccccagcgtggtcatcatggctgacagcctgaagatccgcggcaccctgaagagctggaccaagctgtggtgcgtgctgaagccgggggtgctgctcatctacaagacgcccaaggtgggccagtgggtgggcacggtgctgctgcactgctgcgagctcatcgagcggccctccaagaaggacggcttctgcttcaagctcttccacccgctggatcagtccgtctgggccgtgaagggccccaaaggtgagagcgtgggctccatcacacagcccctgcccagcagctacctgatcttcagggccgcctccgagtcagatggtcgctgctggctggacgccctggagctggccctgcgctgctctagcctactgagactgggcacctgcaagccgggccgagacggggagccagggacctcgccagacgcatcaccctcatcgctctgtgggctgccagcctcagccactgtccacccagaccaagacctgttcccactgaacgggtcttccctggagaacgatgcattctcagacaagtcggagagagagaaccctgaggagtcagataccgagacccaggaccatagccggaagacggagagtggcagcgaccagtcagagacccctggggccccggtgcggagagggaccacctatgtggagcaggtccaggaggagctgggggagctgggcgaggcgtcccaggtggagacagtgtcagaggagaacaagagtctgatgtggaccctgctgaagcagctacggccaggcatggacctgtcccgcgtggtgctacccacgttcgtactggagccgcgctccttcctgaacaagctctccgactactactaccacgcagacctgctctccagggctgcggtggaggaggatgcctacagccgcatgaagctggtgctgcggtggtacctgtctggcttctacaagaagcccaagggaatcaagaagccgtacaaccccatcctgggggagaccttccgctgctgctggttccacccgcagactgacagccgcacattctacatagcagagcaggtgtcccaccacccgcccgtgtctgccttccacgtcagcaaccggaaggacggcttctgcatcagtggcagcatcacagccaagtccaggttttatgggaactcgctgtcggcgctgctggacggcaaagccacgctcaccttcctgaaccgagccgaggattacacccttaccatgccctacgcccactgcaaaggaatcctgtatggcacgatgaccctggagctgggtgggaaggtcaccatcgagtgtgcgaagaacaacttccaggcccagctggaattcaaactcaagcccttcttcgggggtagcaccagcatcaaccagatctcgggaaagatcacgtcgggagaggaagtcctggcgagcctcagtggccactgggacagggacgtgtttatcaaggaggaagggagcggaagcagtgcgcttttctggaccccgagcggggaggtccgcagacagaggctgaggcagcacacggtgccgctggaggagcagacggagctggagtccgagaggctctggcagcacgtcaccagggccatcagcaagggcgaccagcacagggccacacaggagaagtttgcactggaggaggcacagcggcagcgggcccgtgagcggcaggagagcctcatgccctggaagccgcagctgttccacctggaccccatcacccaggagtggcactaccgatacgaggaccacagcccctgggaccccctgaaggacatcgcccagtttgagcaagacgggatcctgcggaccttgcagcaggaggccgtggcccgccagaccaccttcctgggcagcccagggcccaggcacgagaggtctggcccagaccagcggcttcgcaaggccagcgaccagccctccggccacagccaggccacggagagcagcggatccacgcctgagtcctgcccagagctctcagacgaggagcaggatggtgactttgtccctggcggtgagagcccatgccctcggtgcaggaaggaggcgcggcggctgcaggccctgcacgaggccatcctctccatccgagaggcccagcaggagctgcacaggcacctctcggccatgctgagctccacggcacgggcagcacaggcaccgaccccaggcctcctgcagagcccccgatcctggttcctgctctgcgtgttcctggcgtgtcagctgttcattaaccacatcctcaaataggagccctgggggcagagctcctggccagtcccgagccctccctcccaggcacccagcactttaagcctgctccatggaggcagagaggcccggcaagcacagccactgtgacggggagtccaggcgcaggagggacccggggccacaagggcgctgcgggcccaggtgtgctgggcccctctcaggggcactggcctctctgcagggccttccgcccagcgctggccttaatgctaaagccaaatgcagcttctgctgtgcgacgcactcctggccatcttgccgtgtcaccccctgtccggcctccacttgccatgggggatggatggatttagggtgggagggcctgtgggggccctggacagtcacaccccagcagcagtgagtgggcaggtttggaggagcagccagggagccccgagtggcccaggagtccccccacacacagatgcataggcctgccttccggagaccctgtccacattgccgggaccaccctggtggggccactggtgggtgccagggacaggttagggccactctggggaaggcattttggttttttattccacgctgtgctgtttggatgggagccccacagaggcaggtcctggaaccaccccacccccacacctggacgctcgctctggtgggggcacacgcaggtggaggtggttgtgggtgcaggtgtgtgcaggggtgtggggggcgcaggggtgtggcttagctggccccgcacccaggccggggaggctcaagttcgccactttactcagaccgatgcacagtcttcccattttacacttttttaataaacataattgcaatattttaggtgggctgcgagctgcagtcagccttcacgtctggcctcagtccccgtgtcagtgccgctctgcgtgtgcgtgtgcgcgtgtgtgagcctctacacatatatatacgtacagagccttaaaccacatcgtggcggtgccgtctgagctgtagcgggtggctttgtttccagtttttgtacccgtgtccttgtctcccctcctcccccatctggggatgtgtctgtgttccacaccttgaaataaacagacacatacgtgttctcttcttgcggga

SEQ ID NO: 137493 - DNA, 3709 bp, Homo sapiens
ggaggaaggtggacacagggagaagcggcgccggaggaaggcctcccggaacttgctcctcagcggagacaatgagctctacccactcagcccagggaaggacatggagcccaacggcccgtcgctgcccagggatgaagggcccccgaccccaagctctgccacgaaggtgccaccggcagagtacaggctgtgcaacgggtcagacaaggaatgtgtgtcccccaccgccagggtcaccaagaaggagactctcaaggcgcagaaggagaactaccggcaggagaagaagcgcgccacacggcagctgctcagcgctctgacagaccccagcgtggtcatcatggctgacagcctgaagatccgcggcaccctgaagagctggaccaagctgtggtgcgtgctgaagccgggggtgctgctcatctacaagacgcccaaggtgggccagtgggtgggcacggtgctgctgcactgctgcgagctcatcgagcggccctccaagaaggacggcttctgcttcaagctcttccacccgctggatcagtccgtctgggccgtgaagggccccaaaggtgagagcgtgggctccatcacacagcccctgcccagcagctacctgatcttcagggccgcctccgagtcagatggtcgctgctggctggacgccctggagctggccctgcgctgctctagcctactgagactgggcacctgcaagccgggccgagacggggagccagggacctcgccagacgcatcaccctcatcgctctgtgggctgccagcctcagccactgtccacccagaccaagacctgttcccactgaacgggtcttccctggagaacgatgcattctcagacaagtcggagagagagaaccctgaggagtcagataccgagacccaggaccatagccggaagacggagagtggcagcgaccagtcagagacccctggggccccggtgcggagagggaccacctatgtggagcaggtccaggaggagctgggggagctgggcgaggcgtcccaggtggagacagtgtcagaggagaacaagagtctgatgtggaccctgctgaagcagctacggccaggcatggacctgtcccgcgtggtgctacccacgttcgtactggagccgcgctccttcctgaacaagctctccgactactactaccacgcagacctgctctccagggctgcggtggaggaggatgcctacagccgcatgaagctggtgctgcggtggtacctgtctggcttctacaagaagcccaagggaatcaagaagccgtacaaccccatcctgggggagaccttccgctgctgctggttccacccgcagactgacagccgcacattctacatagcagagcaggtgtcccaccacccgcccgtgtctgccttccacgtcagcaaccggaaggacggcttctgcatcagtggcagcatcacagccaagtccaggttttatgggaactcgctgtcggcgctgctggacggcaaagccacgctcaccttcctgaaccgagccgaggattacacccttaccatgccctacgcccactgcaaaggaatcctgtatggcacgatgaccctggagctgggtgggaaggtcaccatcgagtgtgcgaagaacaacttccaggcccagctggaattcaaactcaagcccttcttcgggggtagcaccagcatcaaccagatctcgggaaagatcacgtcgggagaggaagtcctggcgagcctcagtggccactgggacagggacgtgtttatcaaggaggaagggagcggaagcagtgcgcttttctggaccccgagcggggaggtccgcagacagaggctgaggcagcacacggtgccgctggaggagcagacggagctggagtccgagaggctctggcagcacgtcaccagggccatcagcaagggcgaccagcacagggccacacaggagaagtttgcactggaggaggcacagcggcagcgggcccgtgagcggcaggagagcctcatgccctggaagccgcagctgttccacctggaccccatcacccaggagtggcactaccgatacgaggaccacagcccctgggaccccctgaaggacatcgcccagtttgagcaagacgggatcctgcggaccttgcagcaggaggccgtggcccgccagaccaccttcctgggcagcccagggcccaggcacgagaggtctggcccagaccagcggcttcgcaaggccagcgaccagccctccggccacagccaggccacggagagcagcggatccacgcctgagtcctgcccagagctctcagacgaggagcaggatggtgactttgtccctggcggtgagagcccatgccctcggtgcaggaaggaggcgcggcggctgcaggccctgcacgaggccatcctctccatccgagaggcccagcaggagctgcacaggcacctctcggccatgctgagctccacggcacgggcagcacaggcaccgaccccaggcctcctgcagagcccccgatcctggttcctgctctgcgtgttcctggcgtgtcagctgttcattaaccacatcctcaaataggagccctgggggcagagctcctggccagtcccgagccctccctcccaggcacccagcactttaagcctgctccatggaggcagagaggcccggcaagcacagccactgtgacggggagtccaggcgcaggagggacccggggccacaagggcgctgcgggcccaggtgtgctgggcccctctcaggggcactggcctctctgcagggccttccgcccagcgctggccttaatgctaaagccaaatgcagcttctgctgtgcgacgcactcctggccatcttgccgtgtcaccccctgtccggcctccacttgccatgggggatggatggatttagggtgggagggcctgtgggggccctggacagtcacaccccagcagcagtgagtgggcaggtttggaggagcagccagggagccccgagtggcccaggagtccccccacacacagatgcataggcctgccttccggagaccctgtccacattgccgggaccaccctggtggggccactggtgggtgccagggacaggttagggccactctggggaaggcattttggttttttattccacgctgtgctgtttggatgggagccccacagaggcaggtcctggaaccaccccacccccacacctggacgctcgctctggtgggggcacacgcaggtggaggtggttgtgggtgcaggtgtgtgcaggggtgtggggggcgcaggggtgtggcttagctggccccgcacccaggccggggaggctcaagttcgccactttactcagaccgatgcacagtcttcccattttacacttttttaataaacataattgcaatattttaggtgggctgcgagctgcagtcagccttcacgtctggcctcagtccccgtgtcagtgccgctctgcgtgtgcgtgtgcgcgtgtgtgagcctctacacatatatatacgtacagagccttaaaccacatcgtggcggtgccgtctgagctgtagcgggtggctttgtttccagtttttgtacccgtgtccttgtctcccctcctcccccatctggggatgtgtctgtgttccacaccttgaaataaacagacacatacgtgttctcttcttgcggga

SEQ ID NO: 137494 - DNA, 3224 bp, Homo sapiens
cgcgccgccagtggagcccccgcgcgcccggccggcccggagcaccgagctcgcggcacggtaggagaagcccccgagcgcccacagcatgaaggaggaggccttcctccggcgccgcttctccctgtgtccaccttcctccacccctcagaaagtcgacccccggaagctcacccggaacttgctcctcagcggagacaatgagctctacccactcagcccagggaaggacatggagcccaacggcccgtcgctgcccagggatgaagggcccccgaccccaagctctgccacgaaggtgccaccggcagagtacaggctgtgcaacgggtcagacaaggaatgtgtgtcccccaccgccagggtcaccaagaaggagactctcaaggcgcagaaggagaactaccggcaggagaagaagcgcgccacacggcagctgctcagcgctctgacagaccccagcgtggtcatcatggctgacagcctgaagatccgcggcaccctgaagagctggaccaagctgtggtgcgtgctgaagccgggggtgctgctcatctacaagacgcccaaggtgggccagtgggtgggcacggtgctgctgcactgctgcgagctcatcgagcggccctccaagaaggacggcttctgcttcaagctcttccacccgctggatcagtccgtctgggccgtgaagggccccaaaggtgagagcgtgggctccatcacacagcccctgcccagcagctacctgatcttcagggccgcctccgagtcagatggtcgctgctggctggacgccctggagctggccctgcgctgctctagcctactgagactgggcacctgcaagccgggccgagacggggagccagggacctcgccagacgcatcaccctcatcgctctgtgggctgccagcctcagccactgtccacccagaccaagacctgttcccactgaacgggtcttccctggagaacgatgcattctcagacaagtcggagagagagaaccctgaggagtcagataccgagacccaggaccatagccggaagacggagagtggcagcgaccagtcagagacccctggggccccggtgcggagagggaccacctatgtggagcaggtccaggaggagctgggggagctgggcgaggcgtcccaggtggagacagtgtcagaggagaacaagagtctgatgtggaccctgctgaagcagctacggccaggcatggacctgtcccgcgtggtgctacccacgttcgtactggagccgcgctccttcctgaacaagctctccgactactactaccacgcagacctgctctccagggctgcggtggaggaggatgcctacagccgcatgaagctggtgctgcggtggtacctgtctggcttctacaagaagcccaagggaatcaagaagccgtacaaccccatcctgggggagaccttccgctgctgctggttccacccgcagactgacagccgcacattctacatagcagagcaggtgtcccaccacccgcccgtgtctgccttccacgtcagcaaccggaaggacggcttctgcatcagtggcagcatcacagccaagtccaggttttatgggaactcgctgtcggcgctgctggacggcaaagccacgctcaccttcctgaaccgagccgaggattacacccttaccatgccctacgcccactgcaaaggaatcctgtatggcacgatgaccctggagctgggtgggaaggtcaccatcgagtgtgcgaagaacaacttccaggcccagctggaattcaaactcaagcccttcttcgggggtagcaccagcatcaaccagatctcgggaaagatcacgtcgggagaggaagtcctggcgagcctcagtggccactgggacagggacgtgtttatcaaggaggaagggagcggaagcagtgcgcttttctggaccccgagcggggaggtccgcagacagaggctgaggcagcacacggtgccgctggaggagcagacggagctggagtccgagaggctctggcagcacgtcaccagggccatcagcaagggcgaccagcacagggccacacaggagaagtttgcactggaggaggcacagcggcagcgggcccgtgagcggcaggagagcctcatgccctggaagccgcagctgttccacctggaccccatcacccaggagtggcactaccgatacgaggaccacagcccctgggaccccctgaaggacatcgcccagtttgagcaagacgggatcctgcggaccttgcagcaggaggccgtggcccgccagaccaccttcctgggcagcccagggcccaggcacgagaggtctggcccagaccagcggcttcgcaaggccagcgaccagccctccggccacagccaggccacggagagcagcggatccacgcctgagtcctgcccagagctctcagacgaggagcaggatggtgactttgtccctggcggtgagagcccatgccctcggtgcaggaaggaggcgcggcggctgcaggccctgcacgaggccatcctctccatccgagaggcccagcaggagctgcacaggcacctctcggccatgctgagctccacggcacgggcagcacaggcaccgaccccaggcctcctgcagagcccccgatcctggttcctgctctgcgtgttcctggcgtgtcagctgttcattaaccacatcctcaaataggagccctgggggcagagctcctggccagtcccgagccctccctcccaggcacccagcactttaagcctgctccatggaggcagagaggcccggcaagcacagccactgtgacggggagtccaggcgcaggagggacccggggccacaagggcgctgcgggcccaggtgtgctgggcccctctcaggggcactggcctctctgcagggccttccgcccagcgctggccttaatgctaaagccaaatgcagcttctgctgtgcgacgcactcctggccatcttgccgtgtcaccccctgtccggcctccacttgccatgggggatggatggatttagggtcaatgatttccatgggatgagttcatttaactgagcaccttttcttaggagagacgtaactcaactggacccaaattatatattattggaggttaaagttttacctttagaaacccttttcctttgaaatcttatagtaaacactgtctcattttgga

SEQ ID NO: 137495 - DNA, 3524 bp, Homo sapiens
cgcgccgccagtggagcccccgcgcgcccggccggcccggagcaccgagctcgcggcacggtaggagaagcccccgagcgcccacagcatgaaggaggaggccttcctccggcgccgcttctccctgtgtccaccttcctccacccctcagaaagtcgacccccggaagctcacccggaacttgctcctcagcggagacaatgagctctacccactcagcccagggaaggacatggagcccaacggcccgtcgctgcccagggatgaagggcccccgaccccaagctctgccacgaaggtgccaccggcagagtacaggctgtgcaacgggtcagacaaggaatgtgtgtcccccaccgccagggtcaccaagaaggagactctcaaggcgcagaaggagaactaccggcaggagaagaagcgcgccacacggcagctgctcagcgctctgacagaccccagcgtggtcatcatggctgacagcctgaagatccgcggcaccctgaagagctggaccaagctgtggtgcgtgctgaagccgggggtgctgctcatctacaagacgcccaaggtgggccagtgggtgggcacggtgctgctgcactgctgcgagctcatcgagcggccctccaagaaggacggcttctgcttcaagctcttccacccgctggatcagtccgtctgggccgtgaagggccccaaaggtgagagcgtgggctccatcacacagcccctgcccagcagctacctgatcttcagggccgcctccgagtcagatggtcgctgctggctggacgccctggagctggccctgcgctgctctagcctactgagactgggcacctgcaagccgggccgagacggggagccagggacctcgccagacgcatcaccctcatcgctctgtgggctgccagcctcagccactgtccacccagaccaagacctgttcccactgaacgggtcttccctggagaacgatgcattctcagacaagtcggagagagagaaccctgaggagtcagataccgagacccaggaccatagccggaagacggagagtggcagcgaccagtcagagacccctggggccccggtgcggagagggaccacctatgtggagcaggtccaggaggagctgggggagctgggcgaggcgtcccaggtggagacagtgtcagaggagaacaagagtctgatgtggaccctgctgaagcagctacggccaggcatggacctgtcccgcgtggtgctacccacgttcgtactggagccgcgctccttcctgaacaagctctccgactactactaccacgcagacctgctctccagggctgcggtggaggaggatgcctacagccgcatgaagctggtgctgcggtggtacctgtctggcttctacaagaagcccaagggaatcaagaagccgtacaaccccatcctgggggagaccttccgctgctgctggttccacccgcagactgacagccgcacattctacatagcagagcaggtgtcccaccacccgcccgtgtctgccttccacgtcagcaaccggaaggacggcttctgcatcagtggcagcatcacagccaagtccaggttttatgggaactcgctgtcggcgctgctggacggcaaagccacgctcaccttcctgaaccgagccgaggattacacccttaccatgccctacgcccactgcaaaggaatcctgtatggcacgatgaccctggagctgggtgggaaggtcaccatcgagtgtgcgaagaacaacttccaggcccagctggaattcaaactcaagcccttcttcgggggtagcaccagcatcaaccagatctcgggaaagatcacgtcgggagaggaagtcctggcgagcctcagtggccactgggacagggacgtgtttatcaaggaggaagggagcggaagcagtgcgcttttctggaccccgagcggggaggtccgcagacagaggctgaggcagcacacggtgccgctggaggagcagacggagctggagtccgagaggctctggcagcacgtcaccagggccatcagcaagggcgaccagcacagggccacacaggagaagtttgcactggaggaggcacagcggcagcgggcccgtgagcggcaggagagcctcatgccctggaagccgcagctgttccacctggaccccatcacccaggagtggcactaccgatacgaggaccacagcccctgggaccccctgaaggacatcgcccagtttgagcaagacgggatcctgcggaccttgcagcaggaggccgtggcccgccagaccaccttcctgggcagcccagggcccaggcacgagaggtctggcccagaccagcggcttcgcaaggccagcgaccagccctccggccacagccaggccacggagagcagcggatccacgcctgagtcctgcccagagctctcagacgaggagcaggatggtgactttgtccctggcggtgagagcccatgccctcggtgcaggaaggaggcgcggcggctgcaggccctgcacgaggccatcctctccatccgagaggcccagcaggagctgcacaggcacctctcggccatgctgagctccacggcacgggcagcacaggcaccgaccccaggcctcctgcagagcccccgatcctggttcctgctctgcgtgttcctggcgtgtcagctgttcattaaccacatcctcaaataggagccctgggggcagagctcctgggggagggcctgtgggggccctggacagtcacaccccagcagcagtgagtgggcaggtttggaggagcagccagggagccccgagtggcccaggagtccccccacacacagatgcataggcctgccttccggagaccctgtccacattgccgggaccaccctggtggggccactggtgggtgccagggacaggttagggccactctggggaaggcattttggttttttattccacgctgtgctgtttggatgggagccccacagaggcaggtcctggaaccaccccacccccacacctggacgctcgctctggtgggggcacacgcaggtggaggtggttgtgggtgcaggtgtgtgcaggggtgtggggggcgcaggggtgtggcttagctggccccgcacccaggccggggaggctcaagttcgccactttactcagaccgatgcacagtcttcccattttacacttttttaataaacataattgcaatattttaggtgggctgcgagctgcagtcagccttcacgtctggcctcagtccccgtgtcagtgccgctctgcgtgtgcgtgtgcgcgtgtgtgagcctctacacatatatatacgtacagagccttaaaccacatcgtggcggtgccgtctgagctgtagcgggtggctttgtttccagtttttgtacccgtgtccttgtctcccctcctcccccatctggggatgtgtctgtgttccacaccttgaaataaacagacacatacgtgttctcttcttgcggga

SEQ ID NO: 137496 - DNA, 3526 bp, Homo sapiens
cgcgccgccagtggagcccccgcgcgcccggccggcccggagcaccgagctcgcggcacggtaggagaagcccccgagcgcccacagcatgaaggaggaggccttcctccggcgccgcttctccctgtgtccaccttcctccacccctcagaaagtcgacccccggaagctcacccggaacttgctcctcagcggagacaatgagctctacccactcagcccagggaaggacatggagcccaacggcccgtcgctgcccagggatgaagggcccccgaccccaagctctgccacgaaggtgccaccggcagagtacaggctgtgcaacgggtcagacaaggaatgtgtgtcccccaccgccagggtcaccaagaaggagactctcaaggcgcagaaggagaactaccggcaggagaagaagcgcgccacacggcagctgctcagcgctctgacagaccccagcgtggtcatcatggctgacagcctgaagatccgcggcaccctgaagagctggaccaagctgtggtgcgtgctgaagccgggggtgctgctcatctacaagacgcccaaggtgggccagtgggtgggcacggtgctgctgcactgctgcgagctcatcgagcggccctccaagaaggacggcttctgcttcaagctcttccacccgctggatcagtccgtctgggccgtgaagggccccaaaggtgagagcgtgggctccatcacacagcccctgcccagcagctacctgatcttcagggccgcctccgagtcagatggtcgctgctggctggacgccctggagctggccctgcgctgctctagcctactgagactgggcacctgcaagccgggccgagacggggagccagggacctcgccagacgcatcaccctcatcgctctgtgggctgccagcctcagccactgtccacccagaccaagacctgttcccactgaacgggtcttccctggagaacgatgcattctcagacaagtcggagagagagaaccctgaggagtcagataccgagacccaggaccatagccggaagacggagagtggcagcgaccagtcagagacccctggggccccggtgcggagagggaccacctatgtggagcaggtccaggaggagctgggggagctgggcgaggcgtcccaggtggagacagtgtcagaggagaacaagagtctgatgtggaccctgctgaagcagctacggccaggcatggacctgtcccgcgtggtgctacccacgttcgtactggagccgcgctccttcctgaacaagctctccgactactactaccacgcagacctgctctccagggctgcggtggaggaggatgcctacagccgcatgaagctggtgctgcggtggtacctgtctggcttctacaagaagcccaagggaatcaagaagccgtacaaccccatcctgggggagaccttccgctgctgctggttccacccgcagactgacagccgcacattctacatagcagagcaggtgtcccaccacccgcccgtgtctgccttccacgtcagcaaccggaaggacggcttctgcatcagtggcagcatcacagccaagtccaggttttatgggaactcgctgtcggcgctgctggacggcaaagccacgctcaccttcctgaaccgagccgaggattacacccttaccatgccctacgcccactgcaaaggaatcctgtatggcacgatgaccctggagctgggtgggaaggtcaccatcgagtgtgcgaagaacaacttccaggcccagctggaattcaaactcaagcccttcttcgggggtagcaccagcatcaaccagatctcgggaaagatcacgtcgggagaggaagtcctggcgagcctcagtggccactgggacagggacgtgtttatcaaggaggaagggagcggaagcagtgcgcttttctggaccccgagcggggaggtccgcagacagaggctgaggcagcacacggtgccgctggaggagcagacggagctggagtccgagaggctctggcagcacgtcaccagggccatcagcaagggcgaccagcacagggccacacaggagaagtttgcactggaggaggcacagcggcagcgggcccgtgagcggcaggagagcctcatgccctggaagccgcagctgttccacctggaccccatcacccaggagtggcactaccgatacgaggaccacagcccctgggaccccctgaaggacatcgcccagtttgagcaagacgggatcctgcggaccttgcagcaggaggccgtggcccgccagaccaccttcctgggcagcccagggcccaggcacgagaggtctggcccagaccagcggcttcgcaaggccagcgaccagccctccggccacagccaggccacggagagcagcggatccacgcctgagtcctgcccagagctctcagacgaggagcaggatggtgactttgtccctggcggtgagagcccatgccctcggtgcaggaaggaggcgcggcggctgcaggccctgcacgaggccatcctctccatccgagaggcccagcaggagctgcacaggcacctctcggccatgctgagctccacggcacgggcagcacaggcaccgaccccaggcctcctgcagagcccccgatcctggttcctgctctgcgtgttcctggcgtgtcagctgttcattaaccacatcctcaaataggagccctgggggcagagctcctggtccccccacacacagatgcataggcctgccttccggagaccctgtccacattgccgggaccaccctggtggggccactggtgggtgccagggacaggttagggccactctggggaaggcattttggttttttattccacgctgtgctgtttggatgggagccccacagaggcaggtcctggaaccaccccacccccacacctggacgctcgctctggtgggggcacacgcaggtggaggtggttgtgggtgcaggtgtgtgcaggggtgtggggggcgcaggggtgtggcttagctggccccgcacccaggccggggaggctcaagttcgccactttactcagaccgatgcacagtcttcccattttacacttttttaataaacataattgcaatatttaaaaaaaaaaaaaaaaaaaaaaaacaaaaaaaaaaaaaaaaagaaaaaaaaaaaaaaaaaacaaaaaaaaaaaaacgaaacaaaaaagaaaacaaaaaaaaaaaagaaaaaaagggggggccaggaacaaaattccccgaggcggtacctgaataagaagacaacgagatgattatagcaaaaaaaggaacgacctatataaggagagaatggctgactctaataacaaaacaccgcgcgcggcgcggctcaaaacaacagagaacattcaggagcggcaagccaaaatatagtggagagcaccttgcttgacaagcggaacaatctatctgatggaagaggagaaatacaaagggcggaacagagctcaatcaa

SEQ ID NO: 137497 - DNA, 1727 bp, Homo sapiens
acatattgtaaggagtaagggttgtaatgtttctgtcccccgccccccccaagttcataggttgaaattaatcccagcgtgatggtctttggaggtggggcctttgggaagtgaataaatcatgagggtggagcctcatgaatgggaatagtgccataacgaggccagagagctctcttgcccactttccaccgtgtgaggatacagtgagaagatggcctgcaacccagaagagaggcctcaccagaacctaaccatgctggtgcctgatctgagacctcagcgcctccagagctatgagaaatgaatttctaaacccagtctatggtactttgctgtagcagtctgaacagtctaagacagggatgaaaaagcttcaaggagcaagtttgtgaactgagcctggaaggaggagtaggatctgacaaagggttagaagaggaaggactccaagcagaaggagcaaacctaggaaagagactgagggaaaaattcaggagaccaaactctcatgcgcaggaggttcatgctgaggggagcaggaagcagagctggactggggaggccttgaaggcaggcagagcaaggagccccaccaggtgactgctcattggctcccagatggattcgatggtatcgctcagatgatggaacaaaaaagaaaaagagaaaacacaaatgtgacatgtgaaaaataggaatgaaagagaaagataaaagagaaggaaaatcttcccaggtctagaagatacattctcgtatcgaaagggcccagcaggtgcccagcacaacaaacctaggaagaccaacaccaaggcacatcgccacagcattcagaacaccaaggataaagaaaagatcttcagagtttcctgaaggaaaaatgaaaaggtcacatttaaaggactggaaatcagaatggcatggaaattctccacagaatcccaggaagctggaatacaatagggcattaacttcaaaattctgaagaaaataattctaacatagaattcaactctcactatattagctgtttgtgggtaggatgtagatattttcagatatccttatctcagaaagctactggaggatattcttctccaaaattaagaaattagccaagaaagaggataatatttgggacctaaaaaacaggaagtcccagcttaggagagaggagaagggaagtactaggacagaagctaggacttatacagtaggggatagaggcctctaggagagatgtttccagaaggaagtgaatcacatggaatgcctgttatggatgaatatcttaaaagggatcttcagaatttgatgatgataagtaatagctagataggaaagtgaataaggaaataaatgaggccattattgaatctagtgaaaacaatatgcaaaaaaggatatagcatatgtcttggctgtgaataaatatgtaattataacaagataattgctgaatgggagtttaacccaaaggggtgttataattatttttgaaaaaagggaggtgaccttacgtgtgtttacataaatgtgcatgtgtctaggaagtgagggtgggagagttaaatccttgtcttctagagttaggaagtccatagactatacgcacaattgaaaagtaaggacagaacattaaatatgtgttcttagaaaatatgagcataaggccgggcacattggctcatgcctgtaatgccagcactttggggggccaaggt

SEQ ID NO: 137498 - DNA, 794 bp, Homo sapiens
cctataatcccagagctttgggaggccgagaattcaagaccagccaaaccaacatggagaaaccccgtctctactaaaaaaacagaattagccgggtgtggtgccacatgcctgtatcccagctactcgggaggctaaggtgggagaatcgcttgagcccggggggtcagcagaggttgcggtgagccaagatcctgccattgcactccagcctgggcaacaagagcaagactctgtctcaaaaaacaaacaaacaaacaaaaaaccaaaaacccaccaatgcctggctaggtgcggtggctcacacctgtaatcccagagctttgggaggctgaagcgggtgggtcacttgaggccaggagttggagaccagcctggccaacatggtgaaaccctgtctatactgaaagtacaaaaattagccacgtgtggtggcatgtacctgtagtcccagctacttgggaggctgaggcacaagaatcactttaaaccaggaggtggagattgcagtgagccaagatgatgccactgcactccagcctgcgtgacaaaggggaaacaaaaaaagcaaaaacaaaaaatcaatgcctgcatcttacccccagaaattctgacttaactggtaagatgtgagttaactcatgagatttaacaggcaacagtttaggatccactgtcctagagtgtgatccatggaccttcagtacctaggagcttgttagaaatatggaatctggccgggtgccgtggctcatgcctgtaatcccagcactttgggaggccaaggtggggtg

SEQ ID NO: 137499 - DNA, 436 bp, Homo sapiens
ccaggaccacctgctgggctctggaagtgcctcctgttgcctaacctagttttaggcagttccacccatgcagaaggcctttttttcccatgtcaccctctcaaaatccttgagatcttcaagatctgtctccatggcaccccttccacaacaaatcttctctctgcttctccaacagcctgacccaatcacaccgtagaagcgggtaagcctatctgtgtgctctggggccagggcaggtgtgcagacctagtgagaggaaggtgcctgagttttcattcaatactcaagtgcctaccacattaaatatgtactaacagacaggacttcaggtcttgactctcaagatgtctggagtgagtgcagatgaggtgataggtgaggccatgggaactgctggaaacagtattctgaggaagacgctgtttcagcgggt

SEQ ID NO: 137500 - DNA, 221 bp, Homo sapiens
agggccatttgtccagacaggtaaattgcacctaatgattgacactaacaggagaattattaatagtacagagctggaattaacaacaaccactacatacacacacatatacacagtcccagggagtattagatctatagtcatgtatttaggcaaaacttccctttgaactgctttgatccatctgccctgaacatatgaaagaagaagagataactttg

SEQ ID NO: 137501 - DNA, 447 bp, Homo sapiens
tacctctatggaatctcacttagattcctctggtcagttgataagtcctgtgatgaatgttgtggaccagagttggagatgggcatgaagcctatctgatcttcaccagcatcacccacatctgtggaggctgatgctgagcaacatcacactgcaagtgatgaaaaggccagtggtaaagtgagtgtggcctcccaaggaactgaggaggaagagctaggaacttcggtagataagtagatggcacaaccaaatttgttatacaatagataatatgagcctatataacttctacatttcgttgttttctacatttttctgtaaaaaggtaacacatccaattttaaggcttactgccagattactttccaaaaagattgaattcaagcattcccatatatttaaaaacagaggaaatcattatttgtaattcaattcagtaagtga

SEQ ID NO: 137502 - DNA, 201 bp, Homo sapiens
gacagtcacataaacttggtgtgaaatttacactatagcctgaaaaacacaacctgagaattgaattctcatgattacaggttagtgtgggcccaaggtgcctagtacctggaagaagcaatcacaaatctctggggaaatgaacattaaccaaaatctcaaagaattcctgcagagttccaatgaccataagctccccac

SEQ ID NO: 137503 - DNA, 317 bp, Homo sapiens
atttccttttgagtttaacttagcaggatttgtttaattttgtatccctccaagcacccaggctggagtgcagtggtacaatcatggctcaccacagcctccacctcatgggctcaagtgattcttcctctttggcctcctgaatagctggaactacagacacatgccaccatacctggctaatttttatttttttttatttttggtagagatgaggtctcgctatgttgcccaggttggtctcaagctcctgagctcaagcagtcctcccacctcaacctcccaaagtgctgggcttacaggcataagccaccatg

SEQ ID NO: 137504 - DNA, 447 bp, Homo sapiens
gaattattcttggtacagatttgaccatttattagcttggtttccatggttacattagccaacctttgggctttcgcgtcttcattgtaaaacaaagatggccactctatgtacacaccaagataatcacatgtgaaaatgattgtaaagagtcctaagagcaaatatgagttttcagtttatgctcttgtctagagagctaatattttaggattaggttagggagtgggaaggaatataaacatctgggagcactgtgtaatgtgtatccaaagacatttatcccaacatcactgactcatacacatcaatgaattgaagggtttgtcattcataacaattatgccaaccattctagctgcgtataatcagtaaacctgttttctttggaaagctgaagaagtcacatggtctccattttcattccagtgatgttccatggtggtt

SEQ ID NO: 137505 - DNA, 161 bp, Homo sapiens
tgcactagtgtaggtaccaagaatacagaaatgaagcccccaccttaagatgctgggagcctcacagagaagacaggtatggaaggagctcatgtgaaatgagtatcgcatgaaatgaatgttatgacagtgtcctgcaagggccaggttaaggaccagag

SEQ ID NO: 137506 - DNA, 209 bp, Homo sapiens
agtggaaaatcccacacccgacctcatgtgatgagtccaaactgttgtatgcccaaaattatttaaaatattgcataagatgaccttcaggctagtgaatagaaggtgtctatgaaaccccatctctactaaaaatacaaaattagccatgcaccaccacccctggctaatttttttgtatttagtagagatgggcacacataatggag

SEQ ID NO: 137507 - DNA, 375 bp, Homo sapiens
gcgtaaaagccttcctcttgaaataaagcaaataaagtgctaactggttagggttgagcaagagcttcttatggtcattatattgttttctgggtctacaaaataggatgttcagactttctgggcttatattaattaagcaatccttggggttgtcccatcccctgaatccctgaaaaatattgcagctctcgtggtgacttttgtgattctccacttttccccccttggataaagcacttcctttcaccatgaggccagattgggatgcagacgtgacccagcacaattagagctgctgctggttcgtgcccctggtgaagagccatgtcacatttttctcttctatgtacagcgttttaacttactgacaca

SEQ ID NO: 137508 - DNA, 358 bp, Homo sapiens
cagagctgctgtgatacgaatgtttgtgcccacccccatttatgtgttaaagtcctaacccccaagtagaaggtattaggagatggagcctttgggaggtcattaagccttgagggcaaagtcctcatgattgggattagtgtcctcctaaaagaacccagggagttagcttgtctcttccaccatgtgagaacacagcaagaaggcaccacctatgagccaaaaagcaagccctcaccagacattaaattggccttgatcttggactttccagtctccagaactgtgagaaattctgtgtggagggagtaacagctgagagccctggaatgacagaagattgtggtcacagtatggg

SEQ ID NO: 137509 - DNA, 274 bp, Homo sapiens
acaatcacatgatttcgtacatatgagtttctagaagagagaaatctaatctttagtgctataaaacagattggtcgttacttgaagccagagttgataagaaagactgattgaaaaggaacactacaaaggaactgactatgaagaaatatttttgggatgagggaaatatttaatgtcttgatttgggtgacggttacgtgggtgtatatacttgtcaaaattcattaaactgtccacttatgtgtattttatctttttattgttttacttc

SEQ ID NO: 137510 - DNA, 179 bp, Homo sapiens
gcagtggactggaagaaggtaagggatgccaggtatcccatgttctgtctcagctctgcagctgaagatttgggccatgggcttgtacggccctgcagcaggggaagggtatagaggaatggctgcatatcaggaccaagtccatgtcatcttcttaggcattgttaccacagatggag

SEQ ID NO: 137511 - DNA, 408 bp, Homo sapiens
gccacacctgtgatatgaatataatattccagaaagagaagaggtctcatgatgaatggaaccttgattaactcaaaactgtattgactcagaaaagacagagcagacaggagaaccatgtgagtgtggtgtcataaagtcaagggaagagaaatttttcaataaaaaggaaggtgagcagagcaataatcaagcttaatgatacttcccagaagtctagtaagataaaattgaaaaacatctgctggattcagacgtcgttaatgaccttagcaaaagctgtttcatgtctggtattggttcagggctagctacctctgtgacatagacaagatcagtgaatgtctctgatgtcaggtctattcatctgcaaaataaggggaatggggctaggttggtgtgttttga

SEQ ID NO: 137512 - DNA, 118 bp, Homo sapiens
ctggcaccagtctcttagcacatattgaagtcatcacctcctcccctgactgcacttaagtcacagatagcttgggttggttgaggatcctactgagtttacctgagacagtcctggc

SEQ ID NO: 137513 - DNA, 582 bp, Homo sapiens
cagggagatcaacttatagtcctttatatgaaatagaaacactctcttgctttccttttggttaaggtaggaagataataaatcacagtggcttgggtttgaatactggtttatttgctagctgtatgaccttgcaaatgatttaaacaatactgctgagtcctcatgtgtaagttggagaaaacagtacatcccaacaaagttgttggaggattatgcctgaacatgtgaaaaactactagtattgtgcttaacatatagtagttgcttaataaatgatagccatattctcagtgcacacttaagatcacaccctaattggaccagtaatcacatttcatctatttagttggaaaagtagtaaactgtgtctttatgccattttgtgtgtgtgggtgtgtgttttggtagagaacggggttttgccttgttgcccaggctggtctcgaactcctgagctcaagtgatctgccccttggcctcccaaatgctgggattacaggcgtaggctgccgcacccagctaataatatgctatttcaagtgcatttagagaagagtgttgatgaaccatggaatgatt

SEQ ID NO: 137514 - DNA, 436 bp, Homo sapiens
acttttaaagaatcccggcgggatgggggttatacggatggagactgggtgtatgggacagagaaatggatgtagaaacttgtgctgggtggggaggagggctggacggatataaaatgtacgttggatgagtgggacagggagagagctgaatttatgaatacaatgcttcttgatgtacaatggggctacagtccaacaaacccatcataagtttaaagtgtcataaggtaaaagtttcatacgcattttcgtatgatgtgtttttcacaagcctggtaagctgaggagtgtactgggtgcctatggctttcctgccattgtgaagttgaaaaagcatacgtcgaaccgtcataagatggggaccgtctgtatatgctgggtggggtaacaggtgcatagacgaacatatgaatatatgtccaagtggacagat

SEQ ID NO: 137515 - DNA, 260 bp, Homo sapiens
tgcgcttcacgtgcccgccatatcagcagcagcggcggcggcggcgaggagggggtgctgggaggcgcgcggccgttcccgcggggtctccggaccccgcctccccgcccctccccgtgggggctgggccgagaccaccctgcggcccccatcccagcgcaagccgaaagcggcgctgccagacgcagagaggctcctggggcgccgttccgagagccgcgcggcggcagcagccaggggagggtgctcctcgcggccgc

SEQ ID NO: 137516 - DNA, 535 bp, Homo sapiens
gcagtcagttgacaacattgccatagccattattttgattgtgcagagcctcatggtaaagcggaggtgagcacctggggacttctcagatttttctgggcgtgcacacagccccttatctgtgcttggctttcttgattattaggtttttcatatttttgttggagcttttaaaactcttacagacatctcagtctcctgcttttccttctgaagtttttggttggtcttttgtttgtctctgttgttatccactgctttagccagcctctaagctaaacaattccctggaattcttttcaacaaatggccttcaagtaaagggatttcacactggtgaactctatttatgtgaaatacctagctttgcaagagggatcttccagggaacatttatacaggtgaattttctgggaatgaggctttgatggagcttcagcctcattgtactccctctgctggcttttcaggctgctggattttaccagaaatctattatgctgtttgttttcaagtctactgcagagctgtatgg

SEQ ID NO: 137517 - DNA, 334 bp, Homo sapiens
tccacctttcatgatcctataaacccttaccttttacggttccctcattctaactgcagcctgcctcagggcttcatcaatgggttttggtaccacagtgctgggggctcctgtattgagtcccagtaatcttttctccacactgcccccaccgctgaccattttacctactgatgtgcataaggctttgggtctccactgagaaggggtagagccaagggactgtgacccttttgtcaatcttcatcttgatgaacctgctaacaactgtcacagtgattgctggtcaggtttctcatgataaactttgcctttggctttttaaatttctcca

SEQ ID NO: 137518 - DNA, 452 bp, Homo sapiens
tgtctcaggttcgggacgccagaaagaacgggtacacctgagtgcacagacaagtccagtggctctcttccgtcgtggtccactgtgccagctccattgttccagggctgaggcctagggcggtggggctatatggcaggaggagtgtctgcactttgggcctctgcctgggatttatttgtgtctctgaggcatccagcagactcttggaggacaggatgaggtgttccctggcctttcccagcacgtaggtgggaggcctgggcccctcatgaagaaatcagacttggcgtggacttgcaaggaaggtcccccagccggaggaggcgtcatcccctccctggggctgaatgctggggccacctctcccctcatgcctgccatccacaccccgctccaggtctgcttttaggccccagtccctgccccatctagtgtgttcttccagcctc

SEQ ID NO: 137519 - DNA, 492 bp, Homo sapiens
ctacacagcaagactacgagagtagagggagttcgcgagtagctggctgctgcctgggtggaggaaaccaggggtggagagtcgcccttttctatcttttccatccctggggttcacagaccctgttcttctgtgggtgtccacaggtccagaggtgcaaccctgcagtgggatgtcataggatgtgaccttgggccttgtggggagactctgccagtctgtgacagggatgttccctctgtgaccccctattccaagggcgtctctcttcctttgtctccttcatcccctttggaacatctcctaggacctagggttcctctggagtctgatggcccactccacgatgacaccccagccgggccagcctcctccccttgtgcccacatcccaccaccatgggtacctgccttgagctgtaatccctggaaccaagtctccctattttacaaagtctcagacaaccatccaatgcttaaggtcttttttttc

SEQ ID NO: 137520 - DNA, 443 bp, Homo sapiens
attacagttttgcataggatagtcagagtgtcttcactgagaaggtgatgtttgagtaaagacttaaagagaggtagttagccatattgctgtccacaagaagggcattccagactaaggtatcagtttggtgcagaggcattaaggtgagagtgtacctgagaagcaacaaggaggccactgtggccagagagaactgagtaggggaagaagagtataagaggaagctggaagagtatcagtggttaggtcccttaacctaaccattgtttgtttattggacattttaaagacttcggcttctttctactctgagtcagcggagggttttgagaacaggatgacatatctgagttttagacacacacacacacacacacacacacacacacacacacacacacacacacacacttttaaattgtagagatagggtctaggta

SEQ ID NO: 137521 - DNA, 190 bp, Homo sapiens
ggtggttgactggcgtctaggggcaggtagggtggatagatttgaagcaggcaggaaaaaactttgaaggtgattatgttcattatcttgattgtggtgatggtttcataggtgattaactatgttgaagctccacaaactgtatgcttaataaaacttttaaaaatggtccatggaccatctgcatctg

SEQ ID NO: 137522 - DNA, 472 bp, Homo sapiens
taataggctatgatggctagaaaggatctcactgatcatcagtgcaaggattgatttttagaaacaaggaaagtgaaaccagagacagccagtgactagtctcagtactcagagaggtcatggttggtcagaggtcagaactcacatctcctgacccacagcacgtttggctttgtgcacaactgactgccttagttaaggacagataattcttttctctttaacaatagaaaattagactaattaaagtcataaaagatgttgctcctttataagccatagagaaacccccgatggtttctttatttggatctgtgatctttaaagcatgtgactagcagctataattggattaaagtgaaaacatgtgattgtgaaggagttaaagtacctttgccttattctgctttgatagccagcttcaattgcacatcgtgacaagcagtgaaccaacatcaaccctgtggaatta

SEQ ID NO: 137523 - DNA, 325 bp, Homo sapiens
tgggtctccagcctgcttgctgactctgcagattagacttaccagcctccatgatcatgtaagcaaatccctttaaataaataaataaataaatagacatctctcagtaacatgagtgcccagatcttgatttctaaataacattcacactaaaaagaattagggctgcttgaaaatatgacagatttcaaggctggataaggtaagtacaagatgactctgaaacacttattgccagaatataagaaaaggctcaggccggacgcagtggctcacacctgcaatcccagcactttgtggggctgaggcgggtagatcacttggg

SEQ ID NO: 137524 - DNA, 1113 bp, Homo sapiens
cctttccctacttttgagtatcatcgtgaactcgtgttttttagtatattttcaggggtttcagtataccgcagtcattattctttctgatgctcaggggcagggaagggacagtatctttttgatagaaggaaacaccaggactgcctcagtggaccttgttttggaatgtccatcatttgtaggaatgatggagtctcacttcctaatggttcagaaccattagaggtgcttccctaggtgcccaatacgacctatcactgttagagtataatgcatttctttggctatttatctggttaaagcaactcctttatccacagaaaaggaggttgaggtaggaagatccctggagcctaggagttctagtctagcctgggcaacatagtgagatgaacatccacagaaaaacccacttttacagctttgtgagaataaaatttttagaaaggaaatagattttttttttttaattactaagattctttgattaggaactacagtagaacactgggattactagtggctatacgttgttattttcttcccaattgtaaggctttgtcagcagaacatgaaattaagctaaaagtggaaaggtgggacatgtaatagccagaatgttcatcaacaagaaaagaaatttatcttgtaaaaagtgtgtctttgcacgtaagataaacataaaacagactgagcactgatattgactagatgctttaaaataagcagaaggggcagaaagttaaatatttagattagttcaaaatgttagctttatagtagtgtgccattgatggagcattcctggaacatgtcttctctgcttgttttaacacctgaccttggtccctgaaatggaatgtatagacaggaagacagtgatatgggtgggtttgtttaacattttctctttgtttgaataagccctttagttgtttcttaatactgttgaatatttagtggctttctaggaccaagacagtatggttctgtcatgattggtttgggtttattgacgttttccccaaaaggacgggacacacttgaatctgaggttgaatttagttgactttttcgttgtacgtttatgaagaatagatgaactttgtc

SEQ ID NO: 137525 - DNA, 614 bp, Homo sapiens
ggtacctaaaatgtagataatcaataaatcaatcaatgataagaattaatggaatgcatattaaatccacagatttgtgtttgctgatatagacaataaaaatgtaaggtaaatgccatacaaaaacattgacataaaagtcaaacaaattgaaaaatattcttaccttgaaagcatcagcaagcaacttgggagacaagtgtaatacccatgaatcgatacatccataagcagacaggactcacgtttcccaaagctgagctgctgtataccattttcacaatttgtgtcatattttctgaaatacataaactatcatgcacttaaaatttctataattactctttaattaaatctatttttaaaagaaatgttatagcattgccaaaaatagaaagctagttatcatgtgccataaataaaaaagaaaacctcaaaaataaatgcaattaaaagaaactatattaatagtactaaatgagagttaaatacagggactccaagcctgttgttgctggcagtggtggtggtattaaaaatggagattaggaagtgtttcatgcttttcatgctaaacaaaccactaaaacactagaacaaaactgagactgtga

SEQ ID NO: 137526 - DNA, 373 bp, Homo sapiens
tcctgacactgttgcctccacggccttcctttttgaccactcctttgttgattcctgtattagtttcctagggcttccatgaaaaattaccacacacttactggcttaaaacaattgagatttattttctggcagttctggagtttagaagtctgaaactgaggtgtcagtagggccatattccctctgaaggcaatagagaagacccccttccttgtctcttcctagtttctggtggctcccagcaatcccaggtgttccttggcttgtagttgcgacattccagtctctgcctccctctgcacatggtcttcccctctgtgtgtctgtgtctctgtccaaatttcctttgtcttataagggatactgcttg

SEQ ID NO: 137527 - DNA, 723 bp, Homo sapiens
gcggccgctccaacatcaggcgctccagccatggcgcgttcgctcgtccacgacaccgtgttctactgcctgagtgtataccaggtaaaaataagccccacacctcagctgggggcagcatcaagcgcagaaggccatgttggccaaggagctccaggcctcatgggtaatatgaaccctgagggcggtgtgaaccacgagaacggcatgaaccgcgatggcggcatgatccccgagggcggcggtggaaaccaggagcctcggcagcagccgcagcccccgccggaggagccggcccaggcggccatggagggtccgcagcccgagaacatgcagccacgaactcggcgcacgaagttcacgctgttgcaggtggaggagctggaaagtgttttccgacacactcaataccctgatgtgcccacaagaagggaacttgccgaaaacttaggtgtgactgaagacaaagtgcgggtttggtttaagaataaaagggccagatgtaggcgacatcagagagaattaatgctcgccaatgaactacgtgctgacccagacgactgtgtctacatcgtcgtggactagccctagaatgccatccttcttcaggagctagtttggagatgggtttttctggtgccactgacacctgggctgcccatgccgctcaggctacccttatctcctctgcacttatgttatcaataaagaggcaaattctca

SEQ ID NO: 137528 - DNA, 348 bp, Homo sapiens
cgaaggaagatgcaaactgtgcagtgtgcgacagcccgggagacctcttagatcagttcttttgtactacttgtggtcagcactatcatggaatgtgcctggatatagcggttactccattaaaacgtgcaggttggcaatgtcctgagtgcaaagtgtgccagaactgcaaacaatcgggagaagatagcaagatgctagtgtgtgatacgtgtgacaaagggtatcatactttttgtcttcaaccagttatgaaatcagtaccaaccaatggctggaaatgcaaaaattgcagaatatgtatagagtgtggcacacggtctagttctcagtggcaccacaattgcc

SEQ ID NO: 137529 - DNA, 113 bp, Homo sapiens
gaacttgggatacctcttaattagcagttagctattaataaagactggccaggcacagtggttcacttgaagtcaggaattcaagaccagcctgaccaacatgtgaaaccctg

SEQ ID NO: 137530 - DNA, 326 bp, Homo sapiens
gatgatcatgagccttattaattggattcgtcacctttccctgtggccaaaactttgaaagtagaattttgagttttattctttactatatcattttactctaaaatatgttcaaatagatttttccacactgtgtagtactgtactgtgtaaagaacgtttgtaactaggtcaacatacactgtttctaggcaccactaaggaaataactgtgttatacccataatagaaaattaccagagtaacaggattaaaatgactcattaggcctttgattggggtgctctgtgctacaggtagtgccaaatcgagggctctgaagactc

SEQ ID NO: 137531 - DNA, 769 bp, Homo sapiens
agaaatcctgtcatatgccacaacggggctgaagcttgatgacattatgttacctgaaataagccaatcacaaacaaaaatacaaatcaacatatatgtatgattccacatagatggagtacctaaagtagtcaaatccatagaaacacaaagtagaattctgattaccagagcttgggggcagagggaaaagcaggattgttgtttagtgggtatagacttttcagttctgcaggatgaaaaagttctagaggtctatttcacaacaatgtgaatacactaaacaattctggaacttaactgcatacttgaaaatgattaagatggcaaattttatgcttttttatcacaatgaacaaaaacgtaatcaaaagataaaagaacatctttatacacagattaattttaaattgacccattaggaacctcacaaattttggttctatataggggagatgcctatgatgtgcctgttacttttacattcagatcctttaatgctcatgacaaacctgtgaggtgggcggagtcagactaatttgctgaacaattaccaaatggccaagattcaaaccacaaggacaattccaaagcccgtgagccttttatacgttgtttaatttccataaatcaccataaacaaaaatcttctttctcctttgctcctctctttccatgctagaccctgtacttacttactcattaagagaagtgttttagaacttggctctggaattgcacaaccctgggtttgaatcccacagatcta

SEQ ID NO: 137532 - DNA, 326 bp, Homo sapiens
tccttggagtgtttcagcagaggaggggcagatctgactcagttttcgcaggatccctctggctacttgtgcgggtagatgataggaggtggggtggaggctgaggaggaggctgccacagcagcccgggcaggagagcctgttctgcaggtggctagatggcagtccactgcccctgctttgtcctcctgtgctgctcacgagctgtgtgacctcgagtcctggctgctttttcttggagctctattttctcatctgcacagtggtgttaatgatgtgacctcgctgatggggctgtggggatgaactgcatgaacacataaatg

SEQ ID NO: 137533 - DNA, 355 bp, Homo sapiens
agtccgttcgactgagcactggacatacctcatcagggagaacctggctctttggaaggccagggttggggaaggaggcctagacaaggcaagttgggttggctcaaccctggcttttgtcttcctcactcacatccttttccagacttatatctgtaagatctgaactcaagatcagaatgtggggtcagaggagtagcaaagagcagccaggatgagtggctgccaagcaagaagggccaaaggggttgtctagacccatcctctgggaccttggtgctggtctctcttggtcacccgagagtgtacctaccttcttgcccttatgatatggttggctcagtcgaacggactg

SEQ ID NO: 137534 - DNA, 211 bp, Homo sapiens
ggccctgtgtgtggatctgacaccctgcccgggtcgctggttcgcgtttccagcacctcgggcgcgggagctgtgttctgcatgcgagtctgccgaacttggagccgctggtgctatgacaagcgtctgtggcctcgaatggacctgagccggcggaagtcactgaccccgcccatgctcagtggtgtggttcgccgccagccccgtgccc

SEQ ID NO: 137535 - DNA, 264 bp, Homo sapiens
aggttgggatagaaaacccaacatacaaaaaaagcatctactgcaaaatactatctatctcagccagcagcagtgggtggggggtagaagaggctgatttcaagttatatggagcacaagaccgaacaaacagaagtcttgaacatttacttgcatttatttccttttctgttattaaaggcataaaagaaaggtcttcatttcaacgtcatggggcaatgctgggactaacaagtttgtgcttgaatgtgaaatgtgttccag

SEQ ID NO: 137536 - DNA, 338 bp, Homo sapiens
ttaagagtcaagggaagaactcatcagaagagtaaaagaagagaactgaaaagcaaagggggacaatcaacaaaatgtgaacctacagtttatacgaggaatgcaatcatacaggtaccaataactcagttgcaaggaataattgaaatatgcacatatataaaaagtacacatactttgtataacttgaaaaacatttgaggatcaaataaaataatgtattcgaaaatatttataaaaagcatgaagttttctacagacaaattagtgggtacaatactgagcgctactccttgaaggtgaacaacatagaaatattgttcagtgcaactcaacaa

SEQ ID NO: 137537 - DNA, 272 bp, Homo sapiens
atggcctcatcctgtgtcccagctctcattacccacactgaggtctccagcctgggctgcaaccctgaaccgcaggaccccacatccagcccctcctgactcatccacttggtgttgaatttgatgcaggccagtgcagccacattgaattctgcatttttccctcttcaaatctctccttcaaggctttctcatcctcccaggcccacggtcagtcttgtttctgtcctactcctccttgagtaagacctctcggctccacctcctaaact

SEQ ID NO: 137538 - DNA, 455 bp, Homo sapiens
tgtcaacatgaagtggttgttaatgcgaaataagaagaaactcttctgatatttataggcccctataaagggagagaaaggaaatcacactccctagaacccgaaagctcccagccgaaccggaccctcggggagttttagaaatccttctttccgcacaggaatttcgcgaaggggtttccggaagactttgtcgaggaaggttttggtatcagactccacgacctcagagcgccctgcaaattccccccggcccagtggctagccccagaatgcaaacctcaaggcgggcgccccagaccaagctgacctagcctctgcccacccccagctcacaaccccgaggctcccaccccctgcccccgaccgggtcggcaccgtggcgtccggcacatgccaagtctaccgtctccaagccaggctgcaagatccaaaggttggggcctgccgcggac

SEQ ID NO: 137539 - DNA, 138 bp, Homo sapiens
tggagtgtcacttgttataccctatgtatcaaacttcccacacggtaccaaaattgttttttcagctgcagtatgagctttgagaggctaggatccctgcctgtcatatgcagcactgtgtctccagcataggtattg

SEQ ID NO: 137540 - DNA, 370 bp, Homo sapiens
gggttcaagtgattctcctgcctcagcctcccaagtagagtaactgggattacaggtacatgccaccatgctcggctaatttttgtatttttagtagagacggggtttcgccatgttggccaggctggtcttgaactcctgacctcaggtgatccaactgcctcggccttccaaagtgctgggattacaggcatgagccaccgcgactggcttggcagtaacttttgaggaataaagaatacagaaggagtttcctcaaatcttgttgcccttcccatctttgtgagctgagatcagagtaccgtatctcaccctctgcctcttggaggtgattatggtttacatataaatgcagattgcaagtccagga

SEQ ID NO: 137541 - DNA, 350 bp, Homo sapiens
taagttggtagcatagtgcagaggatgagaacatagactctgaagtttgacagaccatttctgcatcctgaccctaacacttctgatctatgaccacagacaacttagtcttcctgctccagattcctcacttataaaaacgggataacgatagtacctatgtcaactgagttaacatttgtgaagtgctttagaagagggtctgacatgtcattagcattgcgtaactatttggtgaattgagaaataatgacactagagcaaaaggacattttaaaaaagatgaatggtacttcatttgagtcagcagtctgagttagataaaaattctattttttccccaaaatata

SEQ ID NO: 137542 - DNA, 144 bp, Homo sapiens
tcaaatgttgttcttttcaacaatgcttccatagaatgaaaccctcaagactgagtcaatggttttgtaccaggtgattcctgcttgtagaaacattcgtagttccagggtccactatggggctaaactctgacctctaatgat

SEQ ID NO: 137543 - DNA, 111 bp, Homo sapiens
ccaacatcatcctcacgagttccagcagtgactggcaccttcctgagcctggccaggaagcgaataaacccccccggtagtccttgatgacttggccgaggtggtgtagta

SEQ ID NO: 137544 - DNA, 823 bp, Homo sapiens
gagctttaagacttaatgactgccttgctgggtttcagacctgtgtggggcctgcttcccctttcttttggccgacttctcctttctggaatgggaatgtttatccagtgcctgtaccaccattgtatcttggaagtaaataactttttttattttacaggctcattagtggtaggagatgagtctcttatgagacttaggactttagacttgatgctggaacaagttaagacttttggggactttggggaaagtatgattgtattttgcaatgtgaggacgagatgtggggggccagcggcagaatgatatggtttggatatttgtcccctccaaatctcatgttccagtgtgattcccagtgtcagaggcgggacctggtagaagatgattggatcgcagcagtggatccttcacaaatgggtttgcaccatccccttggtgataagtgaattctcactcagttagttaatatgagatctggttttttgaaagagtcttggacttccccttctctctctcttgctcccactctcaccatgggatgtgcctgctcccccttcgccttccaccacgattgtaagctccctgaggccctgaccagaagcagatgccggcactatgcttcctagacagcctgcagaactgtgaaccaattaaacctcttttctttataaattacccagtcttgggtatatctctatagcaatgcaaatggactgacattcttgtaaacaacagaaatttatttctcatggttttggaggctggaagttcaagatcaagtcatcaacaaattcagtgtctggtgagggcacatttg

SEQ ID NO: 137545 - DNA, 415 bp, Homo sapiens
gccttggtctttgttcccctctcactccctccacccctgccccccccaacacatgtggagtaccttaccctgccttcctagttctggaatggctgcccctgtgccaggccaccccattttctagaaccaccttcatacagcccctgcgcatcccactgtactatttccttgtttgtttttcctgtcaatcttgccttccgcgctaatgggacactgatgctgtatggtgatgtgttctcccacagtcatcttttcctcctgtggttggggtggggagctttctctgtgtccccccatgagagtgaggacagtctcatttaatggcaccatggtctgtggagccaggcaggcctgtgtgtctgactccacttcagcgctctcagccagcgtgggcacctcggacccagacagacgc

SEQ ID NO: 137546 - DNA, 596 bp, Homo sapiens
ctccaaaggccatgtgaggcatcttggtctctgtgtatgcaggtccctgggcatgttcaggcacgtgcctgtctagagctgcctcctgtcccctgccctgtggtggatgggtgggcttctttcatcccctcatttcacccatgctcccacacatgcatacacattctctgagcaagtgggtatctgggcagacagtgtggacagcctgagtggaagaccagctctgagccaaggcagatgtgacacttttgtgtgactaaagcctgagcgggaagctgagcaccagcacacagggcctaggatggctgcaagagggctccttcatgcctccagcgatggctgcctagaagatgcaggcttccttcccaggaccgagatgtgtgatgagcgggaggagggaggagaagagggatgttggtctgggaccctgaggaggaaggcatggcgaggataggtaagggtaagggagaatggataaggggtgagagacgaagttggagagggaagcagaggtagagtcatgaagcctctgccttatgtgccattttaggagtttggcctttttcctttactgataacatggggaagcatccaaa

SEQ ID NO: 137547 - DNA, 389 bp, Homo sapiens
aattcaataaattcatgcccatatttccaaacttacacaaatgcaggaggttctcatatagtaatttcaatagagaggaataaatcaaatagcaaattttactataaaggaaagaagctctgttttacagaaatttcactttaaaaatacaacctcaaaatggtacctccaagaactgcattctgttcttgactttgctaagtaataaactcccttaaaagcatacaattttcaatttttttttcttttttttttttgagacaggctctcgctctgttgcctagactggagtgccgtgctgcaatcatggctcactgcagccttgacctcccaagctcaactgatcctcccaactcagcctcctgaacagctgggaccacaagcatgtg

SEQ ID NO: 137548 - DNA, 176 bp, Homo sapiens
taaagcaacaaacatgtattatctcagtttctgtggaagcaagaatctaggtttgtcttagctggtcctctttcttaaggtctcgttcgaggctgcaattaaggtgttgaccagggctgcagtctcatctgaaggcttcactaatgaagttgccaaactccctcacttggctgttg

SEQ ID NO: 137549 - DNA, 474 bp, Homo sapiens
tgtctcaccattctgtccacagcagctggcgcctgaaaggcatgcagtggaccctctgcattttcatttcacagtgatctttctccagatatttctcatgtgatgtctgtatcttgctcttacctcttgagactgtgcatgaccttaatgtaatgatcttttgaggtaacacacacataccatttttctgcattgtaagtttcaggggatggatttttcctatatattttcacattcttcactgcatcagaagtgatgctgagtatatagtaggtgctcagttgtttaaaggacattgaagagagaggagtcaaggtaaccaaatgcacaaggaagtaaagcaacatgagtaagagccagcagaatcaatggaaggcagaaatagacccacacaggcttcaggtgttaggattatcagaactaggttgtaactatgcttagaatgtttaaattaatgaaagacaaactggaaaa

SEQ ID NO: 137550 - DNA, 282 bp, Homo sapiens
tgctggaattacaggcgtgagccaccgcacctggcttaatttgttaagtatatgtctctcttacagaaatgtaagcatcttgagggcaggtgatttgtttgttgttcatgttttatccccaatacctagaaaagtgctagcctatagcaatacatactgctgagtgaatgaaggatgccagcactagactctttccagaaccacttaccacaaagttatttagagagttctcatcatttcacaacagtagctgtaaacttgggaccaagtaaagaagagcag

SEQ ID NO: 137551 - DNA, 342 bp, Homo sapiens
attcatatgacccagcaaatgagtattcaggagataagaacaagaaaacagtccagcatttggggaaagcatcttcctggtgaataaaactggtctgtgtgtatggtgggggcaggaccccgatctactctatgagtgtcaccagcatattgctctgctgtgataaagttctccagggcagaaacaggtatcacttgggagaaaagtaatattaaggcatcttgtattttaatgaagcacccaactcattttttttccacaaaaagtaattacaaatttttccaatttaaaagcaggcagctcaattatgtaattgcctaataggttatgtgggcactgcag

SEQ ID NO: 137552 - DNA, 345 bp, Homo sapiens
ttgttgtctcatgatactttgggttgtatgggctcctgtggatgctgcttctgctcagttggctggggttgcagtcatctggaggctcgactgggctggggcatcttaggcagcttgttcacatggttgaaggtttatgctgctgtggactggaagttcagctttggtctcttcccggtggcttgggcgtgggtacctcatagaatgacagctggttctaaagaggagtgtttcaagcatgggaatatcttggaagtgattcagtatcacttaactgcattattttagtcatagtgacactggtcacagggccagctcagattcaaggggagaggaaatagactc

SEQ ID NO: 137553 - DNA, 233 bp, Homo sapiens
agactagtttgacttaaaggttacatggcatacacaaaactccttgtgaggacattctaggtgaggcatttcaaagagctaggcagttattttctagagcagctaatctgtttctggtattaagagtcaatttatataggccatgatgatcacaagtggtggtctcacgtcacctcgagtgttgtaagagtggaactagacgctcaccaggctgcagttgtggtaaacgactc

SEQ ID NO: 137554 - DNA, 386 bp, Homo sapiens
ctcagcctcccaagtagctgggactgcaggcagacaccaccacacctggctcacttttaaaaaaatttttgtagagaaaaattaagatttttgtagattttgccatgttgcccaggctggtctcaaactcctgagctcaagcaacccacccaccttggcctcccaaaatgctgggattacaggcgtgagccaccgtgcctggccaagcaggccattttcatatgggtatatccactaaagaagactccattggagtagagggaaatttatttctttgaccacctgctaaactgaagtcactagagcaggaatagttttgttttccctttcctggtgttttaacgtagcgtcctaaggtaacaggagctagaggacttggggcgcag

SEQ ID NO: 137555 - DNA, 374 bp, Homo sapiens
cccttcagactgatgtagaaattgagaggaaagaaatagaagagcctaactgctggtgtagcagaatcagcagatgactttgtttcaaatagagatttcttgctggaaaaaacaaatttcctcagaaaatataagtgaaatgatgttagataaaaaactcagactatgtttgacattcaaaaatttagtcttcagcctgtcaaacaaagtgaagaattctactatgaccttggcaaatattcagccttttagctaaaaaaaagcaatgtaaacaaaatgagtacatatccaagttttatatgactgttcacatgccacatatactgacacatctccagaaaacatatagactgtctggggatttagttatcttg

SEQ ID NO: 137556 - DNA, 549 bp, Homo sapiens
ggccccgttatcatataggaggtggatattaaggtgagatgttgttaaataataaaatgtcagtataattactgaccagataaaaactggtgagaaagacattcttaacttcaagtttgcatggcatagtgatgcaatcagataaaattaaactaatagcaagacaggaatgagtgttaaattgaaaatcagaaaatgcaggctctagcccagctctgccaaggattaactttgcactcttgggaaaatcacctccacagtgtctgaacatgccaagcaatcttgcaaaggtaaacttgggtttcttatttccgcagaattaaatgctagcctgggggcaagtttaaatgcaaggctaaagttctagagaggatatcattaggatttttaaggtggatattaaggtgagatgtttgttaaataataaaatgtcagtataattactgaccagataaaaactggtgagaaagacattcttaacttcaagtttgcatggcatagtgatgcaatcagataaaattaaactaatagcaagacaggaatgagtgt

SEQ ID NO: 137557 - DNA, 253 bp, Homo sapiens
cacacagcaacctccacttcctgggctcatgtgatccttccaccttagcctcccaaagtgatatgattagaggcgtgagccactgtgcctggccaaattcaccatttttaagtgtatagtcctgtgatttttcgtatcttcagtgttgtacaactatcaccactatctaattccagaacatttccatcatcctctaaaaaaaaacatatacccattagcagatactcccagtcacccctactcccaagccact

SEQ ID NO: 137558 - DNA, 280 bp, Homo sapiens
cacacagcaacctccacttcctgggctcatgtgatccttccaccttagcctcccaaagtgatatgattagaggcgtgagccactgtgcctggccaaattcaccatttttaagtgtatagtcctgtgatttttcgtatcttcagtgttgtacaactatcaccactatctaattccagaacatttccatcatcctctaaaaaaaactgtatctgttaaacgataattacctattattccttccccaagccacggtcaaacccacaagccacggacaccccac

SEQ ID NO: 137559 - DNA, 154 bp, Homo sapiens
cggcccgctttgcttctgcgcttctgaatttcttctcgtgtcggtaactgactgctgggcctcagtttcctcatcagtgacacagcagaaaaaaacacaagtccgtgccccctggggctcacgctcctccggtgctggagagagaccagtggca

SEQ ID NO: 137560 - DNA, 409 bp, Homo sapiens
ctcctggggcaggtggtagatgaagattgcagccatcagggccttctctttgctgctgctgctgttgctgctgctgctgctgctgctgctgctgagatggagccggggggtcggggcccacagcccagacgctgcagagaagctggggagatcgacttaccaggagtgggaattagctatccaacgtaagaaaatgaaattagcttgactttagaactacgagaaggaaatagaaaatatccttataaccttagggtagaattccttaaaatataaaatgcagaattcaaaagagaaaatactgatacatatgacacatttgactttgtaaccttctttttcatactaacctcactatggggacaactgtaacttttattgaaaggcatttttttttaataagccacag

SEQ ID NO: 137561 - DNA, 272 bp, Homo sapiens
cacatcctctgccctagatagttcaattatggaaagcaatcctaattataacataacctagatacccaagaacaaattcccattcccacattacagatgaagaagtccaaacacaaacaacttgtccaaagtcacatagctgggtaaactgaagaacatggtgttgctccaaagccatttctactaactacgaccctatacaaaaatctaaaacagaaaattctgcttacatggagatgttcacacatatatatttcttttctttttagaga

SEQ ID NO: 137562 - DNA, 327 bp, Homo sapiens
ataaaaagagaataaaagttctccataaattagtatgtgcaagattcccccagagagcaaaatattttcagccattgtggaggtatgagaaccacatgtttgcctggaaaaaaaaagtatgctctttactatggatttctgaatcattctgtcaaaatatttgtagttatttctaagttataaatagacaattaattttattacttttttcctttaattcatatcactaggaaggtactagtgaagaattttttccccctgcagactaaatattatacacagaaatataacaaatgaaaaattgtttatatgggtcaataatttatg

SEQ ID NO: 137563 - DNA, 120 bp, Homo sapiens
tcattcaataaaactttccctatatcaatgtagttgttatactccattcaaattaaatatcaggtattgaaatagatgaaaagagacttcgtgtgaaatttttcaagagaaatgagaatt

SEQ ID NO: 137564 - DNA, 471 bp, Homo sapiens
tgacaccttaaggagatgctgtacgaatactcacctagcaggtgtgtgcagggtgatgtgcagggagggaccaaaaggaggtggccacagttatctgggcctgatgtggcactgattgtgggaagaggaaagaaatggacgtgagaaaggaattctggagacactcccaggagggaatcaatgtggcaggatggctgatttcatgaagggggtaaaggacagagaagagtcaaggtgactggaataacatcaaacctgacacaaagagggatgcccagtggggaagaacagatgtgagaggaagttgaggacttgaaattaacactaaatgagtttgaggtgaaagcagggaatcctggtgggaatgctgagcaggtgaatggaaatccaggaccacaggcagtatgtgggctaggatcaacaggaatgtgggtgttccccatcctaggagacagcaggaaaggggagagg

SEQ ID NO: 137565 - DNA, 187 bp, Homo sapiens
gccatggtctgcctgatgcctggctccacacagaagaactcaagaaaggttctggcaacccataggggcactagggtcctgaccctgagcaggcgcagatgacttagagacagtcatatcatgtccttgcacctgttcattctggatgcagatcctcctaacaagctgcagtgtgtctgatcactga

SEQ ID NO: 137566 - DNA, 113 bp, Homo sapiens
acagaacttttgagaagcatcttgagatcctgtggaattttctctgggaaacggtccagtgggctctggatttgaggatgaattgaaaattgctgaaggaatttggagaattg

SEQ ID NO: 137567 - DNA, 399 bp, Homo sapiens
cgttatagcaccgtggtatccaggaggccaaatgaagaaagtgcatgaaataagaagggatcaattgtgaaaatcatgccaatagctctagtaagataactgagaattcactacgaaacttggtaatgaggtgatgacattgtcaagatcagtttgtatgatactttgtattgttttctaagttctgaaacagattatatttcttgagctggtgatatggagaatttagcatgagtaattatggtttaactgtggtatgagatattaaaatccacacacgaaaaacaacaatgacaacaaaacaaaacacatgaaaatacgattatcttgacaggcttctgcagggttttctgctttgaagatctttaaaggtctttttaacctttaaccgaagactca

SEQ ID NO: 137568 - DNA, 381 bp, Homo sapiens
aattaagtggtattggcatgaaggactactaactgcctcaacttattaaaaacagtgccacgtcaggccaaaaaaaagttaacccatgtaaccactgtaatctaatataatgaggactaatgttttctctggctactaatcaggattagtaagcagagccaatttacactatagcttacaaactaagagcaatatgtttactgaaacattctaaaaatttagtctactcttaaccaaagagagtgttatgttccaaaagaactgcttaacacttctagtgtcagacagtattacagctgtaagagatcctagcaaatatcttgcctaacaccctcatctaaacataggaaaaccaaagatcagcaaagttaaatggtctga

SEQ ID NO: 137569 - DNA, 658 bp, Homo sapiens
ggctccctgccctgctctgtgtatctgtgaagggtgggtttgtctgtgggctccccactccgctctgtgtgtctgttgagggtgggtttgtctgcaggctccctgccccgctctgtgtatctgtcctctgcggtttgtttggtttctctgctgtacagcattctgctgagcaaacctgccgtgtacatccgtctttcctcctgtggacaggcttttgggctgccaccaggtttttgctttgaggaatggtgctgctgtggcctgtccacacacctctggctgtgcatgtgggttcctcttagctttgtacctggaagtggaattgccagctcccagggcacggaagagtgatgcctgcgaacacccacgctctcgctggttctccagcacttagaattccggggggttcacttttgctggctgagcaggagcaaagggggcctctctgtgcctggatttgcacttcctggtcacgggttatggtgagcgtcgtcttctgttcttggccatgtgggttttcttttctgtgaaaagtgtttacatctttttgctcatttctctttcccctttgaaaccatcagaactcacagaaagtttcaaggatactgcaaagaactttttgttctccctgagccattggcttaggccaccagcatcg

SEQ ID NO: 137570 - DNA, 553 bp, Homo sapiens
aatttaaaattatattccatgataatggttctcataaaccttaatgcaagggaaaaaaaaaaaactacagcagaataaagaagatttaaaaagaagcaggataggaaaaaagacaagccagaggctagctatatcttttcataaagcacacctggtctcataagcacatgagagctaggcccagaagtttcgagccttggagactcacttcaaacaaattccagggaaagacactcaattaagtgttcaggacaattgtatatccccagtgcactcatgtactggaagtgcttaaactctgccctcagtggtcaataaaatggtattaagtcacagacaacccattgccattggtattggctgatgtctctggtagtttatgtgatgacaaacattagccttaacagcagagccttcctttctttgatttccgtgtgaaattctgtggctgggagatgtttatgttcacatgaacataactgtaagcaaaccatcttatggtagacatctctccagaaaaagcaaattccatctttttaaatagaaaaaaaaa

SEQ ID NO: 137571 - DNA, 402 bp, Homo sapiens
tgctgatggacatgcacagtagggttgggggctcaccgaggaggtggtcaggccaggccccactaaatctgctgagagtgtttgagtggttcttgtggtcatgccaggctcctgaaggactgctgcctttatctgctcggcggacacagcagagcacggcatctgggtaacttcacagcagatatttattttctcagacttctggagtctgaaattccaagatcaaggagtcacttggttggtttctccttaggcctcttttcttggcttgtagatactctggtcacattggattgggcccttcataacaacctcattttacctttcaaagataccatttcaatacagtgacattgtgaagtactaggggttaggatttcaacatacatggatttggtgagg

SEQ ID NO: 137572 - DNA, 685 bp, Homo sapiens
gtaatctattaggccttggatggattattattttcttgagaaaatctttatttcctcctctctccctaaactaacttttatcaggttttttcttaatacagctttaatatgtaaagtttcctaagaatctctcttattttctttatgattggtggctttattataaatatttcaagtgttgtgatcagggttattttgtaggaagtggctgccaattattttgtctttctcaaaaactatgcattgtttttcacttaaaatatatttttttcattcagtatttctgaagtatttcctatgtgctagttatggtgcaggctacttgtaatacaacaatgaatgaaacatggaccctgccctcaagtgatagggaggagcagacatgaaatgataaatgacattacaagtagtataagtgactcaggtgctctaggaatatataagatttactagctgtgcctaggggatccacagaaagccatttttaacagcaagaatgtagtatgcaacatacagtgtcatgacaggatgtgatattttttgaaatggtaagaagtatgactaaatatagcgtgcatagaatgggggaatagaagatagggttatggaggtggatttgggccagaatataaagaattgacaagtttaaattcatcttgtagctaacagacagccactggaagtt

SEQ ID NO: 137573 - DNA, 275 bp, Homo sapiens
acacacacacacgggatcacattgcacccatgaagagcctcacagacaacacacatacacaggcgcacaaatgcatgcacctcctggctcccattcattaaggtcttctggctgaccttcgatttggcttccagaagccctgtcatctttctcctcaaaaccctcaactttgaccttaaatctgcttccctgccttagtgtaagtgaaacctgttggctccactctctctgcagctgcttgtggactgactctctgccttgccttagccctcggg

SEQ ID NO: 137574 - DNA, 424 bp, Homo sapiens
gcaatggttgcacaattctgtgaatatattaaaaaccactgatttattttttcacttcaaaaatgattctaaagtacattagagagaataaagcttaaagaatagctgaggaattgttgggaaaaacaataaagaacactctaccattagatacttacatgtttattaataagacagagtaattaaaattgtgatgctatttcaaaaatagactcagtaatggaacagaatataaagtccagaaacaaattccaatacataatatgtacatatttcattaatgatgaatatggcatttcacataattagagaaaggattccctgttcaatttgtgatgctggtaaaatttattgactttttagaaaatagaaagttaggtggttttttttttttaatcttaaataccaaattgaactttaaatg

SEQ ID NO: 137575 - DNA, 283 bp, Homo sapiens
ctccagcaaaggctggtgatggcttagaatgttccttttgtgcatagaagtattttgcttctggtatgtgccctgagccaggaatagaggcaagctctgattttttttcgctcttgtcgcccaggctggagtgcaatggtacgattttggctcaccgcaacctctgcctcctgggttcaggtgattctcctgcctcagcctcccaagtagctgggattacaggcatgcgccaccacgtctgggtaattttctgattcttgaagtaaaatgagtgctgtatgtt

SEQ ID NO: 137576 - DNA, 452 bp, Homo sapiens
ctcggccctccttaatgtgtgcccaggaatttgaggctacagtgagctatgatagctacagtgagctatgatcgcaccactgcactgcagcccaggtgacagaatgagactctgtctattcaaaaaacaaacaaaaagtggatctcatggaggtagagggtagaatgatggttatcagagactaggatgggtgaaggggggagaagaaaagaggttggttaatgagtataacaatatttcaaaatataagccatgaacttgaattagaaaggacattaacaaattcattctttaacttaacatttttcataaaaccatcatttaacttcccttaatcagattataccccttagttatgacagggagataaaccataactatatcaagtaaagcaatttacagagtgttgatcagtaaagattagcccattatcttctaaatgtacactaaat

SEQ ID NO: 137577 - DNA, 510 bp, Homo sapiens
cgctatcagcctctcaccctcaagagagtgggcaacaggagtaaataagggaaaactttctcttttttcaaagtgtttaattcttttaacatatattggcatttgggaccccacttcaattcaaaagcatatgttagagttagcattaaagtgaaaatgaaatgaggtggttctcccccatatgccactggcttcattatatcacaaagaatgagctcaaataacagggcagcaatgtgaaccttcttgctgataaattctcctacgtttaggtcagtatggatatttggggaaagacaagtgataaagaaacagaaaaattctgactcactctgatattcctttataaatcaatgtataatgatgatgattattactgagaaccctggaagatctaggaaatgggtgaaaggtctagttaatgtttaatgagtgattaaaagaattcatttttatatttcatttatccctagaggatgcagaatttagaaatgtaaattccaaaacaac

SEQ ID NO: 137578 - DNA, 642 bp, Homo sapiens
cctctccttagaatgtaaggatagcttaatgttaccaaatcttttactatgatagtatattaaataaaccaaagggaaaaccaaaaacaaaataatttcagatcatgccaagaggacataaataaaacttaagatccgttcttgacaaataggaacttttagtaaactagtaccagaaggatacatctttaatgtgctaaaagttttgtctattttaaatcagtagtcaatgccattcttcctaaaggcaaaatacttgaagcattctttttaaaaatcaggaacaaaacaagcaacctgctgtcaccactgtttttaaaaattgctctagaatgtttgaccaattgttatttttgtaatcttagaaaaataaaagaagcaattgaaaatctatccctacctatgtatatatttatgtttgtaactaacattactctgataattttggtttgtatcagatgtacatttaggggaaaagggattattttcttcatcacaagaaccagtgcaacaacaaacatagattgactgattgacagattcatagatttaaatataacctttaaaagaaatagggagtacctatatgtagaaaatctcaaaactgagatagggaggacctatatgtagaaaatctcaaaa

SEQ ID NO: 137579 - DNA, 475 bp, Homo sapiens
cgtacgcacgagttcggagttcaaaatgttagtcaggctggtctcgaattcctggactcaggtgaagagttcacccacctcgacctccaaagtgctgggattataggcatgggccaccttgcccagctgagcccaggagttgaggccttcctcagcagcacagtgaaactctgtctctcttaaaaaaaaaagaggccagacgcagtggctcacacctataatcccagtgctttgtgaggcccgagcaggaggaagcttggcctcccaaagtgctgggattacaggtgtgagccaccgtgcccagccagattctcttggatctaccctgcagaggaaaaccatgccaaaatctaaaacttttttttttacaccgggtacgctggcctgcacctgtagtcccagctacttgggagactgaggggagaggaacccttgagtccagggtttttttttctttttgagacactgtattgat

SEQ ID NO: 137580 - DNA, 262 bp, Homo sapiens
cagatggatgaaacaccaaggggattctagaactagatagctaaatatttgtgtatgtcaacaactgtgtacatggaacagacattttgaaattcattattttcagaagtatgggtcatatgaaaaacactgatccctggccgtaggggaggtggaataattacactggaggctttgcaacagtcagctgtcaacactccttttctgtcaatactataagatcatttctcatgttcttctcataggaaacaactgtaacaaa

SEQ ID NO: 137581 - DNA, 409 bp, Homo sapiens
gatatgttaagaggcagggcctttgggagatgattaggtcatgaggcagagcctttttgaatgagattagtgcccttataaaaagagaccctagagagctctttcatccttttttggccatgtgaggacacagaaagaagccagccatctgcagcccagaataatggccctccccagaacctgaccacactggcatcctgatctggaacttccagtgtctagaactgtttgaaataggccacgcgcagcggctcatggctgtaatcccagccctttgggaggccaaggccggtgaatcatctgaagtcaggagctcaagaccagcttggtcaacacggtgaaaccctgtctctactaaaaatacaaagattagctgggtgtggtggcacacacacctgtagtcccagct

SEQ ID NO: 137582 - DNA, 764 bp, Homo sapiens
atttctcacccattctttggtcttctttcttatatataataggaataaagggttcctcttctccttgaagtgagtagtttggagactttcagagctgtcctgggacctggccctgcataaccagaccccaagaagcttccccaaagctgacttgtctttaaggctcagaaagtctacaggggatctgttccaggacaccatgaaatttcccaactcctggccctctctaaaaatcagctgtacatttggaggagtctcttgcaggttgccaaggtctggacctgtgaccccagtcccctctagcctgccccattggcactcaggcctctgggtcttcactcaccttgggcagaatgaagagtggccaaaggttgaaagtggtggagatccctcactccttgcttgcccagggccaaatcagagtgtccaatacccatttgggggctgtgacaacctgccgttctgggaagggtcatgcccacctctgcagtctgtggcattgttgagtttctgcccaaatctagacccaggaaacctgcctgttcggaagcctgacaattcattcccagtgtaaacagagcctttgctggaaaaatcttccctatcagagtggatgagtccgaccctgtgctatgtgggctcttgccatccactggaccctgagatcctgagtggcccatggatgtacagtcctgaatgccaggccagagaggtcaggggcggccaagagccctgcagggctggctgcttctgaagaaggaatc

SEQ ID NO: 137583 - DNA, 469 bp, Homo sapiens
gtaaaacttacacatgagcagaaaaatattattttcacagcccttgttaattatttcaaaataaagcaaatttaatagttactaattgagaaatcgtggtttagaaaagtgtatttagagctcagatttactaccaaagcctccgctttggaagaggagcattcactttatctattaaaatggaaatatcaaattggatgggctgaagaggagacccataactgtgctgaatggtttgcttccaaaaaggcagtcattactttatacagacatactttctcaagcctactgagaaaaccaagtataagagcatgtttagaaactacctagcaaataaaacagacttcacagtcttttctaagaacagagtcaaccactcacgtatctataaacattgagtacctgtgaattccatggagatagtgggaatacagatgaaatgggaaggatagagaaggatatcaaagta

SEQ ID NO: 137584 - DNA, 517 bp, Homo sapiens
tgacattcacaggggtgcgatgttccccttcctgtttccaggtgttctcgttgttcagttcccacctatgggtgagagcatgcggtgtttggttttttgtccttgagatagttggctgagaatgatggtttccagcttcatccatgtccctacaaaggagtgaagtccgctcctcagcttgatgccatggggcgctctggagtgggaattaccccacagtttatcccatctcaagacaaaggagtgggactttcacactcccacacccttagtagttagtgcacgggcaatcactgaagaagggaacacgtgctggccattaggagccaagcatggagaagctgtgagacactgctgaagggattttgtaggcacgtaggtggaggtcaaccagaagacaagtgagccgggatcagagctacccagccaacctgcagctgtgtgagaagggaaggctttttggcctgtaccagtgagatttttttgttgtttgtcatgcagcattattgcagcagta

SEQ ID NO: 137585 - DNA, 500 bp, Homo sapiens
cgtcttttcacaatattcttgcttctgagtgtcatgaaacaattagtcataccaaacataacctactgcaaatccttttatacataaatagtgcatttgatgctagcattttaagtgttgctgctggacacatttgttcctttcacctttaataacataaagctataaaaacatggacatttgtcttcagcacctaatagtgtcctcatcccagctgataatccttccatggtctaaactggctgattaattcagttcattttatgaatagaatagactcatccccttcccatatgcacagcacaatctctcttactaatgcaaaagcattactctaatagtgggcatttcatggtaggtgggaaatggtagttctctggaaaactatgagagaagtattatggataatctgccctttaaatacaccacatgaagaacttacctcttccatctataggaaggctaagcctttagaagaaacagtagagcttcatgggaaa

SEQ ID NO: 137586 - DNA, 573 bp, Homo sapiens
ggtcatcccatctcatgcttgactgatcacagtaaccaagcccttgtgcctcctaggaaaggtcacaggagactccggagcctgccactgtcaacagtgatgcccgtttggctggcactgggttggaatgatttgataacctggttagaagcagggaaaccagaagctggagccgtcaccgtagagctctgtttcaattgacaaatgcaagccagatgccttacagcagctcctcttctacggacttcagtctctctacaagaaacatgcattgtgttgccaccaccttcaaagtggcagccagtgtgaatcctggggagtttatgtgggactcaggatccaaaggaggcacccattcatcagatatatattaagaacctgcctagtgcaaggaactgtgtggggctcagcaaggaatcccaaaatgagaaagattagcccctgccctcacggagcatacactctagaaaggttgtaaaaacaaactttgtatattttagaattggattagagcaaagtcaggttccctcaaaattagaaaattgtaactagatgctataatgtataatggat

SEQ ID NO: 137587 - DNA, 788 bp, Homo sapiens
gaagacacagagacaaagtatagagaaagaacagtgggcccaggggaccggcacactaagcgtgggaggacccgcactggtgccggtctccgggttccctcagtatttattgatgattattttcactatcttggcaaggggagtgcagcaggagaacagggagaacggtgatggtggggagaaggtcagaaggaaaacgtgagtaaaggaatctgtgtcataaataagttcaagggaaggtactgtgcccggatgtgcacgtaggctagatttaggtttctctttacccaaacattttagtatagcaaagagtaacagagcagtatcatcgctagcatatttcgcctctagccacagggtggttttctcctatcttagaatagaacgaataatcgaataatcggctttacaccaagacattccgttcccagggacatgcgggaaacagagggcttcctcttatctcagctgcaaagaggccttcctcttttacgaatcctcctcagcacagaccctttacggttgtcgggctgggggacggtcaggtctttcccttcccacgaggccgtatctcaggctgtctcagttgggggaaaccttggacaatacccaggcttcctcggacagaggtccctgcagctttccgcagtgcattgtgtccctggttaatagagaatggagaatggtgatgacttttaccaagcatactgtctgcaaacatattgttaagaaggcacaccctgcatagccctaaatcccttaaaccttgatttaatacagcacatgtt

SEQ ID NO: 137588 - DNA, 627 bp, Homo sapiens
gaatgacacaatggggagatatccgatgaatatcatggaacatctgtgaatggatcacaactatgcctgatgtgaatcattcttccctcaaaaattctaaagtttaatagttaaaaaattccaaactgttgtcgtcacataaacttcattgtttggcttattttaggggttgggagggaaggaatacaatacatactctaggacattttgccagtaagttgtttgactatgtttaagacccctaagtttaggaaaacataaaaaatggttgcagaaggtgatcagcaagagccctgggtcagtgcaagcaataaaaaagactaactgctcaccactgtcatggaagctacaggatttaagtgtcatgagcttggtggatttaatagtttgccctgtcagtctttaaatttaaagggcttagttaaaggtaggtgtgcataacatgataacggaggcactcccacctgcagaatttctatgatttaggggaacttgggggaagcatttggtgtgtagctctttaggtgacagtttctttcactgaatgatcctgtttcacatatatttccctaatttgtgatcacactgtttttttagggcattattacttgaaacaactgggaaaaa

SEQ ID NO: 137589 - DNA, 227 bp, Homo sapiens
ccttgcacaggtctgtaagctgtgcaacgtggcagtgtgaggtcttttcaccccactgccttaggccctgccacacagtggccccagcttgcatcccattcctattcctgactaataccaaagcaaaacaaaaccctcaagagtgaatttccccatgattatatggggaactgagtacatgtacacagggaattatggaaagtcctgactagacatggtaagccatg

SEQ ID NO: 137590 - DNA, 682 bp, Homo sapiens
gcatctgtgaaaatgcctaggacaaggcctggctgagttgaggggagtttatccagacttcacacagctaccggcagtttcccagaagacatcctgtctgctagccctcacaagaagggtgtagacatgtgcaggctggccagggagaatggctctcactgtggctcgctttgggaatatgccgccccagcaaagcagctgtgcctctttgtggtcacaagacagagccaatggtggcagcatcagtgttgcccttcctaatgcaaagtgcaaactgcagaggtcctccctcctccacccacctgcccactcctcccggctgccatcagacagtccccactatccacacccatctcaaagctgccctggcctcccccacctctcacctgtggagttactaggaaccccattcagcctagtgataaagggccaaatggcttacactgccagcatggtagcagttgtccacaacctggacaattatggaccccaaattccccgggtaatttcggaggttttactttggccaggagtcacttatcctgaggaagtagcctctgatgccttgatatcaaagaccacgcagtggccacatacacacagctttttgcgtcctgcatccccttaggtcttatttataatttggtatcttatcaccagaaagaatccgttccatgagact

SEQ ID NO: 137591 - DNA, 154 bp, Homo sapiens
aatctggagagtcaatactcaggaactaaaacaaaacttcaaaataagagatagaagtgtagtaagagaaatataatgaaaaggctagatttattttttgagacaggatcttgctctgtcacccaggctggagtgcagtggcatgatcactgct

SEQ ID NO: 137592 - DNA, 471 bp, Homo sapiens
gacctgaagagtctccttaacccagtggtcctcagcagagggcaaccttgctttcccacaaagggacacttggcaatatctgcacacatttctggttgtcacaactgggaagtccttgtatcatcacaaggccaagagaccattcctactcccaagagaaaaaataaagtctaggagtagctgggtgctatggtctgaccgaatatttgtgtccccccaaaattcatatgttgaaatccaactccccgaggtggtagtattaagaggtgaggcgttttggaggagaggaggtcacgagggtagagcactcataaatcggaccaatactcttctaaaagaggctcaagagagacctcttgagtgaggcaagagtgagaagcaggctctcaccagacaccagatctgctggcaccttgatcttggaattcccagcctccagaacggtgagaaataaatttccattgtttacaa

SEQ ID NO: 137593 - DNA, 706 bp, Homo sapiens
ggcccagtggtgataggggcctgtgttcacaccagggccaaaacagatctggaaaaaacaaagtccaagcaactggattatccatcttgttgtgtggttctgtctgcactggcataagcacatttcacaaggcacttttgcagccaggcattggggctgcataaatggttttttaaaaatcctttcccaaaaggcaaagctgggttgctgggattcttgggaaatgtaatagaatgggaattcagaatgcggtttactgcagaatttacagcatggcaataaaggctctctatgttcagggggtgagagaagagactagatgcattgtctcagatgtctcctgacttcctgagaaatgccactttgcagatatggggctgcttttcacactggctaagtcagttcatggcaaaatatgagggaattcagtgtgtttcagacactaaccaaagtccatccttcctttctccttccgtccctcccttcctccctttctcactcactctctctttctttttaatgccatggagtaccatatttttcaaagttccaacaaagatgcactacatttagacaatgtggaaatggccctcagccttctctccctgaagtctgtggccagcaaaaatctggactttacttcactctgatgctgaacacccccctcccccacctcttccccaatatctcagatcccaagcctccc

SEQ ID NO: 137594 - DNA, 476 bp, Homo sapiens
cactggacagggtgaagagggaggagcaaggctgagcgtggcttaagttcctgctggggacgaggagattcctccggttttcaaaatattccttttccattgattctgctaggtccttggtccttaaatatcagaggcaggtagatgtttatatgtaagtgtacaatcctgacagtgtgcaataaattcttgtggatgtagaatgaaagaaaagtagaaaagaaggaggaagagagaaagcgaaggaggaaaaaaggggagaaaggaaaaaaggaaggaaaggagggagggaaagagggagagagggaaggagggagggaagaaggaagggagagagagaggaaaaatatttacaagtctacaaagagtaaaaattgcagaaaaataaaagcttgtctctgaaacaacaaaggttagctcatataaacttttagcttcctgcatttgaggagacaagcagaagtgaatgttttgat

SEQ ID NO: 137595 - DNA, 356 bp, Homo sapiens
ccactgtgcttggcctgttttttaaaattacagttactttgtagtagcatgggatagagaaacccctttaaggttttgtaaaaaataatttggtgataaactggtaaatatagtttgtttaatatgaaattgaaaattaagaaattatttggtaggtttttaaacaaaatattgttttacattttaaaaatgaaatcctggttactctttatctcctttgttcaaagaagttaaactatatcttttcaaagatgaaagaagatgtaattggttgctaacatcttatttctattatgtctatttcaacttatgtcttttccttgaattaaatttagccgtgaagttactttgacgcg

SEQ ID NO: 137596 - DNA, 292 bp, Homo sapiens
gcaaactgtaatattttgtttcacgtatatctgaagtaaattaaccagaaaaggttttctatttttttaactttggctttcaatacttaatgtatttatattaatatatatgtcttggatgtaatagtaatgacattttttccctcagaatgatagaattaaagaacaaaaaggaccttgagaatctagtctagtatcttattttacaaattaaataaaaataatctgaggccaccaaaagataaatggtgtgattttgctcaaactatgtagagtttgcttagtgtcagaa

SEQ ID NO: 137597 - DNA, 534 bp, Homo sapiens
ccgcccccagcgggatgtgaaggactccgggtgaggccggccacgccccgcacggatgggaaggccattgtgactatgtggtgattacagttgtcttactactgagtttcctactgaaatcatggaggagaaacagcagattatattggctaatcaagatggtggaacagtggcaggagcagcacctaccttctttgtcatcttaaagcagccaggaaatggcaaaactgatcaaggaattttggttactaatcaggatgcctgtgctttggctagtagtgtgtcatcaccagtaaaatctaaagggaagatttgccttccagctgattgtactgtgggtggaatcactgttaccctcgataacaatagtatgtggaatgagttctatcatcgaagcacagagatgattctgaccaagcaaggaagacgcatgtttccttactgtcgttattggataacaggtttagattcaaatttgaagtatattcttgtcatggatatatctcctgtggataaccatcgttataagtggaa

SEQ ID NO: 137598 - DNA, 363 bp, Homo sapiens
ccgcccccagcgggatgtgaaggactccgggtgaggccggccacgccccgcacggatgggaaggccattgtgactatgtggtgattacagttgtcttactactgagtttcctactgaaatcatggaggagaaacagcagattatattggctaatcaagatggtggaacagtggcaggagcagcacctaccttctttgtcatcttaaagcagccaggaaatggcaaaactgatcaaggaattttggttactaatcaggatgcctggacccgcggcgctcttagatcaccttcgagcttcctgacaacgcaagcagtgcttctacaggacatcgttcagggcaccagtccacctcgagttccagt

SEQ ID NO: 137599 - DNA, 278 bp, Homo sapiens
gccaaatgggaaggatatgtgtggagggagaggggctgttgctgtgtacctggagtggtgttttcatgtgataatgctcaatcatacgttcccatcatctgcctagaaccttgctgctgttccttctctaccaggcccctgtggtccaaggtagaccaggtgtctccacctggggttgtgtgaatttccttctactgaatgtctggcagctctcacatgcctgcaccccatacctcatgcttgttctccctagtgacagatgtttgaatttaacttat

SEQ ID NO: 137600 - DNA, 566 bp, Homo sapiens
cacagggatggggaattatgttggtttcattcttactggcaatcctattaaactgagttctgggagaacagaaactgagacacaatctttctgcaaaccctcatgcattagcagagtgcctggcagacactgtcagcacacagcagatgtttcttgaacctgtgtatgcgtgaatatcctctggcacccgtcagtggtcctgggaagcctctgggcagcactgtgctcgggaaaagcagcaacagagaatgtccaacaagatgctgcctagacccctgctgctcccagtgtgccccgtgaccagcctcagcattccctgggagcctgtgagaagtgtagacgctcaggccccaccccagactctattagcaagcagcccagtgatgtgtatgcatcagtatccaagaagcactttaagtttttggcctgcacagcagtgggaggcatcgaaggttttaaacactcagtagagactcacggaacacttcctacgagccaggcatgtgtagagccctgtaggtaccaccatgaggccgccaggatttcagctctgctgggaggcaggc

SEQ ID NO: 137601 - DNA, 711 bp, Homo sapiens
agggtggagtgcacagtccattacagcatttgcttacacaactatagagcacttgggaacaagataagcttcttacaatcattgcctataccaccctggctactcaggaggttgctgctactaaaactggcatttgagaaagccaccgcactaagactatttatgtccaaggaaacaatactgtctttagcactgaacacacctagaagaaaagccaaaagacgctacccaacatatactacagttacattctaaaaaaaagaaaaggcctgccccaataaaagtaaatgtaaaaatacgaagtggcaactatatctccagatgcacagaaatcagcaaaatagtacaggaagcattaaaaggcaaggaattatgacacccccaaatgagtacagtaattttctgttaatgaatccaaaccaaaaataaatcagagtgccaggtaaagcatttagaatattggttttaaagaagctcaatgagatccaagagagttctgaaaactaacacaatgaaatcagaaaatcaattcaggatataaacaagaaatttactgagaagataaacatcttaaaaaataacagaacttccggaaatgaaaaattcattgaagaaaatacagaataaatttgaaggcattaaaagtagactggactaagcagaagaatgaatctcagaacttgaacacaagtcttttgcattaagccagac

SEQ ID NO: 137602 - DNA, 441 bp, Homo sapiens
gcaaaagccgactttgctcggtgacccctcctggtgccacatccctcatgcctgcagcagaaggtggggggctccaggcccctgacaggtcatcctgatctcagagaagagtctgctgcccccaggacggggactgagctgagggcgaggaggatgccaggagaggcaccttggcccctgctgtggtattggccacaggttgggagctgcctttccccgaagccctagctttgcttctgtgagaagcagacacccagcagcataagcagcctgcctaggaggcttttcactaggaattaaaaacaccaaaaaggaacttcttatcagcaggtaccctaggggccacatggactggtaagtggtatcttccccatggtctcttaaggcctctgaagtcccagaccctcagatagttggcaactctgcctttccgcatatcaa

SEQ ID NO: 137603 - DNA, 305 bp, Homo sapiens
acaaaattacccaggcgtggtggcacatgcctgtaatcccagctacctgggaggctgaggcaggagaatcgcctgaacctgggaggcaaaggttgcagtgagccaagatagggccattgcactctagcctggatgacagagcaaaactccatctcaaaaaaataaaaaaaaaaaagaatgtgcaagtttatagcagaagggctggtggcctattgggatggaaaatttaaagacaagcagtaggaatcagttgggattatgacaggcagctttgggtttgaaaaaggaagttccagatgtcaaag

SEQ ID NO: 137604 - DNA, 350 bp, Homo sapiens
aggctcgtcttgaacttctggcctcaggcagtcctccggctcggctacaggcctgagctgcacacccagtcttgctggtgtttcataaggtccggcccctcccgtcggcctcaggtgtatgacttgtgaggcccagcgatgggctcggaagctcttggtcagtatcccccaaactctgttcccccttgtaggtgttcctcttttttctttgctgcagaagagtgtgtgactcacaaaaagttgaggactgttccttgatgtcctcccaggcttcgcccaccacctggctcctggtaatgcaaggaactgtgtttccatccattcccttcctttcactgcaactccagccc

SEQ ID NO: 137605 - DNA, 315 bp, Homo sapiens
aatttcaaacttcacctcaggaagttcttttctggttacagtatctgaagtaatctcccaatcactaccacaactccttaccttatttcccacacagcacttattctctgagattatttcttatatactgtctgtctctccatcccaagccagaagtgacactccaagaggatagaaatttaatgggttggacaggtgtggtggctcacgcctataatcccagcactctgggaggctgaggagggcggatcatgaggtcaagagatcaagaccaccctggccaacatgttgaaacccagtctctactaaaaatac

SEQ ID NO: 137606 - DNA, 329 bp, Homo sapiens
attgtttgtaggcctgttaatggacagagctgggaaatatgatacatttttattttatttaaggatgaaagacatcattaagttcatattttaattgcaaattcaacttaagaactctaggacttttatctaccctaatcgatcttaaatatgtatctcctttctgcgggttaaaaatcatagttctcaatgacatcaatgtaatacttacttcctttgtctcacactgcccagaacaatctcagaatatattaataaccaacactactattaatatggttcctgaaaacagtttgtttttcagttctttattttgccatatatataga

SEQ ID NO: 137607 - DNA, 404 bp, Homo sapiens
caacatctcttcaaaaaacactcaacaaactaggcatagatggaacatacctcaacatataaaagctatatgacaaacgcacagctaacatcgtaccaaatggggaaaaatcggaaaacctttcccccaagaactggcacaagccaagaatgcccactttcaccactcctattcaacacagtactggaagtgttagtgagagcaattaggaaagagaaagaaagaaaaaccatccaaacaggaaaacttgaagtcaaactgtccttctttgacaatgatatgatcttatatctagaaaaacctataggctccaccaaaaatctcttagatctaataaacaaattcagtcgagttgaatacaaaatcaacatataaaaaatcagtagggtttccgtaccccaata

SEQ ID NO: 137608 - DNA, 526 bp, Homo sapiens
caaataaggagttttggcagagatgcagaaaatattaaaaagaacctaaaactaatgaaaaaaaattaactggataggattaacatgagagttgacaattgaataaggagtcaattatatgaagttagatcactaacaattatctaatccaaagaggagatagaaaaaagactgaggtaggggaaacagtctcagggacatgtaagataatatcaaacactaatatatgtgtgattagaatcccaaaagagaaaagaatgaattagggcagaaaaaatactagccaaaaacttcccaaatttgatggaaaacatcaatttataaattcaaaaagctcagcaaactccaaacaggttaaataaaaggatgaggcttatgagggctaatgagcctaagttttaaaaaagaagtttctccataaataaaaggcattataaagctttcatatatttggtatatagtttaaatatttgaagctttaaccagtggcgcgatcttggctcactgcaacctccgcctccaggtt

SEQ ID NO: 137609 - DNA, 662 bp, Homo sapiens
ctcttaatagagacctgatcttctgtaacctcaaaactccacctacccaacccttgctgtccctaccctgctgtatctaacatccaattattccatatcttctctcctactttaggaaaaaatttctaccatgacatcactttgttaatggcagcatctttctttctctatgtccgacaccatctcagataaatccctgcctattggttttaccttgggcttttgtatctaaagcatctcttcaccaactgttaggctatgctgctttcccttcttttatgttacaagcgtgaactcatttcttcaacataaaactaacataattttagattgtgaaatttttcattttcaaataaaatttgtgaccactttattgcagcattgatgttatgcttcttgaatgcattaattggcaagtgttagtgttttatttcggtaactatctagaaggcagtttgaaaactagaaaaaaaatattcaaatgtatcttaattagatacataatggctaagagagtatattgtcattcttttcctttctttcactttcactttatctagattaggacctattctaacttaattattcctttaatttcattctgagaacatagctatcctaggtaatatattttggaattattactaatgagaggaaaatag

SEQ ID NO: 137610 - DNA, 288 bp, Homo sapiens
tggctataaagggtggcatgagaatccttggggtgatggacccttctgtgtctggactatgtgatagtcacatgaatctaaacaagtatcttagtccatcttggctgttacaacaaaaaaaccagagctgtgtggcttcgaagcaacagaaatttgtttctcacagttctgcaggctgggaagtccaagatcaacgctctggcagactctgtgcctagtgagagcctacattctcacagttggattcttcttgctgtatcctcctcacacagtggaaggatgagctag

SEQ ID NO: 137611 - DNA, 319 bp, Homo sapiens
agaaactgaggcaaggcaagtgttgtttctagcctcaaggagtttatgatccagagccagaggaacaacaagtaactggggtgagctggagtgcatgggaggccagggcaggtcaaaggagttcaaagagactcgtatggtgattttaggggacaaaaccaaggctttggggacagacctaaggctttggagccagaggggatggctcaattcccaacattctcactgactcactgagcgatgttggatgagttacctcatgtctacaacccgtctccttagctataaaatgggttaacaatacctagctcggagtgtt

SEQ ID NO: 137612 - DNA, 412 bp, Homo sapiens
gaggtggtatgaagtgtatatcaatggtgtgggcgcggttgtcgttggtgggtgtgttttaatagagaagggtctgtttctcccaggccagagtgcagtggcacgaacatggctcactgcagccttgacctcccgcctaaggattctcccgcctcagcctcctgagtagctgggactataggcacgtgccaccatgcccggctaatttttgtatttttagtagagatggggtttccccatgttggccaggatgatcttgatctcttgacctcgtaatccacccacctcccaaaagtgctaggattacaggcatgagccaccatgcctggccctccaaaataactttttcttactccctttttgtttttattctttcctctgccacttctgcttcgcacttctgtgaaatgcc

SEQ ID NO: 137613 - DNA, 208 bp, Homo sapiens
accatgttgactgcatcacttgaactcctgagttcaagtgatccaccctcctcagcctcccaaagtgcttgggattacaggcgtgagtcaccacacccgcctgctcaacttttttaaattgtattttttaatagctttattaaatgtagttcacttatcatgtaatttacccctttcacaagtctgcaattaagtgattgttcccagt

SEQ ID NO: 137614 - DNA, 310 bp, Homo sapiens
caggtatggcgcttggctgtgctgtgtactgtgtggggcttggcaggtcaactgctcagatccttgtttttcttgcctgtgtggtgggataatatccataatgaccttttaaggctgttgtaggagtttgaaaaataataatgatgtaaaatacctattctggagaccggtacacagggcctgccctttaaatatttgccagattttgaataaatgattttattgtttactgaacatttcctgttattccatgttctgtgttgaatggctgcttttgtgactgctcaatgccaggccccgagtcttcttg

SEQ ID NO: 137615 - DNA, 715 bp, Homo sapiens
ctgatcttcaaataatttaatcacttgccagaacaaagcctcacattctttaataaaggcagcaaaatccaaacactcagtataacattcacagtgtttagcatccaataaaaaagactaatcgccagtataagaagcaggaaaatttgactcataaccaggagaaaaatcagtcggaagcagactaaacagatgatagaattagcagacaaggatattaaacagctatttcaagtacagtcatgtattgaaaggaaaatatgaacataagaagataaatcaaaggtataaaaaataaaccaaatgaaacttttagagctaaaaaaatatatctggtgtgaaaaattcactgtatagaattaacagcacattagacactgcaggtaaaacagtcagtgaacctgaatatgtaacagcagaaaatattcttactaaagccacagacaaaaaagattgaaaaaaatggaggaagccttggtaacctatggaacaatatcaagagtattctgtcaagcatttagggaagaaacaatgctgagtacacagactttcagaaatagagaatgaaatgtttttctactgctttaatgaggctagtataaccctgatgccaaaattttacgaagtcattatgagagggaaaaaaccctacagaccagttattcctcatgaacacagatataaaactccttaaaatataatcagattttattat

SEQ ID NO: 137616 - DNA, 207 bp, Homo sapiens
aacacagcagggaggagcgaagcttatttctcattaaacagcatttattgtattgcctgacatttttaaaaattatattcaatcatttttttaattaacctttttattttaagatgatcgagcaaattcatcgagacagattttacctgtaggtgtaagaaacaatgcccttgctgggagcggtggctcatgcctgtaatcccagca

SEQ ID NO: 137617 - DNA, 171 bp, Homo sapiens
caacactagggttaagtaagctgctggacacatgtgcccgagccttgactggcacatctggatgggagtggaatgagtgatacagaggtttggttcctactggggaagcccaagttttagaagctagctgactttggagctgcggcctgactgtctacttattatttctct

SEQ ID NO: 137618 - DNA, 408 bp, Homo sapiens
acttctagggaaaaacagaattctccctccaccatatgacggtctttgagcatctcaatgatttcctttggttaaatacattgcggtgcattttattgtcattattttgaatatgcaaagtcctctcttccccctgtccctgctccccagttagcatgtgtgtatttagacacagaaaactggccccactgttaaggatgaaataaaaagaagaagacagcagagaaacttcagctttgcaattcgagcctggccactgcatggttccaaccagtccccatggccctacgctgcatcaggccacttcatctgctgacagctggggaagctccaggtagcagatctccgtgcttcctcccactcccaccgcctctctgcccaatcccgtctgtgggagcagagccacac

SEQ ID NO: 137619 - DNA, 429 bp, Homo sapiens
cttgggccataagtttgtgcaactctgggaaaatgaagatgacaaaaggatttgttgggaatgattgtaatatgaactttgtacaatttgcttacttgtacttaaaaagtattaagcgaaggcggtgggttctaatatcaagctccatttcctcattgccgaagcccaggtgacaatccttagccaatgttcttaaggaacagctctgtttctatctgaatccccatccactgatcccttagctgaggcatggtcagcgggagaacaagcttcttgttttggggcctgcagtactaagtctcagtctttgcccataaactcactcgaaatagtcttctgttcagaatctttctacaaaacattttgcagtcgtccaaaatattctgcaaaatgcttgctgcctgccagtaaataagtggaatgaaaaag

SEQ ID NO: 137620 - DNA, 517 bp, Homo sapiens
tgaacaatacttgaatcaggaggtggaggttgcagtgagcgagatcacgccattgcactccagcctgggtgacagagcaagactctgtctcaaaaacaaaacaaaacaaacaaaaaaaggccgggcacagtggctcaagcctgtaatcccaccactttgggaggactacctgtgagcgaccgcgcctggcctgttcttcccagtgttaaatgacagctagatttgcactctcctctctccagtagtttgaaactttttttttttttttggaaacgcgtctcactctgtcaccaggctggagtgcagtagcgtcatcttggctcactgcaacctctgcctcccaggttcaagtgattctcctgcctcagcctcccgagtagctgggactacaggcgcccaccaccacgtccagctaattttttttgtatttttagtagagacagggtttcaccatcttagccaggatggtctcgatctcctgacctcgtgatccacccgcctcagcctcccaaagtgc

SEQ ID NO: 137621 - DNA, 228 bp, Homo sapiens
ggtttggggactggctcgggaatgggctcaggcagctccacggggtttgcctggcaggttcaggctcaggacagccctgagctcctccacagggaagtcaatgggtcccggttagggccacaccatccccaggctgtctcctggtggcccccagcagcagcaccgtctccctggcagcgggcttctttgtgcgaagcccggagaatgtgaggctgcagtcggatgtgg

SEQ ID NO: 137622 - DNA, 319 bp, Homo sapiens
aatgaaagcaactagaacagagcatttagcgaggttaaaacagacaactaactgtgtgaatcggaaaacgtggcttcgttttcaacaatgtttcgtgggacgcttatctaatacctaatggctatttatcgggatttagagaggttaaaacagacaactgtgtgaatcgaaaactcggcttcgttttcaacaatgttttatgggatgcttatctaatacctaatgggtatttatcgggaaaacacttctttactgcagtgttgtgacattttttgttgtttctgctaaatctacattgaagtgttgctttgtaagtgtg

SEQ ID NO: 137623 - DNA, 231 bp, Homo sapiens
cagagaagggcttggtactgtttagaataaagtataagtagctgttcttggcagtaggaaccttgaagggaagttacattgcaatattattttgataacaattaaggaaaatattaaatgagtataccacttttaaaaatacatttttatctagattggttattataaagttttggtgcttaagactctaaattttcacctttgtgaagctccagtttatccagaataact

SEQ ID NO: 137624 - DNA, 139 bp, Homo sapiens
aacctaagctccaagttgtatgacgacctgacattgtctagagggctcagagctggtagtaaaggaaactgcactctcatcccagctgagccactcagagcttgtgtctgggacatatacgctcttaagcttattttct

SEQ ID NO: 137625 - DNA, 544 bp, Homo sapiens
actatatctggctaattcacacactccacggtcattctttctggatgtctacttggctccatcaaatagcattctaatctttccatgacaaactagttagttcttttgaggtgtagctctacacacaattaagcactgaaataatgcttctgttgccaatagagcatctctatgtctttattaacaagtagatacattgtgtttttatttaaaaataagcacattcactttgagaaaattgcagttcattagaataacgccttaaaacacacagacacggccgggcacggtggctcacgcctgtaatctcagcactttgggaggccgaggcgggcagatcacgaggtcagcagatcaagaccatcctgtctaacacgaaaaaattagccgggcgtggtggtgagtgcctgtagtcccagctactcaggaggctgaggcaggaaaatggcctgaacccgggaggcagagcttgcagtgagccaagatcgcgccactgcactccagcctgggtgacagagtgagactccatctcaaaaaacaaaaa

SEQ ID NO: 137626 - DNA, 866 bp, Homo sapiens
cacgggggagcccgagaaacaacgggaagagggcgaagtgaagcagccacaggaagaggactggacgcccccagacccgggcctcctgagctacactgacaagctgtgttcccagaaagacttcgtcaccaaggtggaggccgtcattcatccccaattcctggaagaattgctttccccagatccacagatggatttcttggccctaagccaggagctggagcaggaggaaggactcacccttgcccagctagtggagaagcgcctcctacccttgaaggagaaacagcatgcgagggcagcccctagtcgtggcacagcccggttggactcaagttcttctaagtttgcagctggccaaggagcagagagagacgtccctgtcccccaacaaggggttggcatggaaacctgcccaccccagacgactgcccgggactctcagggacgaggcagagcacacactgcctcgggccttctcagcccagaaaagtggggaccccagggaactcatcagttcccatctgctgagagaagaggcctcaacctagcaccttctcctgccaacaaggccaagaagcgacctctctttggaagcctgtcccctgctgaaaagacaccccacccagggcctgggctcagggtctctggggagcaatccctgacttgggggctgggtggcccctcacagtctcaaaagagaaagggtgaccccttggtctccaggaaggagaagaagcagcgttgtagccagtaggggcttctgagcaggctctctggggccgatccccaaggatggggctctggcatccgatgccccaaagcggtcaaaagcttcttctcccccagtgctgatcttgctgggc

SEQ ID NO: 137627 - DNA, 392 bp, Homo sapiens
gcgagactccgtctcaaaaaaaaaaccgaaaaacaaaaaaaacctactccttctttcctcaaaaatatgacttgtttaatataaactacattagcacgacttgacaagttttctttttattcaatccctttagtcctctaaacaacctatagattcaaatgtctagaaacacccagagtaggcccttcatcatgatgtaaaaattcctctctgtaggatgattatttgttagaattcatggattacaataaagttatagactttaaagaacttgtctagtgagatgagtaactgagttaccttgaatagaagttagtctaaataattttttactcatgtaacaaaaggtaaatttcaaataaaacgatcatgctatacagaccagtgatttt

SEQ ID NO: 137628 - DNA, 257 bp, Homo sapiens
gattctctgctgctgcctcagttgctaggggaagagactgggccttaggtgggtgacttgaccaggtcaccggctttgtgggtagagctgctcatagtagaacccaggagacttatctcccaggccagtgttatttctcccgtatcctagttttcttaatagaagattattaggtgcagcaataaccaagttcagttagataatttagaaacaaaaccatattttatacacattcatttcatttctgagagctcaca

SEQ ID NO: 137629 - DNA, 203 bp, Homo sapiens
agaagtaaaaagataaggaaaccaaatatctgggcaattatttggctagggttacaaagcctagatttgaacccagtttgatctgattcttaagttattgtttttccattacatctagttactagcatttatattaaacatttccttttaaaatatttctttttttgcaaataatcctcctatggatgatactaattgtaatt

SEQ ID NO: 137630 - DNA, 410 bp, Homo sapiens
tttttccctatgcagaaatatttggttatttttgttgtccagtttattaatcttttccttatggttttggactgatagcatttggagacatagttagaaagtccttcccacttgattataaagaatctgcccatgtattctaatacttttatgcattttatgtttaaatctttaatccatttggagtttacttgtatgtagaaacttaattaaattactacagtatcattccatttactccaccccccgatgtgtgctgttgttttgatgctttcttctccttgtgttctgaaccccacaaggtatctttagtattacgactttagagagtgggtaggctttcgtatttactgaaataattgccctttactgtgctttttcttcccttttgcaatatcatgcttcatcta

SEQ ID NO: 137631 - DNA, 399 bp, Homo sapiens
cctcagcctcccaagtagctgggattacaggtgcgtgccactacgccagactaatttttatatttttagtagagacgtggtttctccatgatggccaggctggtctcgaactccttacctcaagtgatccacccaccttggcctcccgaagtgctgggattataggcgtgagccaccgcacccagccctccttagtctactcttaaatgctgggggtttcctctggctctatccttggttattttctgttcttgccacacacacacatacacacactccatgtatgatctcatcccatggcttgtatgaccagccacaccgtgctaatgattaggcagtctctttctctggctttatcctcttccctgagctccagttcttaatctctgcttaaatatt

SEQ ID NO: 137632 - DNA, 358 bp, Homo sapiens
ccctaggaagtttttgaagtttccagggttggcagccacactcatatggcccggctggagggtacagtggcaatccaacgcccagacagggtcctggacgttggactcctagaccaaagcggagaggaagtgatgggtcaaggcgacaacagggagccttaggagaatgtgtgctccaacccctcatctcataggtggagaaactgaggcccaggtagaggaagtgacttgctaaaggtcactcagctaatcttggtggagccagcactaggattcctgacaagagaccccttccaccataggctgctgacatgcccggctcagggcaacatcacccacccagacaggtacctcccac

SEQ ID NO: 137633 - DNA, 1009 bp, Homo sapiens
cagaagagaggtgtgagttctgtgtctcaagccaaaaggagaaaaaaaattttttttctttgaaacagcgttttgctcttgttgcccaggctggagtgcaatggtacaatcccggctcaccacaacctctgcctcccaggttcaagcaattcccctgactcagcctccctagtagctgagattacaggcatgcaccaccacgcccagctaattttgtatttttagtagagatggggtttctccatgttggtcaggctggtcttgaactcccgacctcaggtgatccgcccatctcggcctcccaaagggctgggattgcaggtgtgagccaccgcgcccagcccaaaaggagaaaaatttaaatttaatagtaaacaagttttctacccatttcttaggcttaagtcatctgggtcactgggtcatttcctctaaagatctgcttctttcatttcagaacccacaaattttgtaaacacctataaattgtcattcattcttcaattttgtatcacctagtttgggtcaactacagttccaatctaccatatcctttctggcttcacttctttccttatccaccttggacttcatggacaatgatctcaagacacttttaccacaccctcagttacctttgtcttttgttctttggtcccaaccacctcacccctccccagttctagatcaatgtaaactttatgtttatttgctcattcaagaaatatttattgagggcctgttgatatgccaacagttgttctaggtattgaggacacagatgtgttttctctccttctgagtgttggcatctgttttataggagagcattagttaatcatgagccggaactggtaccagtatgtggtttccagccttaacttggcagtcctcatggggagccaaatgccttgtcaatttctcacagctgctctccttaagcacctctttctagtcccagcctttgccttttgtagaccaccttacagtcggcctcaaaaggataata

SEQ ID NO: 137634 - DNA, 1027 bp, Homo sapiens
cagaagagaggtgtgagttctgtgtctcaagccaaaaggagaaaaaaaattttttttctttgaaacagcgttttgctcttgttgcccaggctggagtgcaatggtacaatcccggctcaccacaacctctgcctcccaggttcaagcaattcccctgactcagcctccctagtagctgagattacaggcatgcaccaccacgcccagctaattttgtatttttagtagagatggggtttctccatgttggtcaggctggtcttgaactcccgacctcaggtgatccgcccatctcggcctcccaaagggctgggattgcaggtgtgagccaccgcgcccagcccaaaaggagaaaaatttaaatttaatagtaaacaagttttctacccatttcttaggcttaagtcatctgggtcactgggtcatttcctctaaagatctgcttctttcatttcagaacccacaaattttgtaaacacctataaattgtcattcattcttcaattttgtatcacctagtttgggtcaactacagttccaatctaccatatcctttctggcttcacttctttccttatccaccttggacttcatggacaatgatctcaagacacttttaccacaccctcagttacctttgtcttttgttctttggtcccaaccacctcacccctccccagttctagatcaatgtaaactttatgtttatttgctcattcaagaaatatttattgagggcctgttgatatgccaacagttgttctaggtattgaggacacagatgtgttttctctccttctgagtgttggcatctgttttataggagagcattagttaatcatgagccggaactggtaccagtatgtggtttccagccttaacttggcagtcctcatttatacacaaattctatgtcatattccctcatatactatccttaatcacctttttttattgcgcaccctttgcctttagaaccccacctaacattcgtcatcaaaaggaaaaaatcccagtccaagctcca

SEQ ID NO: 137635 - DNA, 195 bp, Homo sapiens
tgcttcactccaaatctgcatgggagaggaggctaaagaattaagcccagatctcagaaacgctgagtggaatttttcagtctcgttactcagcaaacaaatatgtactagggacagtacacacatactaaaaataagagaggagagctaaaatacccccctccccccatgatggtaaactgacatggatacaaa

SEQ ID NO: 137636 - DNA, 156 bp, Homo sapiens
gtgaaactctgtctcaaaacaaaaataataaaaaaaaactcttcagacatcttttctgcaaggccccgctccccaaactctcatagacagagctagctgctccccattgtgggtcccctactccactgtcagagtcattgaaaggcctgtccctcc

SEQ ID NO: 137637 - DNA, 340 bp, Homo sapiens
ctgtttatgcctgcacaggcctgggcagtgagcagctgtctcctgccccgaaggagctaaggccagggttacagagataactgtgctgtagccctggcagggagcagtcaagaagtcacatcacccaaagagatgcccactgcttgtgcatcaagagcctttaaaacgttcattccagttcatgaacaggtaaagctaattgatagattgatggtgacagaagtcaaaaaagtgattacgttgccaggggaaatggggtgggtattgctaagaagacacatgatgaataagaagacacatgaggaataagaagagacatgaggagccttctgagtaatgt

SEQ ID NO: 137638 - DNA, 449 bp, Homo sapiens
tctgtgaaaccttccatttacttggccactttcccacggacattcaattaaaaacaactgtgggaaaagcgaatctagccattagacactgcagaagctggctgggcaataaaatctgcctctctcctaacagcccagagaagccttttagcatttacattcaacagaagccaaaagccaggagccccaagagggggcccacatcatcgttccaatccaatccgagttcaataaatgtctctgataggacaccaaaacacaggcagcaaaagaaaaaaatagccaaacaggataccagcaaaataaaaatcttctgagcttcaaaagacaccatccagaaaggcaacctacagaatggaaaagaatatttgcaaaccatatatctgatcaaggagctgtatctagaatataaagggccagacaactcaaacaataaaaaggcaaataat

SEQ ID NO: 137639 - DNA, 451 bp, Homo sapiens
gtacattgtcatctttgctcagaaaccttcaagaggaagccattaattcccttcagtgtagagtctgaacttttaatcttgctttcaggattcagtgtaatccgttttcctttttaattttagttctcaccatcctatgtaatcctctatcacagttaactctacattttgaaaaagcagccaagacattatactgcagtatattaaatttgggactcaaggaagaaacatgctttacttactcaaccagcttacaatagaaagtgactacaggagagaatatggtttattatgataatcattatggaatttatgcaaaagcaaggaaagagctgaccaataaactaaaaaaatccttttcattaattcattgaatagctatttagcacatatgtatcaggtggttgacattaatccactgtgtatttccgagcactcaagatatttagtt

SEQ ID NO: 137640 - DNA, 256 bp, Homo sapiens
cagagccaggagttgaattcagaaaaatacaagagtctctcagtatattggcctcaattattgtttgtgggttcctagttgatctagaatcagttacttcagagttcaggtgcctttgtgaataagacgaaaaccttggaccctctcctcagaaataatggccctgcatccctcctggatgtcatttgaaaatgagctttgcttgtggcctgctgggtaaatgccactctttgtctgcagtacaacctgccggtgg

SEQ ID NO: 137641 - DNA, 458 bp, Homo sapiens
ctcgagaggtgccgatcttgatctgataacatgaccagctctctgtcctaggttggtctctacctttttggttaatttaataggagactaaaaaaccaatggaagaaagtaacctgctattaagtcaaccaaagagtaggacctgccttccggctcgaaaagcctgggtctggcccatcccaccctatggtgagctgccgtgtgaaccaatgctctgtctgaaggcggcacatcccggtcaggagccagtaagggaagcaaacacggatgggcactgctctgcagaaagcaccaggattcatgtgtgtgtctgtatccgcaatctacacaattatcgcgcctcctacaaacttcaattttaaaggcaaaacagtgctgttttcataatgcggatcaaacgggccgtggagccatcgtgagaaacagctggccctgagatggcagaggcaatactcact

SEQ ID NO: 137642 - DNA, 420 bp, Homo sapiens
ctcccccatctctgaagtgcacgggccaaatctccttaacaaaacagaaatcctcagggcaaaaggattcccaggaccccataaaaatggccattatggatggcattgtcaccaaggaatgacagctccttgtaacatactgtattctaagagatctgacctagattctcctgctggactgtgctttaaagatcctgaatacccaatttaaaagtaaaccaatcaaccaggcagaagagactgatgtgcctccccaggcaggcaagaagcaccttcagaacctccaacacggcagctcagcctgcgactcataagcaaagtcaccagcatcaaagggtccagatgattaacggaagacaagcgggagccacattttggaggctgggggtgggagctgttgacacagctgtgccagctcac

SEQ ID NO: 137643 - DNA, 263 bp, Homo sapiens
ccacagtggtgctaatcatctctttgtgagcagttgtctcttgagtaaattatgtatagcagtaaaaagtgatctcttgcagttctccagttttgttattttttgtttttggacaatggatttaggctcttgtcgccgcgggaaaacactgcgggggcacgatcttggctcactgcaacctccacctcccaggtccaagcgattctcctgcctcagcctcccgagtagctgggattacaggcatgagccaccatgcccggcta

SEQ ID NO: 137644 - DNA, 596 bp, Homo sapiens
agtgctgggattacaggcatgagctaccactccactcaaatccaggtggctttactctctcaccgtggtgaatacttcatcgtgtgtgagatttcatttattttaaacaggagtttcatggagaattacatgttttaaaaccatagacctaggagtttgtataccttttattttaggtagaaaggattgctgtcttcctattaatactttccgtttgaaacagaagggtgaaatgaatgagaattttggtgaagagaaggcagagtggagaacaggatacagcaggctagagaattgagttgtgcatggcacgtctgttttctgagcctattcttttcactcccaccgcctataaccttcccccagatgaaattccctttatcctcctccagttacaccatttaatttgaataaaatacctgtgttcaacttaaaagtatttttcaagcgcagttgacttttcacctttgcaggggtctaggttttgttattactgagttaccgtcaagacccctcacagctgcctcatcgtgctctgtggctgggagtgtataccacactgggttcacatcaccattcagaaattaaccacacag

SEQ ID NO: 137645 - DNA, 521 bp, Homo sapiens
agggaaccagtttggcagcctgagtgcgaggtgacaaagcccttaaggaaggcagagggtgaaaagttgggacaggaggtcagaggcagaaccagcagggcttggtgccccggtaaacacgggcacggatggaggaggccaggatgacgaagatgtctggtttgggccaccgaggtgggacctggaagaaggaagggagaaggggacagaggtgggaaaaagaacagctctcccagcagacatggtcagtctgaaatgccacccaggaccctctgctcagaagtcctgaaggctgttgagacgtgcgtggagtcagggccatcatcaaggctggggacacctatttctttatttttgaggcggagtgtcactctgttgcccagtctggagtgcagtggcaccatctcagctcactgcagcctctgcctcctgggctcaagtgatcctcctgtcccagcctcccaagtagctgggattacaggcgtgcaccaccatgcctggctaatttttgtatttttagt

SEQ ID NO: 137646 - DNA, 478 bp, Homo sapiens
tcgttctaccgatgcttagttagttgggacaggaggtcagaggcagaaccagcagggcttggtgccccggtaaacacgggcacggatggaggaggccaggatgacgaagatgtctggtttgggccaccgaggtgggacctggaagaaggaagggagaaggggacagaggtgggaaaaagaacagctctcccagcagacatggtcagtctgaaatgccacccaggaccctctgctcagaagtcctgaaggctgttgagacgtgcgtggagtcagggccatcatcaaggctggggacacctatttctttatttttgaggcggagtgtcactctgttgcccagtctggagtgcagtggcaccatctcagctcactgcagcctctgcctcctgggctcaagtgatcctcctgtcccagcctcccaagtagctgggattacaggcgtgcaccaccatgcctggctaatttttgtatttttagt

SEQ ID NO: 137647 - DNA, 314 bp, Homo sapiens
gatatatgggagcatgcacacactcaaacatgtgtgcacacaccttctgtaggctgaaattccaacatctgtgtcttagccacttaaaaccatctctagacacctaactccacatacataccactgtgtgaatgagcagctaggagtggctgttttcagactactcctaagttcactatccttgtaacttggctgtaatcaccagaaacctcatgttggtaacctctatagctgatcagatgttccctgatatacagtaaattttggccataaataaaagacagttttacattacccaatttaggcacctgtgt

SEQ ID NO: 137648 - DNA, 194 bp, Homo sapiens
aaagtaggtagcaaagtgatgaatagacaagtcacagaaaaataaatgcagatgatccttaaacacagcttcacacttaagagaaatacaaacgaaaactgtgctgtgatttctcttctgttgggagaagatccaaaaacttgacaatacattctttggtgtggctgcgaagagttgcattcgtgtattgctgg

SEQ ID NO: 137649 - DNA, 469 bp, Homo sapiens
gttatttttatatttgtattttttagcagagaacagggtttgtatttctagcagagaacagggtttcaccatgttggccaggctcgtctccaacttctgacctcaagtgatttgcctgctttggcctcccaaagcgctgggattacaaatgtgagctgccatgcctggcaggaaccaccgtttgtttgttattttcctcaaacaattggtatttgaaatactactgaagtagtatcatttgggaatcttttgaaacattttgatcttacaagggaccctagtactttgaagattgtgaaccactgtctgtactcttaagggtagagaattcctaattccttagctttgtagagatgtgtatcactatctgtgaatgctgttatttccaacacgctttgtaattcgacaatgtttgttttctgacatatgttgtatgtgatatttcagtctaaagaaatgtagtttgaaa

SEQ ID NO: 137650 - DNA, 357 bp, Homo sapiens
aaatcctgtgtctggtgaaggccaattgtttgattcatagatggcacctcctcatcatgtcctcacatggtggaagcggtgaggggtctcgcttcagccactttataaggacactaatctcattcatgagtgctctgccctcatgacctaactacctctcaaagattccaccttctaatagtatcaccttgggggttaggtttcaacataagaattctggggaaacacaaacatttggaccatgccaatactcaaatagcaaaatgtccagtcttaactgtatttctgcaaatcttagctggtcgtggcccgggggctccccttagctccattccagatgcactgtcctggttacca

SEQ ID NO: 137651 - DNA, 451 bp, Homo sapiens
taggataagtgcattctatgagctttggagaaataagtaccagtaacagagaaatttggggttaatgtctctgcacacagagtagaatgaaaataggattgtcccaatatatacttcagtgaattgtaaataaagtgttggtgttgttcatgtttgtttgtttttaaatttttgttttttctctctgtgctcttgtcagaagtcatccctttttggtatgattaagttggaatccttttcagagttaaacattttcttggtccatgtttttaactttataattttttttttggactaagaatacatgtactgcaaaccttcctttatgttactgtcatctttttatttaatcatactatttatatgctactaaagaatgctgggtattggtaccaggaaaaagtaaaattgcctatgtatatttagtaaaatatttaaagtacatattttg

SEQ ID NO: 137652 - DNA, 946 bp, Homo sapiens
ttacgagccagtgcgagcggcgggcaccttacgagtcagtgtgagtggcgtgtacgttaagagtccctgtgagtgccgtgcacgttaagagtccgtgtgagtggcgtgtacgttacgagtctgtgtgagtggcgtgtacgttacgagtctgtgagtggcgtgtacgttacgagtctgtgagtggcgtgcacgttaagagtccgtgtgagtggcgtgcacgttacgagtccctgtgagtggcgtgcacgttacgagtccgtgtgagtggcgtgcacgttacgagtccgtgtgagtggcgtgcacgttacgagtctgtgactggcgtgcacgttacgagtctgtgactggcgtgcatgttacgagtctgtgagtggcgtgcacgttacgagtccgtgtgagtggcgtgcacgttacgagtctgtgagtggcgtgcacgttacgagtctgtgagtggcgtgcacgttacgagtctgtgagtggtgtgcacgttacgagtgcatgtgagtggcgtgtacgttaagagtccgtgtgagttgctgctgaggcaggaatgtgggtgggatgacagcgagatatctatgtctagttacgttttctttaacggcagcctatttagctcgttaacatcagatgaaaatcagaactgaaaggccgtgggggtgagatgggatgacaaacaccaaccaatgcccagaatctgttcctcggatccttccgttcctccctcctcccggctcccccaaaacactcccctgcttagagagttaaggaaaggagccgggcacggtggctcacacctgtaatcctggcactttggaagcctgaggcaggtggatcccctgaggtcaggaggtggagaccagcctgaccaacatggtgaaaccccgtctctactaaaaatacaaaattagctgggcgtggtagcgcacccctgtactcccagcta

SEQ ID NO: 137653 - DNA, 455 bp, Homo sapiens
tgaaaatggtcctgatgatgctggatgcagaatgcagattccttcgtttgaaagtttttcagtaaagatttgaattcaggtccaccgggttctttgtgctcacaggcaggtataggtatatatcaattcatgtggtggagaaaagctcgtttatctaaaacaaacaagaaattatatctatttggatttgggaggtattgcactttcacagttgttttatttcctgattgtttatttcagacaaataccaatcatgaatgttctgatcctctgcaggactctttggggaatgcaaataatagccagtttagcagttaccatcgatggtgaaacatacttaacactcgtgttttcgtgtgattcctgcaggtcattgaatgtaccctaatgtggggtaggtttttggattctgttttacagatgaattaactgcaacttggagcaattcaccaact

SEQ ID NO: 137654 - DNA, 434 bp, Homo sapiens
tacctctagatctaacacaattttgcaaggtaggtaactatgggcccattttagagatgagaaaactgagactcagaactgtcccagctcacccaaagcaatagacatcagagatggggtttccatgcgggtctgtgtgtctgaagttggtgtacctgctaccattcttgtctctcctcatctttaagatggaacaatgacccttactctcctagctaccatgtaaggctgttgtgagagttggataagatgctggatgcaaaagcactttgcagactgcaaagtcctgtacagatgcaaggcttgtaggcagtccctggcatccagccagatactgtacccagctgccacataagtgagcaatatggtatttaattgggtctcattgagacatggagcctgggaaggtctttgcagagtctgggtaaaaggaa

SEQ ID NO: 137655 - DNA, 802 bp, Homo sapiens
gtatttgtattttggaagtttaagacacattttcctattgggtttttggagtaaaggagtaaagtaagatgatctacattgttgctgtatacaggcctttccagttgtaagaaatgtttggaggcttagatgagataaaaagaatatatttgaaaaaatgcatttatttttcctcatgaaagctggtagtgctgaaactgcaaacctaggactaggaaggctgttgaaattagggaaaacatcagtgacatggcatgtcagtgtgtgtattaaagtgcttcagaaaaacagaaccaataagatgtagatatcttcagaaacagagtgagtgagtgagtgagagatttactataaaaaactggcttacttgattgtggagtctgagaaacccagactagggagagctcgtggtatagttccagctggagtctgaaggtctgagaaccaagagagccaatagtgtaagttccagtcttgtacaagtctgaaggcgggagaaaccagtgtcctagtttgaagacaagtagagagaaagaattccttcttactcagtctttaattctattcaggccttcaatgggttgctcaacgcccatccacattggagagaccaatctgctttactcagtctactgattcaaaagttaatctcatctagaaatatccttggagacatacccagtaacaatgtttaatcaagtttctgggcaccccatggcccagtcaagttgatacataaaattaactttctctgtgtgtgtgtgtgtgtgagagagagagagagagagagagagacagagag

SEQ ID NO: 137656 - DNA, 260 bp, Homo sapiens
aaagctaaagaaacatgtgttacaatgtagatagggaatactttcttaatgaaccatgctgaactgtaagatttttaagactcctttttaatgcattacattacactgtatcttgttttcacatttatggtgaggttaatataaaagagacattaaacaaatatatttctgctctttacaaaggatgattattgttttcttacatttcaactaaaaatttctataatattatacttgcaagaagtataacactcttaatg

SEQ ID NO: 137657 - DNA, 184 bp, Homo sapiens
cgtagatctaaaatgttttgcattttgagtctaatgtcaagagaagttgcaccaattgtttttcaacaaagaattgatttttgttttggtttctaagcagtctagcttagaaatagaaaccagtctagcgttaaattatttccatcatattttatttagggatcattttaatgaacttaaaata

SEQ ID NO: 137658 - DNA, 172 bp, Homo sapiens
cgaactcctggcctcaagtgatctggctgcttcagtctcccaaagtgctggaattataggtgtgagctgctgcgtcctgcctctcttccacttttaaagatgtgttcactttgagccaacccagataatccaaattaatttacctattttaaggacaaatgattaccaactt

SEQ ID NO: 137659 - DNA, 662 bp, Homo sapiens
cagtttaatactctcgttatgcgtggtctatacacagttggaattctgtattcagtgatataacagcttcatagaaatgtcttaaatgtgttgtggaagcatgtaaaccatcttaaagatcaatgcctcatgggtttatttgtgtgtggccaaagcaaatcaccaatgtagttgttcatgttgccatttgcagtttgtaaaagacatgccatgtgtgcactaaatagtgcattttcggctagctgtatttgtagcacaatgtcagattgaatttggagatatgattcactctctttgttccagagcagatacaaattatcatggcatgaagtaaatagagctactagtggttaggtcagatgttaagaatgatgtgtgtgtttctttgtgtccctaagaatgctatggtaacttttggtcagtagatggagttgcaggtcccagacatgtttgttttcttttggatactttggccttattcaaaacagaatatagatagaaagatagctagatagatgatagatagatagatagatagatagatagatagatagatagttcaggagccaactaacagtaattcagtttttccattcattaatttaataatgaagtacatatatatagtgtgtgtatatatatataaatggtatatatgtata

SEQ ID NO: 137660 - DNA, 393 bp, Homo sapiens
taccagccttcagaggtcttccacggggagagtcagacattaataagataaatggctaaaagacatgccatgttagatattgctaaataaggatagatagatagatagatagatagatagatagatagatagtgatagatagatataatgcagggaagtggggagagtaagtattgaggggaatgactgaactcaggaggagcatcactagaaggaaagttggaataaacacctgaaggaagtaaaggagctaacaatatgagtatccgagagaagagcatgccaggaagatgctgaggtcagactatggaagaccaaggaagccagggtggctgtcatagagtgaataaggcagagggtagtaagaaatgaaataagagaggtacaagagct

SEQ ID NO: 137661 - DNA, 699 bp, Homo sapiens
agaataatttgtaagagtaaatagtagtggatgaaggtcagtatatgaagcccattatcttcctgtactttatattacaatttcaggttctttttgacccttaaggtatgtaccagagaaaacctagaaatattgccacctggaataagattgagtgtatatgaactagaaatatgtgaagagttatgacaagagattttactagtgctgtattgattcagctctggaagctggctttgaggtatcctgagaaagatgccacagttttaggattcagctttttctgaaagcaataattgatgacctttttaatcttataattaaatctccttccagagatgcaaagatacaaacagtaatcctcacatggttgcatgactgattaagaatttatccagccaggtttggtggctcacgcctgtaatcccagcactttgggaggccgaggcaggtggatcacctgaggtcaggagtttgagaccagcctgaccaacatggagaaaccccgtctctactaaaaatacagaattagccgggagtggtggtgcatgcctgtaatcctagctactcgggaggctgaggcaggagaatcacttggacccgggaggcggaagttgtggtgagctgagattgcaccattgcactccagcctgggcaacaagagcaaaactccatctcaaaaaaaaaaaaaaaaaaaag

SEQ ID NO: 137662 - DNA, 212 bp, Homo sapiens
tccagcccctgctccattctctgtgtggcagctagtataaatatttgtaaggcacaaatcagacaatgccatatgtgactatttcaaaacctccaggggctctcctttacacttcagatgaaatctaaactctgtaggatggcctagaaggccttatgtgatcttagccccagccaccttaattcccaccatttttccttaattcccaccat

SEQ ID NO: 137663 - DNA, 287 bp, Homo sapiens
tggaaactgtttccacggatgggacaggcggatcaaatgggctggtggatcagtgggaggaagcataaagttcacatcttcaaaacagtaaaaacagcctttatttgaagggcccctagaaagagcagccctgttcagagtggtgactgacattttagtggctgatattagacactgaacattggggagagatgatagctatttgcaatttaagacccctgtgagaatatgaacaaaaacggtattgagagagcgatgtgccgtaggaaatctagagatgtttaagc

SEQ ID NO: 137664 - DNA, 421 bp, Homo sapiens
gactgtagcttattatatgaccttgggcaatttacttgactttgtttttttaattgaaaaaaattctctttttttcctgccaacaaagacccagaagagatacttgacttttctaagccccaattttctcatctttaaaatgaggataacactgatgcctcacagggttatgaaagaattgagattaggttctagtatgtatgcctggtatattagtaagcagtcaataaacatagctgtttttcttttctatttttttttgagacagagcctcgctctgttgcccaggctggagtgcagtggcgcaatcttggctcactgcaacatctgcctcccaggttcaagcgattctcatgcctcagcctcccaagtagctgggattataggcatgcaccaccacgcccggataatttttgtattt

SEQ ID NO: 137665 - DNA, 450 bp, Homo sapiens
tgaaaccagaagcatgacttttaagtagcaggaacattgagataatggaaaacttggagcctttgagaaaacaaagcacaaagctgctcttgaacaccttgccatgaaagtaacaaaacgctgaagcatgtttataagtcagggctgaaaatcatgatgaagaggaaaagccaggtgactgctgtcagtttcaataccttatcctgtttcttttatcatgaaattgagtagttcgtcagcaagaaggtcaggtctgagcatctatttaaactcttaaccttgagactgtgatgcttatgtgatgtgggaaattgtatctgctcattagagctctgatatgtaattgaaatctgagattacttatctgccttgtcgtatttaaaccactgattatggctctgacatttttgttactcttcaatcaaccagtatataaaggattcagaatct

SEQ ID NO: 137666 - DNA, 124 bp, Homo sapiens
cctaaagaatccaccctcacaattccccatctaaaatacaaactacacctggaagtccccagacaagacaacaagtccctggtcaggaatataggaggtgcccaatacatgggaaatacagaag

SEQ ID NO: 137667 - DNA, 472 bp, Homo sapiens
tttctgaaattcacagggcctggataaggttgatttaataatggaggatgtccctaggaagtttaaatttaaaaagttacatagagctatgtgatgaatgtggtctacttgtactacatcatgttctacaaagagaatatgagttattttgaaattacagctggtctgttttcttttgccatagtactgctctgattttggatgacatgggtcacaatataatgaggacaccagagataatggacagtactcatactcaaggttatactcatttaccacctagttcaggagtcagatactcagtctgtaggaaacaaaacaaaacaaaacaccagagcataagaagtactatgagataaagcagagctataggaatacactacttagggctgggagctccaggagtatctacctgaagaagttacacaaatgagcgctcaagggaggaaggaaaaaccagacatcagcactg

SEQ ID NO: 137668 - DNA, 443 bp, Homo sapiens
acccctgttcacttccataacacattctcaccaccagccaggggcaaggagagttaatcaagtgcagcccacttagttttcagaagagaagactgaagcccaacaggtttttaccccatcagctttctctgccacctagattgtgaatactatttactatcacttgttttctgggcttagaagcgtgacaacccaactttaaatctaattcctatgtcccacatcaactttctatcttcttctatttctcagaaacttctcttatatttgtgtgtaaaccagaaataaaattctaagacccctcaactgactgaacagatcccccttttggccaagggcattccaaagtaaacctgaaaaacaagtgcagttcatgatgggaagggggaatcggacatgtctcattatgccttcctccctttggaattcaggcacaactgacc

SEQ ID NO: 137669 - DNA, 264 bp, Homo sapiens
tgcccgcaagtaagagccttcatacaccaggttgcagactatttcatagctttactggatgcaacaaagcccagcaaaacccagctgtgagacgtgctagttgtttccagtatatacccacatgggcttctgggaagaaagattcattctttgttccacctgttataggaattcctgctccttggattttatttttctattttacattcagtcattttgttttgtctcctcatccttgactttttaaatcactcactgtgaaag

SEQ ID NO: 137670 - DNA, 465 bp, Homo sapiens
gatgatgggacatttacataagggaaagatcatacatatttccttgattatgagataaacactttaaaaatcattttaacaataagtgcatcttctaatacatttatatatttaatattctctttccaaataactgctattacatcaatagtgcgtcttacaattgatggtatgttagcattaagaaaatacagtaactaggccgggcacggtggctcacgcctgtaatctcagcacttggggaggccgaggcaggcagatcacaaggtcaggagatcgagaccatcctgtgaatggtgaaaccccgtctctactaaaaatacaaaaaattagcagggcatggtggcgagtgcctgtagtcccagctactcgggaggctgaggtgggagaatggcatgaacccgggaggcggagcttgcagtgagccgagattgtgccactgcactctagcctgggcaacagagc

SEQ ID NO: 137671 - DNA, 164 bp, Homo sapiens
tactgctgatgataaaggggagatgagaaaggtaggtggattgttatggtgaaatatatctttaaaccactggaacccttctcgaaccattgctacttccaacttgggcatctccatactctagggattgtcagtttcaaaactcagacatgtgcccatgtgct

SEQ ID NO: 137672 - DNA, 122 bp, Homo sapiens
atccctgcctccagtatagctcctgggcaggattccaaaggaaggtctgtaaggtcctctctcttcttgttggctccccctggtcaccatcgtgaacacagcagacagcaattgagcatttg

SEQ ID NO: 137673 - DNA, 164 bp, Homo sapiens
tgctgggattacaggcgtgagccactgcacctggcctccttttttttttaattgacagatgaaattgtatgtagttgtgtatgacatgatgttttgaagtatatatatgttgtggaatgactaaatctagctaattagcatagcatggtctcacataattagga

SEQ ID NO: 137674 - DNA, 219 bp, Homo sapiens
tccagcctcaggtaatctgttagagcaacacaaaatgaactaatagaatggctattcactttgattctatttttttaatattatgaacaatcccgaataaatattcctgtacatgtccctttgtatacatatgagaaggtatccctagggattatacttcccatagaatttctgggtccttataaaatatgaaactttactacatatataggtgaaatt

SEQ ID NO: 137675 - DNA, 284 bp, Homo sapiens
gagaatctcacttatgtgtcacttggcaggaggcttcagttcttggccacatgggcttctccctagggctagacgtgtgacattaacagctggcttttctgaaagtgaggagagaaagagggaggctgaaagagagtctaaggtgaaagccacacactcttagaacttgatcttggaggtgacaccttgtcacttttgcacttgatttggaggtgacaccttgtcacttttgctacatgctattggttgttcaaatcaaatctggcaccatgtggatgaggatt

SEQ ID NO: 137676 - DNA, 280 bp, Homo sapiens
atctcctgacctcttgatccacccgcctcggcctcccaaagtgctgggattacaggcgtgagccaccgcgcccggcctatgtgggagatttttcaaccgaagatcctaacatgagggaggcctaatgtgagcatttttggctgctccccacttgaaagacccctgcatctgtgaccctgcagatgccagcgcaccttgtcacccagtcgtgcctcttcacccagcgcgcgcctcgtcacccaatcgcgcctcgtcacccattcgcgcctcgtcacccaat

SEQ ID NO: 137677 - DNA, 442 bp, Homo sapiens
tatagaaaaggaatttttatgatttcttcctgcccaacccccactaagaagcaaaggccctactcttgaccttggcatccccttgttgctttcttctcgtccatgacacctaggcttgatattctttaccttgggtattcttgtgaatatttgctgaattttcatttacaccaaatacaattcagaagacagaggctttccaaggtatgagtgtgtaagtatgttaaagaaaagctctcagcttgtctcatggtttaaagtcctcctaagatatctgagctgaatctaaggaataaagtagattggttcctccctgtctgatgagttttatcaaaatgtgataaaatgtggtaaagaaaaatggtgggccaacttcgttatagttctactgagggacactgtacaggtaaaccaggccataactcatttgtcctgtgacagt

SEQ ID NO: 137678 - DNA, 443 bp, Homo sapiens
agtccgtgcgactgagctggaccctcctgtcattcccatacctgttccagagactggaggggcctctcccaggccttcctgaggctgaccatgaggagcccaggttcctgggagaaatgttcagccctgagcccatcatgagaggggatttagtctcagtttcctacctgtccccaacctcccattccagccctgttcttttccccagcccccctgagggaggacagccatgccatgataactcctgtcagtgtcacacagcaaggaaacccaagtggcccctggcttccttcagcctggcttgcttaggtctttgctgtccggggaaggactccaggcatctgtgggctgtgagctgctcctggagcctcctctgagggctgaagctcgtggggctaaaggaacttaccacagtggctgtcggagctcagtcgaacggactg

SEQ ID NO: 137679 - DNA, 418 bp, Homo sapiens
cctaggagttcgagactagcctgggcaacattgtgaagccccatctctacaaaaaatacaaaagttaaccaggcgtggtggcatgcacctgtggtcccagctgctcaagaggctgaggtgaggagattgctttagcttgggaggttgaggcttcagtgagctactaccatgccattctactccagcctgggtggcagagtgagaccgtgtctcgaaaaaagaaaagaaaaagagggatgcacttggagaagtttcttggctgccccctttctttctgcctaggtgctgttgagtgaaaacatagtgcttggagccctgacagctatctatcttgtgaccaggaggggaaggccaggagactcatggttctctgttcactcagatctcagatacctggaaccactgacttttgaacttt

SEQ ID NO: 137680 - DNA, 196 bp, Homo sapiens
agcagggcatacgaattcctccccagtctggccccagtccacctccttgcctcacccccaacccacgaagctcatgcaacctccacggctcactcaaggccctctcgggccaccatgcttttgcatatgctgtccctggtcccggaagcaccctctgccagcctgccctcagcacacgcctaatcgcccttccatg

SEQ ID NO: 137681 - DNA, 433 bp, Homo sapiens
ccaggctatgtgcagtggggtgatcatagctcactgcagccttcaacttctgggatcaaaggatcctcctacctcagcctcccaactcactagaactacaggtgtacacgatgcccagctaatcttttttctttatattaaactgtttagggaaattgttgtaattttttgtagatacagggtctcactatgttgcccaggctggtctcgagagatcttcctgcctcaacctcccagagtgctgggattacaggcatgagccaccgtgccgagccagtttccaagatttctaataccccattactttctgtttaatttacgacagtgtttccttgtttcatggcttctttttctttttaaaggtataaaatatagatacttatttaaaaatctctcccagattgttctattaactttatttccttaggtataa

SEQ ID NO: 137682 - DNA, 974 bp, Homo sapiens
attttttagtttggatattgttacaccaggttttcatgggggcaaggcatacctgatttactcaggaaactagcaaattgatgacagcattacaaaatgtacaaggtagattttgctattaaggacagttcctattgctgagtaacagcggaatgaaaccaggtatttactgatgggccaaacctggtaagcatttgtctaggaggcagatcagagctactaagttgggacggaagcccgtcagtggtggacctatcaccttggcagttaatgacaaaaggagccagacgagtttttgcctttgctactagatgtaacagtggatagagaagccggcctggcatgagccacaggtgtgggcagtgaggtggtgggagaaggcatgcagggtgagaaaggtggcgcagagcccacggtagatgggcatgactacatttcagccccagaatattctagtgtctgcagagcaactgttttcaagtaaagaaggtgctgggaaaacaatcaaatttgataaaaaataattaactttatcgagagcatgaggcagaacggggtgagagaaaccacaggcagtattatctgtgaaatctccatgaacacagatttttggattgctgttattttggaagataaataaggcttggtggaacaggaagagcactgctgatttgtttaaaaaaaaaagagagagggattttttagatttccgaatacagaggtcatcggccaaagatgaaaataaagatggaacaggtaatcacaccagggacgaatggatctctcataagtaattctattctttaggtgatgtacttcagagctactttaggtagaagttgagctcaacaactaattgttcctcctatggaaagttgatgcagatgctaaaacagacttttaagacgataaaaagattttgaaacttattttgtagacgtcaataagtctgcattatgattataaatgaggat

SEQ ID NO: 137683 - DNA, 695 bp, Homo sapiens
aaaaaaatcaggcttggtgtaatcccagcactttgggaggctaaggcaggaggattgcttgagtccaggagttggagaccagcctgggaaacatggcaaaaccctgtctctaccaaaaaatacaaaatattagcagggcatggtggcatgtgcctctggtcctagctactcgggatgctgaggtgggaggatcacctgagcccgggaggtccaggctgcagtgagctgtgattgcaccactgcactccagcctgggtgacagaggaagacactgtctcaaaaaaacaaaatgaaacaaaacaaacgaaaaacaagtttagaggaaggaaacttgagattccacagacaccaaatacagtaatggactttctgctttacttctctgtttccatgttaattatgagaacaaggtagatttaacattgactcgatctatgtttaatttcaagaacttaaaatagcaactgaaatagcttcatagataattgatagatttaaaataatatttaaaaaataatctttaggacggacgtggtggcttatgcctgtaatcccagcactttgggaggctgaggtgggaggatcacctgaggtgttgtggtgcctattcacattaaaggtggatcttcctttcctagtccactgactcaaatgttaatctcctctggcaacaccctcacatacacaccagaaac

SEQ ID NO: 137684 - DNA, 192 bp, Homo sapiens
gaggatccaacattctcacagcctcacattcacttccatctattctctgaaaatattccctgagaggtcacagagaggaggactcagaggccacaggtcatggaaaggtagattgaggtcacagaggtcacgaaaaggtggactgaggtcacggagaggtggactgaggtcacacaggtcacaaaaaggtgg

SEQ ID NO: 137685 - DNA, 337 bp, Homo sapiens
gtacaaaaaatacaaaagtgagccaggtgtggtagtgcgtgcctgtagacactaattcagtaggcttaggtcgggggtggaggttgcagtgagctgagatcacaccactacactccagcctggatgacagagccagaccttgtctcaaaaataaccaaccaaacaaaacacacacacacacacacacacacacacacacacacacacacacacaaatacccaaagtgatataagactattctctgtgcatagaagagtattttgtgtgtatgtgatattacatatataaaaatatatcatggccgggcatggtggctcacatctgtaatcccagcac

SEQ ID NO: 137686 - DNA, 548 bp, Homo sapiens
ctcgaatgtactgtttcaattgtcttacacttgggagtgagggatagatgaggcaccatgtccagctctatctcagattaaactgccagccccaaactgagaggtcttcttcatcatgattggaaaaggcatatcggaagggatcagtcggtgacacagcattttctcagctagccctggaaaaccacccaaacgtcatagaaatataagggaaatgtctgcttaacctactctttcttttgggagggcatgcagtttagctatttgagtgagtattttgtttttgttccaatacttgattttagcagagcaaatgagtccatcatgcattagcaaataaagtcagctctgaaagtgaattctcagggaagggaatggaggcacatgctagaattcttgtactgttctaagtttgttattatgtctcatgtggaagtcagaatgtcctggagactgactcctggtttggctttgatataagcactggaagatgaacaagagatgaggtggtggcaaaaaatagggatgatcttagacaaactgaaaca

SEQ ID NO: 137687 - DNA, 372 bp, Homo sapiens
taaagcggtacagcatcccatccagcaagaatccgggaactttacaccagcaactgtcggtgggtgcccaccctcccaaggtgggcagaagacataccttgggtcccactcaacactaatcagaaagttaacaagcatctcattcttttccaaaagggtctgggtcctgctacagccagttaggttagctcagcctgaggaaacagagaaaacaacgatgctaattcttcctagatatactctctaggccatagcccgccagcccctattctaagcagtaccgcagtcactgagaagagccccacctccactatcagcacccctaaccccttacagtacaggcctctgttacagatgcattaaagacacttt

SEQ ID NO: 137688 - DNA, 431 bp, Homo sapiens
atcgagctcggctccaatgtcatataagcggagaaaaagaacaaagaggttaaatgtaaaataaatatccttctactttggacagatgcaggaaagaggaatctacttttgtcagaaaggtacaggaaaataacagggtagaggcacagaaaattttacatccacaaactccaggaggatacagattctctggctgccttgtaatggattccctatagttgtactatgagtttgaatgtacctttcagttcctacggtgttgaaagttttgagtaatgcatgagtgattcataagaagctagcaagtatccatctatgatcgtgcatgtgaagaagtggagctgcaggtgagaaaggtccagaaagatagtttcccaatagcatcttgacaatgatttcaataggacagcccgtttgaacgcttatatgac

SEQ ID NO: 137689 - DNA, 293 bp, Homo sapiens
aaggcctggttggcaaagagtgcagctggactttagagcaggccagatgcagctggctagtaaagggtttgtaaatcatgataaggagttgagatttttatcctgaaggtaatggaaggccataagagatcttaagcactagtgcgctttggcagatgtgttctttgactccacgttgtggagaaagagtgggaattggttaagagcagagttaagaagggtttgcatgcagtaatctgagcaaaagatgatgatggtctgacagactagggtgatggcagtgggcaatggag

SEQ ID NO: 137690 - DNA, 184 bp, Homo sapiens
aatcccattactacaaaaaattagttgggcgtggtgatgcgtgcctgtaggcccagctactcaggaggctgaggtaagaggatggcttcagcctgggaggtagaggttgcactcagctgaggtctgcactcccgcctgggtgacagagccagaccactctgtcacaagacaacaacaaagccaa

SEQ ID NO: 137691 - DNA, 136 bp, Homo sapiens
gcagaagactgccctcaacctgctgcaggaacaagacaaggcaggaggaatttcaaaacgctcacctttcacaagccctgattccatcgattgtttgaatcttccatgaagtccacagagcatgggtgaggccaga

SEQ ID NO: 137692 - DNA, 158 bp, Homo sapiens
tgggaggcggaggttgcagtgatcacgccattgcactccagcctcggcgacagagcaagactttgtctcaaacaaaccaacaaaatgtttaacaaaagagactgggagccccaccggccacagctcctcctacgcacacacgagtcgggattctgccc

SEQ ID NO: 137693 - DNA, 403 bp, Homo sapiens
aacagagttctcaaacctcttgctcttgtatctttcagaaattgatttcaaacagcccggatttactagatgtgtaaactataactccaatggaatgagagacctaagaactgggtgatatttctaacggttcacaatttatctgacaccaatttcaggaaacgtattgataatgagcaaacaagagatttcctgaaacttgcttatcacagagatttcctttcctggccccagtgtgctggcttatgcttgtaattccaacactttgaaaaggcgaggtaggaggattgcttgaactcaggagtgtgagaccagcccgggcaacatagcgagaacctgtctctacaaacaattaaaaagttagcaggcatcatgccatattcctgcagtacccactactcag

SEQ ID NO: 137694 - DNA, 501 bp, Homo sapiens
cgtcctcctccacaggatcaaaggctgaaggccattggcctatttgcctccttgtcatcagccttagtggggtggaaatctgcaactcaagattcctgctgcccgttacaggaatctgtccaccataaaccggggatgtcagcagaattgaatggtgaatcaaaaactggaacaaatcattttaattacctaagacccaaacctaattcacagtatttcttcactagaccatgaatcaacttcattttatcccctccctctagttgagcagttcaacccagaactgaactaagagttgtctaaaacttggagctactgctggaagggaatgtgctgaccattcagctagccaagccctctcattttacacagaggccctgagagctgtgacccagggcttcagctgcacttaaacgcttcacttttctcaaggccacatggcacctcggggacccagatttgactcattactctggcagcccctcaccttctgcactgttc

SEQ ID NO: 137695 - DNA, 432 bp, Homo sapiens
ctgtgaactatcactttacttctcattttaatcttcatatgctgtgttccaccttcccacttagcctggaaactcggccggaatcagacagttttctatgccttactgtgcctaataaggggcccaagacgcgccaggcaggtgtgtcacctgttcactctgcaagcattaactgagcacctactacgtgctggcattgttttaggcactgtggatgtagaagtgaacaaagcacatagtgactgcaggaaacttgctccacagggagaccaagaggagtgacaggtgagaagacggggagggctatcacttctctctcttttttttgttttttgagacagagtctcactctgttgcccaagctggagtgcagtggcatgatctcagctcactgcaacctccgcctcctgggttcaagtgattctcctgcct

SEQ ID NO: 137696 - DNA, 423 bp, Homo sapiens
ggatgccccagggccctcggtttaacttcagcacaccccaaaaacatcagactaaccccctttcccaccctttccccatctcccacagttcccaggttcttcctccttcactgctgtatctcactagtaacccatgaagttgcagatgttctttgggcagcataaaggtagtagcaagaactctgctccaacacttacaatatcttattgacttattctttgtcttgttcagtaaaagaagataattattgctgttttgttaaaggtgaaatcagaatcaagagcatattcagtcattacaagagcacagagtatctttatgacacaaaatctcaacacacacacatacacacacacaaaaatggccacaaatataagtgactgatagtattcagaatgtcagtaatcccaactttccaaggc

SEQ ID NO: 137697 - DNA, 135 bp, Homo sapiens
ggcaggagaacattccaggaagggaagactgttgtgtgggaaagggtgctgaagcaggaaacagctgggaacagtcacagaactgaaagaggccaggatggggcaaacagaggggaagactggtgtccagggaga

SEQ ID NO: 137698 - DNA, 382 bp, Homo sapiens
acttggcatctatgtgctgccaatttcccagacataatgaaattgtcaaagtgactatctctagttaagagctccagaggtaatgctaacgatcgcaattctataccaaatatgcagttacaaaagaaaacaagtgaaaagggtgaatatggtactccagagggaactaagggtaaaagaacctaaatttgaatcccagacctgctagtcactgaatgatttatgtgagatagctaaaattgttccatgcttcagtttttctcagttttcaaattaaatcttccctctctacagatttctaaggaataggccgagataatagctgtacaacccctttgaaaagttaaaaatgtcctatgatgatggggttttcccctgtccc

SEQ ID NO: 137699 - DNA, 249 bp, Homo sapiens
ctgggcctgggggtacatacctgtagtctcagctactggggaggctgaggtgggaggattgcatgaatctgggaggacaaggctgctgcactatagcctgggcaacagcaagacttgcctcaaaaaacaagagactgaattgttctaatagataataaagtcgcatgtgctaaattctggcaccatacactctgagacttctgctcccaaatgtataagaataactgacactagatgaggttcctgcca

SEQ ID NO: 137700 - DNA, 259 bp, Homo sapiens
tcttgaccagtctgcttttgctttggccgagaccacttccacttctacttcttggtagccattgcttttatgtgctttgtttttaggattgtaacggtaatgccatgtttcacttctttttaaaatgcttcgaagacattctttaggctcttggtcctatttgtttaaaatttccatggaaagctctggtcttgtgtgcagctgatctgagtgccatggtcttggcacccattgagtggaaagtttgcttaactttaat

SEQ ID NO: 137701 - DNA, 247 bp, Homo sapiens
gttttttgagactcatctagttcctttacaattttaatttagaatttctttagctccaaatcaggatcattagctgggagttcttataaatcaaaagcaaaacaaagctattgcaaacaagtgggagttctcataaccttaatcagaaaggcttgagttgcatttccaaatcctgtctctagagaccatgagtttttaatgatagtatttccatgaaagcccaattgaatacaatcaccacccagac

SEQ ID NO: 137702 - DNA, 393 bp, Homo sapiens
tcaggcagctcacagaccacttgaaaagaagacaaagacccatctcaggaagctcacagccacatgccaaactgggcaagaccaattataaacacaattggaacaaaatcatgacagatcctttcaatgagttaaggtgagaggaatgttaatcttattaccgccctctcctcatttctctcttcttgcactgctagaagaaaattcaataaacgatggctagtgagtggctcaccaagaaatgggcatcatcttagatgggccctggctgccacagccagccctaatagccctggcttctgactgatagggccaccatggcctgacagtcccttgccctcaggatggaaccgtggttagggtgattaatgcatgaactgttatttcataccc

SEQ ID NO: 137703 - DNA, 541 bp, Homo sapiens
tgtactcgcagggcacacgcccacccacacgctgggctacaggaaccacgcctgtagccacgagaagagagtggacacccacccatgccatgagccactgaccactggctggctcccagctggtatacttaggagctggtataataaggagacttctaaaagcttttagccttaaaatatatgttactcattaaattctaaaactgcttattcaaataccacatatggttttaatcacacttgcccagatgtctcaggattgtctactccagagtctctgtcatgttaggagttgtttaacaggcagcaggtgtatccacagcatctgctcacatgatcctaacccaggggactcctgggttcatccacaactaccagctctccatgtaccacccttgtctgagccaatctgactggggatcctgtgggccccctctgcctatggggcctgggtggtacccctcctttcccattgccttgggaccaagctagttgcagaattggacttcagcctcagtcctgattggatgccctacaggat

SEQ ID NO: 137704 - DNA, 253 bp, Homo sapiens
tatataagatatcatgtaggcataacacaaggaccacatggagaggtcagacagataatgagctgtttgtggcacattgagtttgaactgactgcagaacggtccaggagagatgtccaagaagcaattggatatgaaagtctaaaatggccgggcatggtggctcacacttgtaatcccaacactttggaaagctgaggcaagtgaattgcctgagtccaggagttcgagaccagcctgggcaacatggcaa

SEQ ID NO: 137705 - DNA, 294 bp, Homo sapiens
aggcagtggacggggatggtgccaacaccctgaatccccacaaagctgggtctcagagagagtcccaggagttacagttaatccttacacacatggtccggcactgtgggatcaggaggtgtgtgtagaataggagatgctagtgatggcattaatcattatgcctgacgtttattaagcacctactatgcgccaagcggtttctggtattaatttactggacctgcacagctgctctgcaaatcagcgcatgccaccccctgcttcaaactctccaacacctggatacaatcc

SEQ ID NO: 137706 - DNA, 205 bp, Homo sapiens
tcacattccacagggtttgctaaataattatgaccagtattttactaccatcttcttccttggtgaactactaaaattagtaaatttatgttaaaaatgaagttctccctagaaatcaaaagtgcagtctaagcactgaaaatgttctatcaacacttgttaactgagaaccattgaaacatctaggaatttttaactctgcaag

SEQ ID NO: 137707 - DNA, 454 bp, Homo sapiens
ttgactttatggtgataccctttctatttttgatgtttttctccattctacattagttactattcactatttagtaccctggtgttatcataggtcatgccatccctttggcatcactttatatattaggtactattgaactgctccaactctgctgtttcaacatgtcagtttgctgactgaccacatccatattttttcttttctcactcactgtcatctcttctgcagcctaataaggacctccaattccttgaaccccttaccttctaacgtctctctctcttttcttccctacttaaattaggttttatactttactcttttaattgttctctttccagcaacttcccccaatatgcttcagggtcccacacacctgcagaatcccaaccctgcttaaattcagctctttggatcctccactcctacaccagaaagctgtgccctgcta

SEQ ID NO: 137708 - DNA, 354 bp, Homo sapiens
tacccactctctttatgaaggaaccatggtaggattgattatactaaattgatgggaggccattgtatgacatgaccaacccaaatgaaatctgtgggaccaggtgctatgtaatctgtttttaaagaaatgggatcttgctatgttggcccaggctggagtgcagtggctattcaaaggtgggatctgtgcacggtatagccttaaaatcaaagcaccctcccgccccggcccctgcagtaactgggactgtgtgccccatgatgcctggccaagtcaactatctttgaaatgggtcatcaggacaaggtggctcacacctgtaggatcgcttgagctcaggagttgagaccg

SEQ ID NO: 137709 - DNA, 840 bp, Homo sapiens
ggtcctccaggtccccgtgggttcgcagctccacccgcccttcctcgccctgcatccctaaggagaggtgtccgctctgaagggctaggggccagccatggagtgaggggaccggggctgaccacgcgcggcacagacagaggtcctcaggcgggccctctcctggacggtggggccggagctgatctagaagaaatacggagggacgtgccgagaagccgctctccttcgccgcgaccctggagagcgcctctccacccaaaggatctgccgagctgagagatccagggcgggcgtccgcagccgtgaggccccctgcgccgccagtatgggaagatcctgcctccttacaccttggagaacgctgggcgacgactaaagcgccttccgccggcctgtcactccatgtgacacaggagccacgtgagacccagaagagtccagcgactcgccgcgcggcgcactttaaactctagcctgagtctgcgacccctccagctctccagtccccagctgttggggacatcaagccggagccctgggctctctgccctgtgggtcgctgaaagcagagactcctcaaaccaaccgaaccgggcgcattaaccctctcgcctgcaccccgctgcctcccggttgagccccgaggcggctccaggtagaacctgctggactgactgcggcgtccagaaatctggagtgtgggctccagacactctccacggtttggccccgggtctcaacacccaagtcgcctcttctggctccttcaccacacagcggggcctgtggaaagggaggggccgagagacccgtcggcgcaccactgtcctcgagggg

SEQ ID NO: 137710 - DNA, 439 bp, Homo sapiens
ttaggtgtttgtttttttaacagtctaggaatttcagtgcaattccgtgaggtggtgctgaccttagatgagaaatacgtggccaggctataaggactacatgtagaattgagatgggacagtgtacgtatggactgtgaggggaaagaaaaggtaaatgtgtgaaaggaaagagattggtgcatggtcatgacagtctgacagcttagacatttcagaggcattgtttatgagaaaggggatagggacacataggtctgatgacaaccaaagccctttgatgatgccatctgtcactcaaggctccccacagcctgcccaacctgactctcctgcctgcttctccactgcctaccttcaacaatcaaactatatttttgttacagcaaactacattccatttgcctttaaatgcttgcattttagttattgtactggc

SEQ ID NO: 137711 - DNA, 541 bp, Homo sapiens
gtatcacttacagtgagggtttcctggggcagctattctaaaaattgttcagtttgcagaacaacctctttgcagaaagctataattcattttgtaaaaacatgaataatgatatatgtaagtacccttcatagactatttttcttacagaaaatgattcctctatgtatgcaatatatgaagttatgatgtgtgtccacaaaaacacaaaccatcaaactaagcatgattgactatttctgggcttttttcagcaatactcatttataacttggttcatttgttttatggtctccttcaatttccctggaatccaatagtagtaggtgccaaaagtcctatataaatctatgggagaaaatgaaaataatcagctactttctttttttttttagactaaatcacaaggaaaaaagctacttcccaggagtttgagaccagcctggccaacatggtgaaaccccgtctctactaaaaatacaaaaaattagccaggcatggtagcgggcacctgtagtcccagctactcgggaggatgggg

SEQ ID NO: 137712 - DNA, 473 bp, Homo sapiens
cttcctatccctgcctaatctcttcaatccgaatctcttgacaaggggataatactacctataatttggcattttcttctagttcttaagtacttcttaaaaattttagctttatattggcatgacatacttggcagtggttatttctgagaaagaatatggaagaaaggaatcacacgataccctatatatttactgcttggctcttttaaaggagaatatattacttagataatacaaaatgttttcatcataatgatgctcaaaggaaaaaggtgaagagtttgtaagtatgacctcaatggtctccttgaatgggaaaagtctgacatattaaactacttaacaactaaaaaattttacaaggcaaaaatataccgtaacattaaaaggtatattcaaactagaaaaatattcacaacaaaaaagattaatcaaataaaggtattctcaatacacaaaaagctcttacc

SEQ ID NO: 137713 - DNA, 331 bp, Homo sapiens
ccaagttaagcctgaaattttggttcaggattcttgagaggccctgtgagagctcagactctcccagggaacagctatgtaagaagaggaagaagagggcagcatgaagtcaggtgcagttggaaggccctaacttatgctgtggttatctactaaaatgccccttaagcagtctttattcaataaatattgaaagacctttctttttaaaaaatacacctaaaaacaaggagagtacatgtgtttacaattattagaaagcatatatttgcagtctagctgtatttgattaatttcaggatatgggcttcccttgccaggtggtctccat

SEQ ID NO: 137714 - DNA, 231 bp, Homo sapiens
cagcactgaggctggacagtggggaatggagggggactccttgagataaattaccacctccttcactttttttctgagacggagtctcactatgttgtccaggctggcctcagactcctgggttcaaatgatcttcccacctcagtttccctagtagctgggactacaagtgcaaaccactgcacccagtcctccttcacttttgatttgctcaacacctagtggcatcct

SEQ ID NO: 137715 - DNA, 517 bp, Homo sapiens
caggaataatagatgagaggaatatggactgtatataaattttgtgtaaataaccttctttattccaaaataacttcagatgttctgatagtactttatagcaaaagaaagcaataatactttctagcagataattatatttgataactaatgcttctgtatatcttttgctagttcttcctgttctcctcaatcacgagtaatcaagatccttatatttctgtccttgtccctctttcttttctcaccatgcaccctcttgccttgggcagtttaaatactgtccctgtctgccaacttttaaacttacacttcatatcaggtctttgttctgagctccagatccgtatgtgtaactgtctctttcacatttttacttagagtgctcaaaggcatcaacattaatttgtcaaaagctggactcttggtctacccaactctttctcctcatcctacctcttctcattaagtcacccaggtccacatatcattcacctgaaagtcatgcttgaccttg

SEQ ID NO: 137716 - DNA, 741 bp, Homo sapiens
gcactaaatccgtaaattgctatgggcagtatggccattttaatgatattgtttcttccaatccaggagcttggaatatttttctatttatttgtgtcatctctgatttctttcagcagtgttttgtagttttccttgtagagatctttcatttcctttgttagccatattcctaggtattttattttctttgtggctatgtaaatgggattgtgtgcttgatttgactctcagcctaatcactattggtgtatagaaatgctactaatttatgtgcattgattttgtatcctgaaatcttgctaaaatcattcatcagggctagcagcctttttgtgtagtctttagggttttctaaatagagaatcgtatcatcagtgaagaaagatagtttggctttgtaagacctcaaactataaaaatcctagaagaaaagctacaaaatgcccctcttgacattggtcttggcgagaaatttttggctaagtccctaaaggcaattgcaaccaaaaattgacaagtgagacctaattaaactaaagagcttctgcacagcaaaagaaactatcaatagaataaacagacaacctacagaacgagagaaagtatttgcaaactatgcatccaacaaaggtttaatatccagaatctatagggaatttaaacaaatcaacaagcaaaaataaataaccccattaaaaaaagggcaaaagacatgaacagacactgctccaaagaaga

SEQ ID NO: 137717 - DNA, 318 bp, Homo sapiens
cagtcagtaaaaacttctaatcccaagcagctgtactcatctgggtggactgctttctctttccatgtacctaattatttcctgcctcattccaagactgtaggtgactggtgtggagcacttgttctacacaagaccctctgggtcacctcacagatgggagtcctccagagaggggggcttcacagccagactccttggaagaatcttctgcactgggtgtcccctcctcactcctcagctgacaagggtcagcgtcctactcccacaggcctgtgtcccctggtgaccgagagtcactccatctagtcctcatca

SEQ ID NO: 137718 - DNA, 751 bp, Homo sapiens
tgggttttttcccccctaaaggtctgctctctgatccaaatttttatctcttgatgtaatatggaaagtggagcattaacttacaaaaggcaagaacttgtttgaaaagtgtcttttaatatttatacattttgggcctgtgaaagtaaatcaaaacatccaaataactgttttcataaagcaagctaaaccatattataagatttttatgttagtaatagtgttattgaatttaggctatggaagcatctttgatgtttttaccttactgctttccaagtttaatattttcctattgctgcaacttctttttaaagggttgtagagcaccacgattctgttaataaataagtgaaagttatgcagcttgggaaatctttacctcttttaggagaaaacagatgtttctgcagtatgatgagaatgtctttgggagagaacttttattttttcctggaactgttgcagttttagtacatgaagtgacccccctcacattctaagttattatgtacttttaattacctaacttcatgtcaaggaacagctcttaagaatcagcctttatataaaaccagaattagtagaagaaaagataataaaaatcagagcagaattaaagattttgaaataaagtagcacaaaagatcaatgaaacaaaaagttggtctttgaaaagataaacaaaattgacaaatctttagacagaataagaaaaaaaagagagaggagccaaataagattagaaatg

SEQ ID NO: 137719 - DNA, 587 bp, Homo sapiens
cgtttgttatataagcagggagggacacgatgatagaaacatgtagccttggaagcgcgtcaaaacatccatcatacgctagctcagtaagtgggcagcctcacctgctttccaagtttaatattttcctattgctgcaacttctttttaaagggttgtagagcaccacgattctgttaataaataagtgaaagttatgcagcttgggaaatctttacctcttttaggagaaaacagatgtttctgcagtatgatgagaatgtctttgggagagaacttttattttttcctggaactgttgcagttttagtacatgaagtgacccccctcacattctaagttattatgtacttttaattacctaacttcatgtcaaggaacagctcttaagaatcagcctttatataaaaccagaattagtagaagaaaagataataaaaatcagagcagaattaaagattttgaaataaagtagcacaaaagatcaatgaaacaaaaagttggtctttgaaaagataaacaaaattgacaaatctttagacagaataagaaaaaaaagagagaggagccaaataagattagaaatg

SEQ ID NO: 137720 - DNA, 484 bp, Homo sapiens
aaattctatgtgtaaactatgcccaagtctctggatgcctcctgaaccagcatccactgggcaggttccaaacaatgcatccaagactaaaataactgagctgacatttcagctgccacccaccacagaggagacagaatttacagtttgggttcagccaaggcaattgtttatttaaaaaaatacaaaacaacaaaaacagcacttttaagagacacatactagaatccaaagtttctacagcttatcactcacaaagtccaggatataatcccaagctacttggtacataagaaaaaagaaaacatgacccattctagaagaaaaaataattcatggagaatgcccttaagatgacccagatgttggaatcagcagaaaagtgttttaagacagctattttaactatgctccatatcataaaggaaaatacacttataatgaataaaatgtaggaaataggctgggtgcagtggctcatgcc

SEQ ID NO: 137721 - DNA, 554 bp, Homo sapiens
cagagatagtgaggagatttgattgtctgtgctgacattaaactactagaggttgatgctaggagtgtagtgttgagcagaccccaagaccatattcaggcttggcaggatgatattctctgcccgattaatgtgacatttcatggaacaaatggaaagtgtttaccattcctgccctaggtgatcaattctttccagccttgaaagccatgtccaggtggagtctggtttagatgtagtccaaagcaaaaggaaggtcaggaagaaagggtaggagagccagtcaaggtaccccacatctgtaatctcagcaatttgggaagccgaggtaggcagattgcttgagctcaggagttcgaaaccagcctgggaaacacagggagaccccacctctacaaaaagtaaaaattagttggtcatggtggtacacacttgtggttccagctcctcacgggctgaggcaggaggattgcttgagccagatagatcgaggatacagtgagccaagatcataccactggactccagcctaagtgacagatgatatctgtctc

SEQ ID NO: 137722 - DNA, 363 bp, Homo sapiens
tctatatgtgaaatggcataatatttaaaggtagacttacaaattaaaaatgtgtattacatatacttcaacagctactaaaaaatgtataatgaagttgtaactaagccagtagtggatataaaatggaaccattaaaaaactcagtccaaaagaaggtaggcaaagagagaagaaggaacaaagaatagacggacaagtcaaaatctaagacgtataggatacatttaaatgcaccttgttgataagtacattaaatgtttattaattttcaatttctattaacaaattacctcaaatttaatagtttaaaacaactatttttttagctcacagttctctatgtcagaagtctggaaatgg

SEQ ID NO: 137723 - DNA, 414 bp, Homo sapiens
taaataaagctggaggcctgcactcttatacctgagtgggtggttttatggcctaattctctaattgctggcatttatgacagtgtggatgctactggccctgtggctgaggtagattatgctgggaatagggaggaaaaaggggtccttttgttagccttttcattttgcccctcaataaagtctctgcaaaaaccctgaggaaatacagagacacttggactgagggaatgacttcccataaaatggttctttatgtttttaaaatgatgagccgcttttcttgacctatccaaagaaatccataccaccactgttaaatatttcaatgagttttttaccttgtcaggttacacaccaggggaagccaaccatgagactgtagctgctgccaaacattcgcttctaaagact

SEQ ID NO: 137724 - DNA, 175 bp, Homo sapiens
acacagaaaccctaaatcttctgattggaataaggagcctaagatgcttcccatcccactccccagcaccccatccaaaggctgggcatctctggaatgggaaagacccagccacccactcagacccctaatccagcatcacacacttgctcagggaattcttttttacatttta

SEQ ID NO: 137725 - DNA, 378 bp, Homo sapiens
ccagcctgggcaacaaagactccatcttaaaaaaaaagaaacttgaatgtgaaccttgaagctaccacccactagctgtgcctacttagacaaggctgtgagaggacactttcacaaagaaataaaggttttatcatgtaagtgagctactgctgacctcacccctatctggtttctgcaggaaagaggtgtcatattcacaagggttctgtaatggaaggactgtgggcagaggtaagagaacccaagaacaaggaaggggtgccaaagcacttggaaccagcaagggactgaaggagcaagagggggagctgctaatgggaaataatattaataccttgacctctctcaaatcctgcccatcaatctcctgccagt

SEQ ID NO: 137726 - DNA, 425 bp, Homo sapiens
agcacgtgacacatgacaactgtctcactgtgccatcaggaatggagtggacccctattgggatgtccatccccctaccttttttggttggaaccatccctcttctctcccctcccctccacacagtgacagggatgggcttctgattgccatgttcataaacaagactacctgcaactactccccaccctgggtgggagttgggcactgttagtaaattggtcaaggatggtgcctgacccaaggtggttcagtctgtgtccttctccaggaacttggaatcaggacgtacagagagttgcctctctgcaggtgacgagataagcacaggccctgtccatggtcatgtttttggccatttggaccagagaacccggtttgcaagaagacaagatttctaagatccaagctcggattgcttttcc

SEQ ID NO: 137727 - DNA, 313 bp, Homo sapiens
agattgtgccactgcactccagcctgtgacagatactctatctcaaaaaaagtagattttcagggcttagtgggaggaggaaatggcaggaaactgctcatggatacagggtttctttttggggtgatgtaaatgttttaaaactgatcatgatggtggttgccgagctctgtgaatgcactgaaaccattgatttgttcactttaaatgggcaaatcatacggtacctgaattatattttaagagttatataaaaaagaaaatcttccttgaagagatgacacttaaggagaggcctagggagtgggatgag

SEQ ID NO: 137728 - DNA, 408 bp, Homo sapiens
gtttgacataatgtctgctcagaaaattttctctttaaagattaattcaaacgcaccaagaatttatcttgatcagcacaacagagggcaaatataaacactaggtctgaatttattccattcacactaaagtgactcccagcatcctctactcattctaataaagtagaagctagaaggaggttcttaaattccctccttataaatcgaaacaattacctgccctatcctagagtatgagagtgtatgtaaaccaaaataccaagcaagtttacagatataactcgcatctgtgcagactggtttgcactaatctgtagagaaaaaatgtatttaaattaaaccaccaataaataagctctgtaatttgtcctctaggagcttacaatctagtagggaaaacacaaa

SEQ ID NO: 137729 - DNA, 372 bp, Homo sapiens
  misc_feature (25)..(25): n is a, c, g, or t
  misc_feature (53)..(53): n is a, c, g, or t
  misc_feature (58)..(58): n is a, c, g, or t
actagtcacgtgttggctagttggncaggagttgggaaagccaccttagtccngctgnagcagattggggaagggtcatggaaacaacaggagtgtaagaatctggcttctcaaaaataactatgagtcaaaaatatcaaaagtgttacaggtgtgggtccagatgagaagaaggcctcaggtgtgggcttaggaagaagctttcaaaaaatgtctgagaaggaaaaaggtcatgcctatttctaaaagaattttactagggtggactgctttgatgtggaggctaaggtggaagtgaggagggtgcagcaatctgactgaagccgggattcaatctcaaaaaacaattagccaatgcagatgatgaagcca

SEQ ID NO: 137730 - DNA, 767 bp, Homo sapiens
atctgagactataggatattttcatggatgaaatgatttgtatttgagtctaaaattccagaattgatgaagtaaacatcagtctcttgaactgccaaggcaatattaatgtcacttgaaatgaatgtgaatgtcagagaagcatccttctagctagggctctgttgtcatgccaagactgtagcagaggcggggcaccgtggctcatgcctgtaatcccagcactttgggaggccgaggcaagtggatcatgaggtcaagagatcgagaccatcctggccaacatgtgaaaccccgtctctattaaaaatacaaaaattagccgggcatggtggtgtgcacctgtagtcctagctactcaggaggctgaggcaggagaattgcttgaacccgggaggcagaggttgcagtgagccaagatcacaccactgcacaccagcctgggtgacagggcaagattctgtctcaaaaaaaaaagactgtagcagaatcatcaggttggaatggcaaggaagtcaaaatgcttcaatatttaccctgtgtgtgtgagcgactgtggaggaagaaaacctgaatccacacatccccaacccaatcttcagcatcactggtagacagctgtctattcccccatgcttcaagcctggtcattcccttcgtgacattgttttgccactgacactaaattgtctctgctgcagacaccaaaggccaagtgaaatgaagccacctccttatttcagagcacaactgcgaccacactgacc

SEQ ID NO: 137731 - DNA, 436 bp, Homo sapiens
tagtcactgtgtttattttatttatacactagaacctgctgctatccttgttgaagaaatagtggtgagtccaggctttggagtcaggaaaacctggatgggagtttcagcttcttcatttattagcagtttgggcaagtttcttaacagttgtaaaccgtagttttcttctttgtaaaataatagtaactacttctttagtgtctatgtgaggattaaatcagatgatcatgtaaagcacttagctatagtacctactacatattaagtgcccaacaaatgttacttatgatacaataggttttacttaacataaaattaactcctaatttcttaaaaaaatatgtcttttgaatgtggacctttcgattttagtcagctaaagcattaagtctgttttcttccactccctcaacttcatagtaacatgtctgtt

SEQ ID NO: 137732 - DNA, 550 bp, Homo sapiens
ttactgggttcaggaaggcaccagatcatcaagatggaatagaattccttaggctccatgttcattgtcaaaaatggcatgaatttggttgttgcagaacctgtgtccaaattatgcatagaagagttgatgtttaacctcagttaagttgctggaatcttctctcatctccacaaaggggatgatacagaccatatcctgggaagggaagactgtaacccacacctgggatagtaactgtcagtctggtctctaaagggctgggtgaccataagcaataactgccttcccattgccatacctcaaaactctgaggcacaaaatccacccacagaaatggtggactccctaggtcattagcagctgagccatccaccctgcaaactctatcacccctaggcacctccaagagtgttacaagaaagaacttaaaaaccacctgaaagaaatggcacatagagaaaaccttccagccgggcgcagtggctcacacctgaaatcccagcactttaggaggccaaggtgggtggatcacctgaggtcaagagtt

SEQ ID NO: 137733 - DNA, 276 bp, Homo sapiens
tcggtaccacctagggaacagacatggttctcctggcatggacactaagtaatatatgcagtggtggtggtagttgtggtaaaaataataagagctaatacacatttatagcacttagatgccagatacctaacctttgtatgcctcattttcttcatgtgtaaaatggtgatagtaatggcatttacgtcatagggttgttaataaggtttaaatgcattaataatatgtaaagagcttaggatagtatctggcatctaagtgctataaatgtgt

SEQ ID NO: 137734 - DNA, 516 bp, Homo sapiens
acctggcgcttgaagataataaatataaattgttattttatgactcttgttattattattgtgatggcatattcttcaccgcagtcttgaccacagcattagaatttactaattctcctgatgggcacacagcacaccagcagctttctcactgcagtgagctcagccttgcgtggaacctgcgccccacctgcactggcggcatgcccgagttgtggcgctgtaggcacaccatgtgcccccttcttaagtgttctgaagtggtaggaggagggagctgtgactaaaataaggtgggctgggcatcatggacccaacaccataaatcattttacaacagatcaggaaagtccttccacctcttttcagagctgtgctataattttccttttcagtagagaaggattaccgggcctctcccttcttggcagtagcaagtacgccagaagctggcaggcttccagagaagggagagccagtttcatttcccacaagtagaaataatactcatgaatc

SEQ ID NO: 137735 - DNA, 469 bp, Homo sapiens
aggtggggagatcacttgaggtcaggagttccagaccagcctggccaacatggtgaaacctcatctctatcaaaaatacaaaaattagccaggcatggtggtatgcacctgtagtcccagctactcaggtgtctgaggcaggaaaatcgcttgaacctggaaggcataggttgcaatgagccaagattgcaccactgccttccagcttgagcaacagagcgagactcttatctccaaaaaacaaacaaacaaacaaacaacaacaaaaaaattggaatgactaaaacattagtattaattctcttacaaatgaaattcctgaatcaaatgatatatcagatactaaagcctctactactgaagcaggacattaaaaatctgctttgccctataaaatgctcttcattccaagacataaaaacaaagtgtgagtctttcacctacctcatattgactcttacggtggaaa

SEQ ID NO: 137736 - DNA, 209 bp, Homo sapiens
agtgtttgttaactccaaacaccaataaatgctgataaataatgctattaaaaacgtgttattgctctgacactttgttataacatctttcctcttacgttttccccatgtaacatttactttaaaaggccccagccaaaagccgaacgccaataaaactgcaccaagtctcccagaacatcttcatttatgaaacagtcaaagactca

SEQ ID NO: 137737 - DNA, 659 bp, Homo sapiens
agctggtacagataaccataccacattgcctgtttttccaaaaaattacatttgggtgatatcaaatgcaaatttttgaactgcattgacagaagtcaggcatgtttagagagttagtaaactttttcagaccacagatcagcattaagtgaaatactgcttcagccactgataccttcatggcagataagtattatactgacttctttttagagacacttctgttcacacacaagacacagaatttgttgaataaagaggaatttgaatgctcatctttgtccgtttctaaccttaggaagaatgaagtttacattatccttaaaaggtattatttgactaatgttaacagcttgtacagaatatttgactattgtccttagataacatttatcaaatattatattgaatgagtattttattctagtggaggaaaatctctcatcatgccttcctactcgtggtttgttttattattatgacaaatggcacatgggtgatcacaatccacttgcaagaaacactgatattctcttgtaactaagtcaaagcttatgccataatgccaacactgttgtcctccttgagtttatcctctctagctttctttgtaaaggcctaaatcagccttgagtacagatatttaaaaagaagacagg

SEQ ID NO: 137738 - DNA, 121 bp, Homo sapiens
agtgatccacccacctcggcctcccaaagtgttgggattacaagcatgagccactgcgcctggccctaagtcttcaagttctgatgtctgttttacccttagagtacatctcagttcagac

SEQ ID NO: 137739 - DNA, 364 bp, Homo sapiens
acggacaccttggccaagagagatttcagcattatctattacgtctaaattgttacaaggagaaggtgttcatatgttagctgtgtaactgagagataactgatatgactaaagtgcttgtctctgggtagaaagcccgtgaggtggattttcccacttccctctgttgtctataatgaatgaccactacatttttaaccccaaaagcttctcatatgaagaggagacttctttcagcagcaggcagggcaccttctctgaagctcgccagcaagcaccaaccgactccctggccacggccaggctgacgcccaggcagtgaccccacacgggagggctctcgaaaaggctggagctcccatga

SEQ ID NO: 137740 - DNA, 521 bp, Homo sapiens
aggctggggtgcagtggctgatcttggctcactgcaagctcactcccgggttcgcgccattctcctgcctcagcctcctgagtagctgggactacggcgcctgccaccatgcccggctaattttttgtatttttagtagagacggggtttcaccgtgttggccaggatggtctcgatctcctgacctcgtgatctgtccgcctcggcctcccaaagtgctgggattacaggcgtgagccaccacgcctggccatctcagtctgatcttctgtaaactgtggatgaattttataataagctgcctgatttggtattgtaagaatcaaataagtgaatgcatctactcaaatatgataagacaagatttagtggtacttagtaagattaaattagtcctaggtaatgatattttaaagaaaactcatctgtatgcaaatcttctaaataaaatttctagcaaaactaatccagttatgagaaaaaatagtgccctatgaacagttttactttaggattgcaag

SEQ ID NO: 137741 - DNA, 247 bp, Homo sapiens
tgtgcccatagtcccacagcaggtaaggaaatgagccaggatttgggcctatgcctgtctgatgtgccaggtcaatttcctttgcagaggctgcctttaattaattaattaattaattttgagacagagtctcgctctgttgcccagactggtctcaaactcctggcctcaagcaatctctcagccttgacctcccaaagtgggtggatcatgaggtcaggagtttgagaccagcctgactaacata

SEQ ID NO: 137742 - DNA, 466 bp, Homo sapiens
cttttcccttaggactcggctcaagcagctgagcatagtgactcaggcctgtaatcccagctactcgggaggctgaggtgggagtatcacaggagcccaggaggccgtggttgtgccactgcactccagtatgagcaacagagtgagaccctgtctcaaaatctcaaaaccaaccaatcatccaaccctcagctcaggcctcacttgcaagaattttttccaaatccccaggttggagagtcttaacacttagcgctaccattgtagtaccaatgtattgaagtaatacgtttttgcattatgcatgtctccagataggttgtgaacttgcagatggcattgaatatcttcttcacctgcctggtactaatggataccagaaataaacctgttcagaagaacatacttgaagccctgctaatggagtccattaagtagaagttaattgtttttctttctttctttt

SEQ ID NO: 137743 - DNA, 216 bp, Homo sapiens
ctgccccccaccccgacacacacatgcagtcatacatggcccctatcctattcctgtggctgcagccaaactgttccccacatccccctgtgcacctactgtgtgcccagcacccacagactcaggcaccacgtgcacgtttaacagaagcctcagccaggcagagcgaggaagacaaccacagtaataaaccagatactctcaaagtcagagcgg

SEQ ID NO: 137744 - DNA, 251 bp, Homo sapiens
tccaaagaaaccatatttcaccttttaaattttcctttagaattaaaaaaattaattttatatatttcggatcctcagataaaatggataagatgtgtagaattttatttaaatcaaatgatgtaagttggccgagcatggtggctcatgcctgtaatcctagctctttgggaagccaagatgggtggatcgcttgagctcaggagttcaagaccagcctgggcaacatggtgaaaccccgtctctacaaa

SEQ ID NO: 137745 - DNA, 245 bp, Homo sapiens
tcaatcagcttctcaggctcatacatagatttaattagtctccagtactgacagtttagtgcatttattcattaagcatcaatattgctgaacaaatgtaaataaaatatagacagagatgctttaaaggggcagtcacagaaacatctgggcgagataatgaggctgggaaagatgtgaatgttaatgagactcccaagctgctggaggagctccagctcttggaagcaagggatctcagtaac

SEQ ID NO: 137746 - DNA, 414 bp, Homo sapiens
tacgatcagctcggtacccgcgagaccccaactgcaatgaagataacataaaaatattaagtctagaaccaagaaatctgttcggggaaaagtaagtgaatattcttcttaaacgatatattaggcttaatttttatctgtttaaaaattttagataaatttgcaaaataattccttctttactatgatatgtaaggctatatattgtaggagattaaatacaaggagttaagcatgtatttaacaattcaaggcaatgtaccaaatgaatggcaaaaactggagagctaaatatgttcagaaagaaaagaaatcactttgaaacaaagtagccaaggaaggaagtgctaggatttgccagctgggcactgaaagagaaagcatcagaaagaattaagagagaatgggtgaact

SEQ ID NO: 137747 - DNA, 852 bp, Homo sapiens
gaagaagataattattaaattgacctcttaggtcatttgcagtcttataatttgaagactttaaaagtctcttaataaatattactggctttcacagttctctcttagtttttaacatactaacgagttattctttttacattttttcttgtgaagttgaagcgtaatagtttgctgagtgttatagtcaagatgaacactgattatcagaaaataaagatttccagggagactggtagttacgtgaaaaaataatagaattcttttgcctctggttttcattccctttgtataaatacaaatgggaatggtttttatctttacattgaaattaaaggtagtacttattaaatattttcttatggattgtcctatattgtttcaggctgaggaaaattggatttataaaattggttgaaatatctgtactttaaaaaatactacttatgctttctgtctgaagtgagaaaaccctattttcagaagctcgtaaaactggcttaatttttcattattggtcttggagaattgtacagttaaaatatattttattatgtattacaagcaggattctgaactattcttggaaagttagcaagtaaaacctagagaagaaggtgaaaatcacggcttccgtaaatctctagatgtagttttccgtgtataggaaaacatgggatagaggagcaagttaaacacaccatgagaaaacaatggattgtactccgaatgtgggacattgcacagaacatttgacctgggttcttttaaattcatgttatgaaaagaaaaaaagacaggagatctgttctagattaaaagagaatgaagagatacaggaaccaaatgcca

SEQ ID NO: 137748 - DNA, 308 bp, Homo sapiens
atgaacaagaaacacaaaaacaaaaacgctaaaaattcttgaagagatgcaaaatcaccaataaggaaagtaattccagttaaagagagatatcacctgaattcctattaggctgatgaaaaattaagcagctgaatgttgcctactgaaggctagaatacaaggttatgtagtagcagctgaatgttgcctactgaaggctagaatataaggttatgtagtagcagctaaatgctgcctactgaaggctagaatataaggttatgtagtagcagctgaatgctgcctagtgatggctagaatataag

SEQ ID NO: 137749 - DNA, 347 bp, Homo sapiens
aaaaaaatctgttaggaccatttggtctagagtgcactttgacttcaatatctctttgttgattctctatctggataatctgttgattgctgaaagtgtatattgaggcaccctaatattatcacatcacattctatctctcctaggaccattaatgcttgctttatgtatccaggagttccattgttgggccatgtatgtttacagttttcatatcctcctgctctattgacccctttatcattatataatggccttctctatcttttcttactgttttgatttaacatctatcatttttggtttccatctgcatgaaatatctttttccgtaccttccctttcag

SEQ ID NO: 137750 - DNA, 228 bp, Homo sapiens
ctgggattataggcgtgagccaccacgcctggccctttttctcttgacttcagtagtaaacagacttctggaaagagggctcctcctctcccttaaattaattcagagggcaagaaacttattaaattattttgttaaagctctttcttttgccctgtagggagaatagtgtagctaggagtggtagaattcaacccaaacccctgtttaaaatatggccatagttag

SEQ ID NO: 137751 - DNA, 198 bp, Homo sapiens
gaatggatggtctatgtcaagactcttgatttttttgcctttaacttatgtaaaaagaacagaatgttcagagttcttaggaaagtttgtgaataaagtgaccacatcccctgatctactgaaacactgaattaagatcagagacttgcgagtttgtattttttccatttcagcaaatccctaggtgcccttggattt

SEQ ID NO: 137752 - DNA, 412 bp, Homo sapiens
acccacaggggaaccacatgatcaacttctcagacacaggctttaaaataactgtgtcaacctgaaaaaaatatactgaaattgagaattcaataaatggatttttaaaattagacacagatgaaaaaagttgataaactgctatataggtcagaattctggccaaacacagtggctcatgcctgtaatcccagcacttggggaggccgaggcgggtggatcacctgaggtcaagagttcaagaccagcctgaccaacatggtgaaaccccatctccactaaaaatacaaaaattagctgggtgtggtggtgggtgcctgtaatcccagctactcaggaggctgaggcaggagaattgcttgaaccccggaggcggaggttgcagtgagctaagatcatgccactgcactcc

SEQ ID NO: 137753 - DNA, 304 bp, Homo sapiens
tgcccaccagaccataatgagccagtctgctcagcctccacactcccaaggacggactactgccggagctgctggcagctgctggaggccacagtgttgccctgggtccacccagcacttgaaccctgaccagaaccctgaacccagcatggtcaggcaggaggctggggccttgggcctcagggggacctggcaaggcctaccccaggaggtcaggctggaaactggaggagactcaactcatgcagaagctcttagctgagtacagcttcctctcccccagtgcatttaagctgcgctttac

SEQ ID NO: 137754 - DNA, 292 bp, Homo sapiens
gtgtgttatgtaggaaattaccattcctgttgtctgtgtaggatgttctaaagatgtagccaggaatctcagaggagagagagaagagacagagagagagagacagacagagagtcagacttgtagttctaatattttcttgcttttgcctctgcctctggtcatacattggattgtttttctgcttttgttccttggggtggcatctgtcttcaggagaaatcactccatagtcaaacacagattgctgaactgtggcatttttgctgttactgttatcctgaatttactg

SEQ ID NO: 137755 - DNA, 502 bp, Homo sapiens
aatcctcctcctccctcctcctctattgaaatgatggtgacaagtaaatggcagttttaaaatatctttacttagcaaaatttaaaaaaaaatttttttaatggcagcccatgtcatggtccccagtggtttttattgtttctatgtttctttttatgggtctataaaatccacaagtctgggaaccacttgttaaatcacataaaacaacaaattaaaaagataattcaaaggatcgattaaatacacgatccacatctcttcttcctttcactgacttatgtaatggaaaattgagctcatttatccttgcctccaggcttagcataaatttaatcagaagattcatcttccttcatatgaaagacttgtcatgtgagataattctagaaaattctgttacaaatactaatttatctcacttcgtaaagaattcaccaagccggtggtggtggctcacgcctgtaatcctagcactttgggaggctgaggcgggcagatc

SEQ ID NO: 137756 - DNA, 347 bp, Homo sapiens
tgtataagagagagaattagaataaatttaaatatccattaatagaagaatggctaaattatggaccaatcatactgtggaataccacacattccttaaaaaggttgaggcagtcatatgtactaacatgaaatgatttccaagattggagaatggagaaaagcaaggcaggataaacgcccacctgggagtgacacagagacagagaaacctcccccacccagggaagcagctctgcagagttggcaggatcaggggctagtctgaacccctagcacagaacactcacctcacggaagagtggccagaatgttttccacataggtcctggtcctcacttctcctca

SEQ ID NO: 137757 - DNA, 315 bp, Homo sapiens
taggtatgagggcatactgaagtgtatgtgtgtacagatgtggcatggtgggggatgggaggggttgtccatgttcttcttaagggccacggattatactcttaccactctgacagaggagaaccctttacttcttcagcatcagaatccttatgcccagtaaccaatgaggctgtgttccaggcctcaacaagaagggacccagacatgactactctttttctctctggccttccattgccttctctgtttatctccacaagcgttctcattttgcctttcttttctttttttttccctctgctattctgctta

SEQ ID NO: 137758 - DNA, 441 bp, Homo sapiens
tcatttttcctaaccagttgcatgtaacaagctgtcggtgtatatctgtggaaatgaatttgtcatcagtgatagcactgcaatatgatgtaattgatacaattcacttatctcacaaaataagcttgctgtttctcctggggggccagggtggttgtatagatcagatctgactttgtccacgtcttctctctgctcaacaaagtgaaggaatcaagccttgtgtgatcaccacagtctgctgtatccagcacgttctcttgtacacgctgggtgcccagtacatccttgcagatgagtgaatggcctgcctttccgtaatacaggctggcgaagcttccctgcgctcatgtctcagaagagatgctctctgctccccgtgcaagtggaatcgtctccctttggagtcattgagaggtgacaggggccgctgtgagtggc

SEQ ID NO: 137759 - DNA, 225 bp, Homo sapiens
tgcctagtgctcactacttgctcgtaagtggaacagtccatcagcattttctagctcatagtgttccaaccccagggcactcaggcccctaacacagagcaggaccagataagaggcagatgaggctgggcaacattcctcatgggactccagaaattcatgaacatctggccaaattccttctagatttaggatcacacctggagtcaaccaactccccattaa

SEQ ID NO: 137760 - DNA, 303 bp, Homo sapiens
ggaagtctacctcttccatactgaaattccatttcagtagccaaattaaaaaaactcctactgggcatcttcctaaaatagatggtgtatttcttgtttttgatgagcctcagggttatcagcaggaacaacataatacagtggggctccagaggcaatcaaaccataggaggctggcttctcaaagttgctcagccttaaaggagataatatgtgtagcttcttgctgttgtttttcatttggtgcttctaactgggtaattagttggattaataagcactgtctgttacctaatttccaga

SEQ ID NO: 137761 - DNA, 421 bp, Homo sapiens
tcatgttcctggttatccctatgcccaaagcttgcctgaggataccctgtggttccacaaaaatacattaccaccacacaatcctagccctgtccatgctggtgactgccagcattgcttccaaactagagcctcaagaaacaagcctaagcactcagatttttctctcaggaattcggggacacctgttgttctatctttaaccagcaggtagcgccaactccccagctaggatgtcaccttggcctcatccctgaagtcggcaccctgccttctattcccactagctatcagcctctaatccatcagcctcatgtgcagcaactgtgtatcagagagagctgtctgagaaatagctttgtttggctgacctaaaagggatgtaaaagaacagcctttttataaaaatagggctgtactt

SEQ ID NO: 137762 - DNA, 309 bp, Homo sapiens
ggaattaatgaaatatgccaaaacagtgtcttgtcaagaaaaacacaatacaggcaatcattgtgcttaaaaaaatactatggtccctttatataccgttgaagccaacccagttataactgacttttactgttaagaactaggctatttgggaggaatgggagaaataattttatcccttgcatatctaaatgcatgtcataatgagccttcatataataggggtcaactgtacattcagtggaaagggaatcattaaaaggcaccctgcctctcaacacacgaagcacttcctctacagcttggcca

SEQ ID NO: 137763 - DNA, 377 bp, Homo sapiens
tctctcccaaggggaagaaaataggcaagaatgcaaagatataaacaaaacaactgtcatgaagttgtttattacagtaaaaaaaaagaattggaagtactcaaatatccatcaacttaaataaaattaaataaatgatgattcacatgcagtcttggaggatgataatgttgatcaagggttcttccctacaggccaggactgagctgcaggggttcaaatgcagctctctcacagggctattgatggattctttgaggctccgtggggtcctccgaccacagctccctgttgtggtgagcactatgggggcaactagtggtaccctcagctgctaactgctggcattcccttgccctggcaggccaccctctttg

SEQ ID NO: 137764 - DNA, 240 bp, Homo sapiens
ggaatagtgctggtgctaacgtgtggtctagtttagaagctgcacaatggctgaagtatttcattgcttgggaagtgaaatggaaagagtagagggactggaaggtgcccagctgtcattattatagtgtctctttgggaccatgcacgaatctctggagatgaccagcataaccccatttcacctttaccactgccactagcttatcaccagcttagtgggagggagcactggctgatg

SEQ ID NO: 137765 - DNA, 429 bp, Homo sapiens
ggaagaatcaaaattattatgtcaacatgaggatgaaagttatgctctgttgtttctcataacatttgtgtgtgtgtgggtgggtgggtgtgtgtgaaaggtaggatcacctctctgtgcctcagtctccccatcatccttcggtggtagatcaatgctatctgatgaggccttttttgggatcacccactccaacatgcatgtcctttctctgtcccctcctggtgcctgtattagtctgttctcacattgatgtaaaggactacctgaggctggctaatgtataaagaaaagaggtttaattggctcatggttccgcaggccatacaggaagcccagttagggaggcctaaggaaacttaaaatcatggcagaagatgaaagggaagcaggcatgttctgcatggctggagtaggaggcaaggagcg

SEQ ID NO: 137766 - DNA, 1813 bp, Homo sapiens
acgaggaggaagcagggctgcccagggaaatgccaccctggagaggcccctgtccctccctctccgtccttccctgtgcccctccgtccctcccatgacacgatccatcgcccgatcaccatcgtccagtcaacgcccgaagcccgagtacacatccgtccatgacgtgacaggcgagcacacattctgattagatagcagagagcatcatagagacaaagagtcagggcaggagcccaggtcggaagcgatgtaactcacagagaaggaacagaacgagcgagatgatgacacaagaacaatagagcaaccgagagacacatcacacagaacaccatgacaataccccgaagaacacacacgaacggggagacaagaataggaggagacagaatcacaagagaagacgagcacacatgagcggacgcaactcaaacagtatgagaatgacaatataatacacatagaacagagacatgggcatcacacgagaccaagtcaacacaaccaggaacgcttgaaaaatacacaagagacctgggagcgcagagaaagacacaggcaaatgctgacagacaacaaaaacagaccatgagagaacacaagagaccacacacggaaaaccacaccggggaagaccacagagaaattccgaatacagccagcacgagcgcaaagagaaagaggaaagaagagagagagaaataacagacaaaaaagaaagaagaaaccacacacaatccaatcaacaaaagaaaaaaacacacacgaaataaaagaaaaagaaacgaactacaaaagccaactaatcaattagaagagcaaacaaaggaaacaaaaaaaaacgaacggcaacaagacacatcaagaaaaagcaacataaaaggactataacacacgactattaaaacacatggaaaaagaaacaaccactcggcatcaatacaacaaacagacgacaaaagcaaaaagaacagaacacaacacactacgaagacaacagcaaaaaaaaaaaaggaataaagagaagaccaaaaacagaaatgagaacaaaaacaaagcacaacacgaaaaacaaagcaagaaaactgaaacaaagaaagaaaaacactgacaactatagtataaaaggacaaccaataaaaagaccaaccacaatgaacgcaacaagccaaaaaaaaagacaaacaaagaaacacaacacacacaacacaagaaaaaagcacaaacaaaaactagcagtcaacacacaaacaaagaagaaaagcagagaagcagaacaaacaactgaaaacacaccacactaagtagacaacaaaaaacgcaagaccacaagaagacagacagcagaaacaaacagccaacacaagaacgcgagaaaacgaacaacaagcaacacaacgacaccagagagagcagacaacagaagagaaacgccaccaaacacagaccccaacaaacggaaaaacaacacacgaagaacaaacagtacaataagatcaacgacatcaaaaagagacgcaaacacagaaaacacaaatacaaaatgacaagcgacaaaacaccaaacaaagaatgagcacaaaccaaacaacacacaaaacactacacaaagcaaacaaaaaccccgacacacagcagcgcccacaaaaccacaacaacaacgaaccaaacaaaacaaaccaaaacaaaaaacgaccagaaacgaaaaaacacaacaacaaaaagaaaacaaaaaacaagatacaaaaaaaaagaatcaaacataaaacgagaaacacaccaagcatagcagcacacaagagcagacgcc

SEQ ID NO: 137767 - DNA, 279 bp, Homo sapiens
ggtcacagccagggacatgagaggaccaaggccaggtccagaagcagggaagaaccagggccagggcagggacatggcagggccagggccatggcaggatcagggtcagcagaaggccagggcagggctagggtggcacagggccaaggcagggcagggtcagtgtagagcaaggaacgggccagggtatggcagggcagggacagggaggtccagggccagagtcaggtccaggacatggacagggcagggccagaaacatggcaggaccagaaaggg

SEQ ID NO: 137768 - DNA, 195 bp, Homo sapiens
tcatgtctcttatctgcccaaactcagtctatcagtgatttagggaagacaatttgcagtccactcgtcacctacaaaggttaatttttgttcataccttactctacggtggttaaatattgtcagctttatgaaaggcactaaaacactgagaattttttgtttgtttgtttttgagacggagttttgctttgt

SEQ ID NO: 137769 - DNA, 476 bp, Homo sapiens
gcttggtcacctccattggtaaccaatattaaaggttactttaatattttcctgtataactgtaagcctggatggcagtgtttatgttgagaatagtttaaatttaggtggccttaaagatatctctgaggtgaacaccagaagagtaaatcatgcttttttactttgttatctttgatattgacagggtgttgagctgaaatttttcataaacatacatagctgccagtagtttcaagtactactagcatttaacacccataagtagttatcattttgcataatctttggcatctcaagttgggtattttcatcaggggctaggaaaatgggaaactagttctaataccgaatttataattgaacttatcaaactgattttaaccaggaacttagacttttcccaattgtagtgttggattttaagaaattattaaacatctttgttatcattaacaaaatgacttcagaattaa

SEQ ID NO: 137770 - DNA, 263 bp, Homo sapiens
acatggcaagaggcaggcaagaacggcagcccccctctcctctgcccctctgtgccacaaaggccaatattcagggggtcattacccagaaggacaccaggacctcatcagtggccaggccccaacccagctctgctcagtctcctagacaaccctccacggcctcaccgagatgggccttcagctttagctccaatgccacctcctccaggaagccctccctgaccacagagctgttgctgttggtcccggctctgtagatg

SEQ ID NO: 137771 - DNA, 511 bp, Homo sapiens
gcatagttttaattcatttactaatgtgagttattttgtccatttaacaaattaggaaaataatcgtgccaacttcacaggtttgttctaaagagaatgaaaaggtatacattttaaaaatacttagtgcttagcagatggtaagcactcaataaatgttagcagttgtcaacatgttaagaaaaaaaattggactatccaggcttgttggaaaaagaaataatgaagaaatgagattttttaggcagaaagtgaaatatccagaattttttattaaagactgtcactgaatagttccacactagaattaaaaaaaaaaagaaaaaaaaaaatgttgttgggcgcggcccggcgcccccggaaaagagcttttcaagaacacttgtttggggacgcgcggggcccagaatagtttaggtgaaccagtgggcaaagacggtgttcccagaagaaaaccgggggagggaacaaggtggcttgggttttctcacaaataaaaaaggccccgggg

SEQ ID NO: 137772 - DNA, 218 bp, Homo sapiens
atgtttgagtatttaggtcattctactttctgctgttacatatagtaattctgtgattaacatttttgctgaaactgacatttttcactgttgcataagatagcttcccaggagtactaggtagacgtatataaacatttaatacatgttcataaacttgaaaaagttttgtcagtttatacaactgtcataatgtatgagtgttcatattataattt

SEQ ID NO: 137773 - DNA, 371 bp, Homo sapiens
attgccccctatcatttggagtaattgactgtgttcaataatatttaatagttcctttatgcattttagtatatttgtcttgataaagtatatgcagaaattggagttaaaaaggatcttgtaaatcagattatagttctcactcctgtacttgagccagcctaggtacattaaatatctgtctagtttaaataattctagaaaagattccacaattttccttagtaacccaaatatgtcattgccttgatttaagccattttcttctggtttgtcctaaatagagatggagaacagctggttaccattcccaatataataacccatatatttctagaacattataaagcattccctcaggtttttcttca

SEQ ID NO: 137774 - DNA, 672 bp, Homo sapiens
tcagcctcccaagtacctgggattacaggcatgtgccaccatgcctggctaattttgtatttttagtagagacggggttttgtcatgttggccaggctggtcttgaactcctcgccttaagagatgtgcccgctttggcctcccaaagtgctggaattacaggcgtaagccattgtgcctggccatgcatctcattttcaaacagtccctatacctttgtcatttaacgttctattcttttagtatgtgaaaaccaaactctaatttacaagtcacaaagaattatccaagacagactcccattgtggacatgtatgtggcattgctgattcacagctactgtactgaagccttggccaccctggaggaccctctctctttttgctggacccttctgcacagtgactgcagtagggagagtcagacctgggagtgggggagaggttttttggattcctctctgggtagatgtgtgttgggaagtagtgaaatgttgatagctgcctggctcatctgatccagtaaacataactggtgcgtttgggttgaaagaaattgggctttccttatcagttctcagttataagaacatcagtcagcagtacattagacttaagctttgcattccttgcgtttttttgtttgtttttctcttcctggaaaaaagtttgc

SEQ ID NO: 137775 - DNA, 207 bp, Homo sapiens
ggcctggtgggatctgaaccgtgaaaggccttcattgttattttttattattgacatacaaaagactgcatacatttaaagtctacatttgatagatttttatgtatgcatacagctttgaaatcatcaccacaatcaaagtgataaacaagtctttcactctcaaaagatttgtgtaagacctttaaagagggaaagtctggcctg

SEQ ID NO: 137776 - DNA, 478 bp, Homo sapiens
ctcaagcaaccctccctcctcagccccccaaagtgttgggattacaggcatgagccactgcacctggccctattctttgttttcaagacaattttggctattctgggttcctttagatgatatttttgtcttaattttctgaggcaatttattggttttaatattttcctaggaaacgggacagaattaattaattaaattcaatattttgtttaagtggatctggaaggagacctttctgtagttatcagtcatctttgactacttcattctcaccacatggtatagggatcttttcagctgtagctcttaaactcctcagaaagtctatgttcacttaactgtctgcattgctattttatagaagcaaatgagtattgtcatgttgtagctgcagtgacacagagttcccatggactgtaactcaagattatgtgtagctagggctagaatgtttctcaaacagaattacttaaaa

SEQ ID NO: 137777 - DNA, 408 bp, Homo sapiens
ttctcatactggatgtctatccaagttcagcaggggattctgctcattgtaacaactccgaccatggctgatagacgtttcctctcggcacatgcttccacagttgctcactgccaaggaaatgtggcagactgctccctggctctcagagctcctgccaggaatggcaaactttccttagcttacatttcactggcaaaggaaaccgagtggccttctctaagcatggcactcctaccatgtgcccacaatgggagatgcgtttgtgaacagcccagtgaccgccacaggatcctcaacttctttagtcattgtcattcctttgaggcgcaagttccaaagaatcattagagaagccatcataattcagaaagagaggaaagagaccatctgtggggttggcactat

SEQ ID NO: 137778 - DNA, 231 bp, Homo sapiens
cccctttttccaggtaaggtaacttgtccccaggttccagggattgagatgtaaacatggggggaccttattctatataccacaggtgcaatgaactatgaggatagcatgaaggtgctgaaaggcagatggtagtataggaaggaatatccaagaaaaaaggagtagaggggaaggcatagaggcatgaaaaagaattaagttatttatggctggaccttgcaattggaa

SEQ ID NO: 137779 - DNA, 231 bp, Homo sapiens
atcgctcggctgacagagggcatgtcatgccggaagatcgcacagctggccgtgtcctggcaggccacggcgtatgcctccaaggacggggtcctgaccgaggccatgatggacgcctgcgtgcaagactttgtccagcagcaccagcagatgatgcgctggctgaagggggagaggcctgggcccgaggacgagcaaccctcatcctgagtccatggggagaccacacct

SEQ ID NO: 137780 - DNA, 581 bp, Homo sapiens
tttcagaactcagtgagactctccatgtgcactgagcatgcactgtgagctaagccctttgccaggttttgcaagaaatcataaaggcagtattagatatggtctctgcccttccagagcttacagtatgagagggaagataaatatctactcctccgaccctcatctcccacacatgatgaaaagtgagtgactaacttctgctatctcatttacattgacctcagatggtgaatcagagtctagacaagaaaatcacacatgtacatggggaaactgaggaaagtttaatgaaaggataatttgtaaagattggacagagttaagagggaccaagaagagatggtgaagtgtcccaggactaacaatagcaggaagtccttacacccaaaggcctgaaagagcaagaagagggagtatttatcagaggccagagagagagctgaaactgcaagagatggcctctctcaggaaggaataaagctaggtcctctctgtagcctacaggaagtgagtcaggggcatttagtaccctaacctctgtcttcagtaccctaacctctctcttcactttctctcta

SEQ ID NO: 137781 - DNA, 206 bp, Homo sapiens
tgcagagcatatacactggagctggggaggctgatgcagtggacggcaggattgaaattatttaggagttgaagtgccacaagatgaatggtgtgaagctgacaggcacaatctcaagctagatctgatccacagatgtgatcctgaaggtggcacacgcgtactgtggagtaccagcagcctagcatacagcccatctcatacat

SEQ ID NO: 137782 - DNA, 303 bp, Homo sapiens
ctcacccgcctcacattttccgccaacctcctaactggctcccccagcacactcgccatcgggctccttcttaaggcggaaggtgcccgggatcggggagggaaaccaccgaattcgatgacacgatgggtttcttctccccacaactgacccctcaacccgtctccaaatggcgattctaaagcccaatttcatctccccgagaacaaaacttgttaacttttaatccccgcatccgtgcggccagcatgtactccgcgccgggcactgggttgcccgtgacatatgctcattaaacattta

SEQ ID NO: 137783 - DNA, 154 bp, Homo sapiens
ttcacccttgaggaggacacgggacttccccaggaacctcccgtcaatcctgttgaggctcctgaaatggtggaatgacgtggactttggaaccacgcagacctgggtttaaatcccaggccaggcacggtggctcatgactgtaatcccaaca

SEQ ID NO: 137784 - DNA, 532 bp, Homo sapiens
tttgcatccctgtgtcagaacagttcatgtaccccataaatatatacacctaatatatacccgaaaattatgcaaaatgaaacatataaaaatgcaagaaataagtgtcttttaaaagtacgaaaatagaaagctttttcttttctttctgttatttgtgtctcatttgctgtcttgctgtgtctcacattctgtggtggtttttcatttcctgttatgattccatgtaaagaaaaattaaaattttaagttattagcatgggttttactatttatatttatattgtcacaataccgttttaaatgcaaacatatgcatttaacttgtataaagaatcatcaaaattacacagtttgcattttatagctcatgcatgcatatattacttttgccagaacagtgaaaacttgcacaaaactaaactgttttaattcatttcttgatatatgcacattctatcaagactctctagatttggcttactgatgagtaaagaaggactgaaggaaaagaaattatggcttgcctata

SEQ ID NO: 137785 - DNA, 363 bp, Homo sapiens
gtggtgggcgcctgtaatcccagatgcttgggaggctgaggcaggagaattgcttgaacccatgaggcagaagttgcagtgagctgacagcgcgcacagtcttggctcactgcaacctctgcctctaaaaaagttttttttagacctctgttattgtcacaactttaaaaagttttcaggctcaaattctagataagtagaaatttttattgtttacccttacttaaatttgaggtttccttcagtgcccaatccttgtgactgctagctaatttcccaaagtcataaagaagtctctcaaaaataactaatattcagccaggcgtggtggctcacgcctgtaatcctagcactttgggaggc

SEQ ID NO: 137786 - DNA, 258 bp, Homo sapiens
ttcttggatctgtggtttgatgtttttcctcagttttggagaattttcagccttcgtctgttcttcgaatatttcttctgttccatttctccctttccgcttttctgaaactgaaattacatgtaggttagatcatttcattgtatcctttatacctcttaccttctctttggtatttttttataaatctttttgcttctctctgcttcattctagatacttccttttgacctatttaccagctcactaattctctct

SEQ ID NO: 137787 - DNA, 356 bp, Homo sapiens
actagtgagacaaactggacagccatgtcacagaggactcaggctcacacatatttctctgcttgcttcttcatttccaaaagtcagtagcaagcattattgtcacagttcctagtcacaggttctccatagaaactacaggggctgaggaatatatctggggagaagagacaatctgtgacatggacttaaatatagcattgaaaggagtgttgagggaaaggctcgtgtattgcagaatgatggttagttatgagagagagctagagacaggcctcagggctttttttctgtctgttccctttcctaaaatgtattattttccaaccacaaagaagactttttatctcccagtg

SEQ ID NO: 137788 - DNA, 250 bp, Homo sapiens
cattctcctgcctcagcctcccagttagctgggactacaggctcctgccaccatgctcggctaattttttgtatttttagtagagacggggtttcatcctgttagccatgatggtcttgatctcctgacctcgtgatccacccgcctcggcctcccaaagggattacaggcatgagccatctcctttttcattgtttcttctctctttttagccgtctttcatatttctcttaacatttttatttttgag

SEQ ID NO: 137789 - DNA, 852 bp, Homo sapiens
tagaacatttttcattgatgcctctaatcagagcttgactgccattcctttggagatcttcacattcacagaattagaagaagtgcatttggagaataaccagattgaagaaattccccaggagattcagcgtttaaagaacatcagggtcctctacctggataagaacaacctgaggagcctgtgcccggcgctggggctgctgagcagcctggagagcctggacctgagctacaaccccatcttctcctcctcccttgtcgttgtcagcttcctccacgccctgcgcgagctccggctctaccagaccgacctgaaggaaattcccgtcgtcatctttaaaaacctccaccatctcgagctgctcggactgaccggaaaccacctgaaatgtctgcccaaggaaatagtgaaccagaccaagctgagggagatctacctgaagcgaaaccagtttgaagttttcccccaggagctctgtgttctctacaccctggaaatcattgacctggacgagaacaaaataggtgccatcccagaagagatcggacacctgacggggctgcagaagttctatatggcttctaacaaccttcccgttctgcccgcgtccttgtgccagtgtagccaactgtcggtgctcgatttatcccacaacctcctccactccatcccgaagagcttcgccgagctcaggaagatgacggaaatcgggctgagcgggaaccgcctggagaaggtgccacgcctcatttgcaggtggacctcgctgcacctgctctacctgggaaacaccggcctgcacaggctgcggggctccttcaggtgcctggtcaacttgcgcttcctgga

SEQ ID NO: 137790 - DNA, 160 bp, Homo sapiens
ttttagactcagcaacatcacagacaagaaaggaatcctatggattaaagttcttcactataagttttttttttcctccagttcaaatgggtaacgtgccaatgtagtaaaggtttgagggaggcacgtctgacacaggcacatgaacacccagtcatca

SEQ ID NO: 137791 - DNA, 1944 bp, Homo sapiens
caacactttaggaggccaaggcaggaggatcacttgaggtcaagagttcaagaccaacctggtcaatataataagaacctgtctttatgacttcttttttttttttaattatccaggcatggtggtacacaccagtagtcccagctacttgggaagcttaggcgggagggttacttgaacccaggaggtcaaggcttcagtaagcagtgattgtggtactacattcctgtctgggtgacagagtgagaccctgtctcaacaacaaaaaaggatctttccacctcagcctctctggtagctaggactacaggcacacagcactatgcccagctaataaaaaataataattttttatagaggtggggtccgctatattttccaggctagtcccaatctcatagcttcaagcagtcgtccagccttgacctctcaaaatgctgggattacaggtgtaagccaccgtgccctgcccatgataaatattttaattttgcctgataagtcataaaaagtttattcaacaccttaaatagatttctcaattttttaaaaatattaaacctttgaaatcgaaagtaatttttggatttcacccctttattgcaaggtttttgatgtctgtgggaaaaacccctgaattgcttgtgaaactctggatatgtaattttttttctttttctgaacagagtaaaatcttggatgggccatgatccaaaaatcatggttttgaaagtagaccgtactataagccataatcacaaatctgaggtaatagttgtgaaagtgtttaaaacatcctgaaaacaatgttgaaaaaaaaaatctatgataaaaactataaaatctctgcatatgttatactgtattgaacttgaaactttgaaggaattagagtagataagacattaatggtagaagagaaaccacaggggtgaattatatcctacaaaagagaaatcttcatgatttaacctttttttctgagtgacttttattttgccttattaacagaaacctgagaaagtatgttgctttgtattaaatggttgagaccattatttgatataaaagctgaaaatttaatttttgtattttggagaattctgtggttccaagtaattgaaagaatgactaaagctgtatgtcatagaccctgctaaaatgaaataacttgttgggaacattccatgcagatttccaaaatgtattttaccttattattagagaaagaaaataaacttttaaaataatctgataactagcattcatatatttaataagtattttggttacagaagggaaggtgatactgtacattgtaactgctgagacttttttttaaccaatgtctttggtagatagcgaggcacaattattttctcttagggaggattttgaatacctattgcaggcgtgagccaccgctgctggctctttttactttagattgtatctgcctgatttgacaatgccaaattttttatgtaatcaccatttggtttgggactgagagctctttcattttctaccagtcaaaccactattagagtcttcatgttacttccccaatttgctagcaaggtagaatcagcatggatagcttattttccttattggaattctgttttggaagaggcaggtcttatagcagggcagactaattaatgtgctgaactcattccctcctgcttaagtgaataaaaacttttatttgactatggattataaagattgcctttaaggagccttgtttattttggggaaggagaatggatattttgtaggagaaaaagactttatatagtaaatgaaaagtctatgggctgggtgtagtggctcatacctttaatcccaacactttgggatgccaaggtaggagtattgcttgagctcaggagatcgagaccagggagactgcatctctatttttaattaaaaaaaaaa

SEQ ID NO: 137792 - DNA, 263 bp, Homo sapiens
gccaggctgatctcaaactcctgaccttaggtgatcttcccgccttggcctcctaaagtgctgggattacaggcgtgagccaccgctgctggctctttttactttagattgtatctgcctgatttgacaatgccaaattttttatgtaatcaccatttggtttgggactgagagctctttcattttctaccagtcaaaccactattagagtcttcatgttacttccccaatttgctagcaaggtagaatcagcatggatagct

SEQ ID NO: 137793 - DNA, 270 bp, Homo sapiens
ctcgggtgttccagcagtgagaatttggatacacttacttcaagccgagtaagttaaagtacctccaattcagagatgaagagctacaagaagtctgcctgaataatgttaaattggcattaaggaactgcatttattcagttattttgcctttgctaatgactttagctaagtccttcacctgcccacttctccagcccagggatctttcttaaacctatatccttgttttgtataatttatcagcatctgaaattatcttatatattt

SEQ ID NO: 137794 - DNA, 989 bp, Homo sapiens
tagaaaacaatgcttttggacttacattgccacggcagtttacacagttttattcccaaaaattgtagttttgtgactaggtgataaaaatgatctcctatatgtgccaaacttggtattctagacactcatacttaggatgtaaattgactgtagtccaataatttaatatgttgtgtttaattcttgtaatattttactcacaaattgaacttttccttaccaatttaatgtttgtaggcttaatttggcatctttgtcaggattattagacttctctgcattcttctgacttctccctaaactaatgtttagaactgaattgggtccagcaatttaagtggaaaatcagtatgactagagacttctagaaacttctggtgtcactgagatggtgaatttgatgattctgaccctacttgctcatctgtaaaagctattagaggattgttttaagcatttctattctatacaggtatatgtacaccatgtaataccactcagccataaaaaagaatgaaataacatttttgcagcaatttgggtggagctgtaggccattattctaagtgaagtaactcaggaatacaaaactgaataccatatgttctcacaagcgggagctaagtcatgggtacgcaaaggcatacagaatagtaaaatagactttggagactgagacgcggggagaataggaagaagataagggataaaaaacgatatattgggtacaatgtatgctactttggtgatgggtgtagtaaaatctcagacttcaccactatacatttcatccatgtaacccaaaaccacttgtactccaaaagctattgaaataaaaaagatatttaaaaaaaaagaggccaggcaggttggttcacgcctgtaatcccagcactttgggaggctgaggcgggcggatcacttgaggtcaggagttcgggaccagcctgaccaacatggtgaaaacctgtctctactgaaaaaaa

SEQ ID NO: 137795 - DNA, 583 bp, Homo sapiens
agacttttcacagggaaaggttaagttagagatgcccaatggtccacattcctactgtgaacccctggaattttagtcacaggagagaccctagccccttgcaggacaaaaaattcacatagagggctgcccagagacagcacaaaagcatttcctattccagtgaggaagttcacactgggtcccacgctccccccgagtcctaagcagctacagcaaggtgatattttgaagcccagctcacaacagaatgcgtactcccctggggcccagtggcatcgtaaaaaagaatgtaatcatgtcattcacagcaacatggatggaactgaaggtcattatgtcgagtgaaataagccaggaactgaaagacaaatataacaagttctcattcatatgtgggagctaaaaagttgatcacatgaaggtagagtggattggtagcagagactggcaaggttatatgggtgggaagagggaaatgaagagatgttggttaatgggcacaaaaatacagacagaaggaacaagttcaaatgtttgatagaagagtagggtgactatagttaacaaccaatgtattgta

SEQ ID NO: 137796 - DNA, 434 bp, Homo sapiens
ggacataaatggcagatgaggatgagtttcttttctcaaactgactactggtaatgcttcttagagcactgtgcataaagcattcttaggccaagcccaggctctgtaggaatgatcctatgataaattacctatatttatcatagattttggaaagtatgatgatgacatgcatgccatacttctgccatggcaagtactagaatttcgcagaatgcattttacttttctgacttcccactattttccttctattttacaaattcgcttttccttgttgtattttatgtatccattagaaatgcacactaatacaatggtgtattagtctgttctcatgctgctgataaagacataccccagatgggtcaatttataaaggaaataggtttaattgactcacaattcagcatggctggggaggcctcaggaaa

SEQ ID NO: 137797 - DNA, 275 bp, Homo sapiens
tttttgtattcttagagacggggtttcaccatgttcatgttagccaggctgatctcgaactcttgacctcgtgatctgcccacctcggcctcccaaaatgctgggattacaggcatgagccaccacacccggccattgtgtatgcattctttatggatgagaattaaggtatttggtctgcagaaggatccagcttccagaggccaaagagagatggagtttagatggaaaaatattcagatttggaggacgttctccatggcgtggggagagag

SEQ ID NO: 137798 - DNA, 206 bp, Homo sapiens
tattaagcatgagttgggacaactattctaaccagagaaattggctccagtgagggcagtttggcaatccaaggtatggcatgtctatggctggcaaaattcagggtgactgaagcaaaagtttcaaaaccataaagactacaacgggggtagagcacaaaattctcaagagatgaatctttgtaagagtgaggcagaactacatg

SEQ ID NO: 137799 - DNA, 157 bp, Homo sapiens
caagtaccaaacaccaaggaaacactaaggagagaaaaacgcctgtgagaagaaaaaggaagacacgaatcattcccaacagaagctgttaccatgaaggaagtacgggcaggggcatttgttgaatgtctactatgggagaaggggttcgcatcat

SEQ ID NO: 137800 - DNA, 223 bp, Homo sapiens
aaacaagagggaataaatatcacatatgacctcaaaagggtagtaaaaaattgacaggcaataattatatgttctaagagattatatctaagagaagatataattactgttttggtccagaatgattatatcattattttgaagaggaaaagctaattttaaaatatgttaattgctttctttcaaataatgtttaagctttaatatccaatttatcatttaa

SEQ ID NO: 137801 - DNA, 347 bp, Homo sapiens
actgcagtaatgtacacaccatctgtcctaggttctagtaaaaaatatcagtattgtttattgttttatgatttggatacacactgagatggagtttatatttccttccccaagatccttgaagaaaaaagacacagtgaacaacttggtatccagcatccctgcccaggcataaccctaacactcatgcaccagcactgaaggccctcccctctcccttacagggtcttcacctaatgacaaagtcatgggcagtctctgttcagctgtcacctggacgccctgagtcccagactatagaagggccccagggtgtggagtggggctgtggggccctccctcgggct

SEQ ID NO: 137802 - DNA, 294 bp, Homo sapiens
tccaggctgcccttgccagagctgcttcaagatccctcttgattgtccttaggcctgattgctctggagagccccatacatgaaagccagctcttgttctatctcttctcactccagtcctctctgcccccaccgtcccccagctgggcattatgagaaaagcaagatgactatgagtattgtgattatttatatgaacaaataatctcaaggactattgctaactaacccatgggactcccactaccttcatgaggtttggacgaggtgaaggatccctaaaatcctgccacc

SEQ ID NO: 137803 - DNA, 406 bp, Homo sapiens
ggtggctactacactggatgacacagctacattggtacactctctgggagaaagatctttggttttcattatttacatactcccagtttctatcagtgcaaggcacagagtattcctagactgaactcatctactgaagttgtataggaatattttctattttctagaaggctttcctttcaaaagcatgttttgactggaaggtgcaagcataagcacacacaaaaaatgcctaaactttcaagataaatcagtaatgaccagagaaaagccaaaaaccctaggttttataaccaggctaaagaatcaataaattccaaaaaggaaaagtactagcaaagaagtttgaagctgatattccatgacccatgtattaatgtgttctcacactgctaataaagacata

SEQ ID NO: 137804 - DNA, 491 bp, Homo sapiens
tgaggaagaggggaggagtaaaagggagtagagggagtttgtgtctagaaaaatctgtgtagaagtcttgttctttttaagagaaattgtgtaaggtcaatggctcttctaattgtgcaattcaaaaaattaagtcattctgaaggtgaagataataagtgaaataaaatggttcttagcacctcaatgcatatataactggccgtgataaattatactcatggacaattcatatagcctcatatagctacatgttcattcatgaaaagatcctgaatgttattctgatagagtagttttaaatctgaaaattactttatcacacttgaaagtttattgttaatttctcccttcactgcttctttctttctttctttctttctctttctttctttctttctttctttctttctttctttctttctttctttcttttggcccggcctgggggaaaggtgggggatcctttaaattggaccggcgggcttgca

SEQ ID NO: 137805 - DNA, 462 bp, Homo sapiens
cagcagtgggcacttgtaatcccagctacttgaggaggctgaggcaggagaatcggttgaaccccagaggcggagttctaaagtgagccgatatcacaccacttcattcctgcctgggcaacaagagtaaaattccatcttaaaaaaaaaaagctagaggatctgcagttatgaactttgatagccattaactgactagatcttcaacctaaacgggttaaaagagggggaaagaaaatggaatggtaaaaagaactagatggaaaaaggaatgaagtaagaagtgatatgcaaaataattgtcatcttctccgtgcctcccattccctcagtctagtcgaggtctttccacctggccatgtttcttttcctcagataaagcaagctcattctcaccttaggactttcaaaccaactattccctaaccttggagtgcttttcttattttggctgagttgtct

SEQ ID NO: 137806 - DNA, 466 bp, Homo sapiens
atgagccaccgcgcccggccaactcctgaactttctatggtggagtcatttttgtcttttacgttttaagactcacacagatgtttgcaaaaacaccgttagctgaaagtggaaagtttggtgatgggtattttgcttctaggaagcaaaaacatcagagtgacacatcatggatcaggattctgaagaggaatctctcccagacatttatggagagttaagagaagtacctttgtgagcacgtgattcctgccttctatttttttttttttgttattatttatttttttgagacggagtctcactctgttgcccaggctggagtgcagtggtttgatctcggctcactgcaacgtccgtctcctgggttcaactgattctctcacctcagcctcccaagtagctgggattacaggcatgcaccaccacgcccagctaatttttttttttttttttttcattttta

SEQ ID NO: 137807 - DNA, 117 bp, Homo sapiens
gcagtgtggacctcctgagctcaagcgagcctccccagtatctgggattataagtgtgtgctaccacatctggctacttgttgtatttttcatggagaaagattttgccatgttgct

SEQ ID NO: 137808 - DNA, 620 bp, Homo sapiens
tgctgggattacaggcatgagccaccgcacccagcccaggctaggttctatatgggtgtgctttttagaatttagatcatgggctatccccaacacaaactggataatgtttctttctagattctctctaagcgtgtattctctttctttcctaggcacagccaccacttcacttacattgtgggattataatttcatgagtagtggaatttccttaaccttctcttgtgtgggagctgaaggacaaaatgagatattctctgaagagtggttacatcatgcaaaactatgatgtgtaatgaggtcacttagttttctaagtacattatacattttgataagattttcatagaaaagcttgtctcctgcctcagcctcctgactagatgggactacaggcgcccgccacgatgcccggctaattttttgtatttttagtagagacggggtttcaccatgttaggatggtctcgatctcctgacctcgtgatccacccgcctcggcctcccaaagtgctgggattacaagcgtgagccaccgcgcccaacccaggctaggttctatatgggtgtgctttttagaatttagatcatgctatcccccacacaaactggataac

SEQ ID NO: 137809 - DNA, 597 bp, Homo sapiens
agccgggtagactgtatgggtggctagacccagaagagagacaacaatcactgcagttcagctcacaggaagccacacccataggaaaagggggagagtactacatcaagggaacaccccgtggggcaaaagaatctgaacaacagcctttagccctagaccttccctctgacagagcctacccaaatgagaaggaaccagaaaaccaaccgtggtaatatgacaaaacaaggttattctaacaccacccccccaaaaaaccacactagttcaccagcaatggatccaaaccaagaagaaatccttgatttacctgaaaaagaattgaagaggttagttattaagctaatcagggggataccagagaaaggcaaagcccaatgcaaggaaatccaaaaactggcacaagaagtgaagggagaaatattcatggaaataggtagcttaaagaaaaaacaataaaaaattcaggaaactttggacactcttttaaaaatgcaaaatgccctggaaagtctcagcaatagaattgaacaagtagaagaaagaaattcagagcttgaagacaaggtcttcaaattaacccaatccaacaaa

SEQ ID NO: 137810 - DNA, 481 bp, Homo sapiens
atgaaagaaatttaagagaacttaattgaatatgaagacatcccgtattcatagattgaaagaattaacattgttacaatgaccatactgctcaaagcaatctacagattccatgtaattcctttaaaaataccaataatattcttcacagaaaaagaaaaaaaaatcttaaaatttatatggaatcaaaaaagagcttgaaaaaccaaagcaatcctaagtaataacaacaaagctggagacatcacactacctgactttaaaatatattacaagaatatagtgaccaaaacaatatggtatgataggaaaaatggtacatagaccaacagaacagaatagagaacccagaaataaatccatgcgttttttatccaaatgatttttggaaaagttgtcaagaatattcaatgaggaaagaacatccttttcaataaatagtgctgggagtatttgatatccatatgcagaagacagaaac

SEQ ID NO: 137811 - DNA, 371 bp, Homo sapiens
tttggatattcaggttgaatataagatgtctgcggaacatctagggagcagctaggtgtatggattttgtgcccagaagagaagtccaggctgggaaacaatgtcatttgatgtccactgaaggaattttaaatgcttactctagacaggagtacttgaaaactgcttttacatgtataaagagctttcatacttgcaaagaatttggtgtggctgtgtagcccgaagaagtttaatctaggaacaagcagtagaaaatagattttggtatggcctaaagaaaagctttctaatagggcagcctgatgaaataagctgccttgagatataacgagcactctgtcagtggaggtactcaaaccataggctag

SEQ ID NO: 137812 - DNA, 430 bp, Homo sapiens
tcaggcacaggggatgaggtaaagccaacacagaagtaagactcatggttgggtattggagttggtccaagacctagtgcaatgtgatgctgacatgaagagggcagagatgaagctccttaaatctttcctggggttaggattgaccccaaaggctgatgtgaggctggacttagatacaagtcaagaatgtcaagtaaaggaagaaaagagtggagggactaggaactagcaaaatctgacagtgaatctatattctgtctttatgatcctgaaaaaataaataaaattaaaaaagcattctaaccatttcaatcatgaaaataattatgacaaattcataaataacagattacatttaaaaaaactggataaaatggaatttcggattccttattgttttccctttgatttttcagtatttttttct

SEQ ID NO: 137813 - DNA, 708 bp, Homo sapiens
acaaacttttgtgatattgcaagaagaatgaggaaataaatatgagaaagtatattaggagaaggataagaaacaggtttcattatgaacaaagatttagagattaaaataatgataacctcactcaatctctttgtcaattattaggaataaagttggaggaaaacttatctacactccatgtggttctgttcttcccaagacattcttggctcagccaaagcaatgcagagactgctaagtatatgtggagtctgtcatagttaagggatataaatatggatccagagattctctgcaacagaaagactgttcttgacaatcactgtataatagtaaaaatgcagtttataacattgcgttacctaagtgttttgaatgtttcttattcacatttacatgagagaattgttctcccagttaaacaaaaataacatatcagggtctgaaatttacaaataaatcaagtttatatggtgttcaaccaatctgaatttgtgtttatgggtaatgttgaaggttcctttatggtgtggtactcattgcactttggaaaggctgtgagaaagttcccataagccgaagttgttttaatgacaaatagtgaagttatgatcaaggattttaaagaagggaagacacttagaaatagtctagtctaagccctcaccttacacttgaaaaaattgaggccctttgtgattgacc

SEQ ID NO: 137814 - DNA, 506 bp, Homo sapiens
  misc_feature (289)..(289): n is a, c, g, or t
ttggataggctgttggagaggcttggaatggagatattaatttgggattcatgggcatctagctgcatttaagtccctaggactagccaaccgtggactagtactagtccacggttggctgtactaatttacattcccaccaacagtctacaagcgttcccttttctccacattcttgccagcacttgttctctttcatttttgttaatcaccattctaacaagtaggaggtaataattcattgtggttttgtgatcggagatgttgagcattttttcacgtatctatnggccattgtatgtcatctttagagaaatgtctatttattcaggtactttgttcattttttatttgagttgttttcttcctactgagttgtttgagtaccttatgtattttggacattaaccccttatcagatgaatactttgcaaatatttctcccattccattggttgtctctttactctgcggattgtttcctttgctatgcagagtaaagagcc

SEQ ID NO: 137815 - DNA, 364 bp, Homo sapiens
caatccaaaattacttggcatatggagacccatggacatttcaactcctatgagaacagactcaacagacacccatgccattatgaagtatatgttggaattatcttacaaagaatgaaggcacgtatttttaaaaacatgcaggccaggcacggtcactcacacctgtaatcccagaactttgggaagccgagtctggcagatcacttgaggtcaggagttggagaccagcctgaccaacatggtgaaaccccatctcttccaaaaaatacaaaaattagtgctgatgcatgcctcagactcccgaataggtgggataacaggcgcccgccagcagggcccagctaatttgtgtgttaatgtt

SEQ ID NO: 137816 - DNA, 394 bp, Homo sapiens
aggctggggcaatatggactgcacctgagctagcaggacagggtgggcaggtgggcagggccgcagactttgctccttttgggagatccgtaggcagctccccggcgctatgcctactggggccttcatgctggcatttggcccagtcaggaagtctaggctaggtgtggcctagaagacagcattgcctcaaaccaactcatgccagcgagcactgactagccacccactctgtgcccagctctgtgctgggagctttggaggttacttcatggaaatgaatccccttaacagcagtgaaatgtaggcaagagacccattgatttgttcattcactcattcacacgttctttacaccaaactttgctgagtaccacttcattccagagaatac

SEQ ID NO: 137817 - DNA, 292 bp, Homo sapiens
cccgagccgtggcttcctgtccgggaacggcccggcgtcctggctgtccagctagtcctggcgcctctctctggggcttcaccgcccgaccccgcggcggagcctgcttctctcggacctccagagacctcggatccgtccgagcacctgccctagtcctgcctggtcccccaggacagtcccaagccactcctccccaggcgagcacagcgaagggtgcgcgggattgccaagccagttcctcttgatggcagtattgctccagaaatgcccacctgcccttcccccacgt

SEQ ID NO: 137818 - DNA, 435 bp, Homo sapiens
agctgggattacaggcatgtgccatcagtcctggctaatttttttgtatttttagtagagacagggtttcaccatgttggtcaggctggtctcgaactcctgacctcagatgatctgtctaccttggcctcccaaagtgctgggattacaggcgtgagccactgcacgcagccccgaattacaatttttgagtatgtatagtatattgtatgtcaatcattcctcaagctattaaaaaagaaaaacaaagcagccgctcagacttactggaacgacggaaacgcccaaccaacattcatggttcactcaattaatatttactgagcccctactatgtgctagagtctgttctcagcactggagtcgcagcagaatcaaaagtccctgcccttgccagccttactaattctggtgggcaagataaacaataaatat

SEQ ID NO: 137819 - DNA, 414 bp, Homo sapiens
atgtatattattattttctgtctcctgccactagaatgtaagctgcaagatcaggaatctgtggcttagaggtgtatcccacagctctaaaacagggcctggctcaaaggaggcactttatgaatccctactgagtgagtgaatggatgagtgagggaaggagggagtgaatgagtgagggagtgaatgaatgagtgagtgagtgaatgagtaagggagtgagtgagtgagttaatgagtgagtgaatgaatgagttaatgagtgagggagtgagtgaatgagggagtgagttagagagtgaatgagtgagggagtgagtgaatgagtcagtgagtcaatgagtgagtgaatgagtgaggaagtgaatgaatgagtgaatgaatgagtaaaggagtgagtgagttaatgagtga

SEQ ID NO: 137820 - DNA, 302 bp, Homo sapiens
gtctacatgatctgtaaactcttaatcctgagagtctttgatttcacttggagtgttttctttgaagagactttattggttaagagttgcattcatttcctgactactttgaaaagtaaattccctttaaaagtagacttatagctatagattatgttgcttgctattgtatctccagcacttaaaatagcctctgacacatggttgatgctgaagtatagtaacaataatatcgaagcacaccctaaatatgaggctctttattcagtaattatgatttatatatacaaagcaacccactg

SEQ ID NO: 137821 - DNA, 583 bp, Homo sapiens
tactcaataatcaaaatattctgtggtataagtacctttacattgttgtgtggctatcatcacgcctcatcttcagaactttttcatcttactcaactgaaactctatacctattaaatattaatttatcattttcttccccccacctatcctagctgcaaccattgtactttgtctttatgaatgtgaactattcttggtaggttatataattgtaatcatacagtatttattcttttgtgaatggatatttcacttggagtagtgtcatcaagattcttccacgctgtagcgtatgtcagaatgttcttctatctaaggctgaataatataccattgtatgcatataccacattttgtttatccattgacccacttccattgattgctttcatcctctggctgttgtgaataatgctactataactgtgggtgtacaactacctctttgaaacctactttcaatctttttggaaatactgtatgaccggaagtgaaattgctggatcaaatggtagttctatttttaatttttagagaaaccaccatagtcttttccatagcagcttcatcattttacatt

SEQ ID NO: 137822 - DNA, 268 bp, Homo sapiens
aaacctgcacgttgtacacatgtaccctagaacttaaaagcataataaaaaaatttttagtgtaaatattttatatattccaaattttccttcaaaaatttaaaaccaattcactatcttaccaataatgtattaagatgaccatttcaggccaggcacagtggctaatgcctgtaatcccagcactttgggatgctgaggcaggaggatggcttgagcctaggagtttgagactagcctgggcaacatagtgagactccatttctac

SEQ ID NO: 137823 - DNA, 150 bp, Homo sapiens
gagtttacaaaatgtttaattggaccagaatttaaaaaagaactctaaaaactgcaaacattaactaagcaattactaggtgttcatttcttcttggggaccaaatcaagacagagaaatgtgcaagatcatctttctttttttaaatca

SEQ ID NO: 137824 - DNA, 317 bp, Homo sapiens
cccaaattcagagctccctgcagcccactcgcctggtctgtagtgggaaagcctttggcaggatcgtaagacggtggtgtgctagccgtggcttgctgtggaactatctggagcttggtagagtctgtatatctggcttctagggaggctctacttctggctgccatgggtaggttagttaacctctcttgacttcagtgacctcatgtgtaaagtgggggaaaggccatgccttctcccggaaagcttaggagaatttaatccgacgttaatgtgaagcctgtatagcccagtgccgggtgcagagaagtttagtt

SEQ ID NO: 137825 - DNA, 377 bp, Homo sapiens
  misc_feature (1)..(1): n is a, c, g, or t
  misc_feature (19)..(20): n is a, c, g, or t
  misc_feature (24)..(24): n is a, c, g, or t
ntgctagaggatcgctccnngggncccttaaccctttaaggtgaaatacaccatctaaatgtaaatataaatgatacttcctcaacataagtttcttcttatactatttcaataaatctcagatctgcttttattctttctcttccatgccaccaataccacttttcttcttaattttactgttagatatgttgtttttggaagaagtatagagggaatggtagtaaagagagagtgctttaggattcaatacattcttttgaacagtaacatttagagaatctgtactccatagtggtatcactgcacatttttaagagcatcttgtatctagaacagataaggaattcatgtgacgtaagaaaaggtgtcactgt

SEQ ID NO: 137826 - DNA, 293 bp, Homo sapiens
tgtccagtccatcctaacctgtatattctttccaggttactgtcattgccatcaaacccaggagaacacttggggttgcatctcctcagacaaaactctgtaccgtgctgtgtcacagcctgaaaaggacacttcccacagaaaatcaggcaaggggcaggttctgagcttccctccaaagctggagaacaggctccacaaagctcaactggagaaatcatgagaattatctaaaagtaaatctagttagtatactatagaaaaatctgcagaagccttctgtgaatgggctg

SEQ ID NO: 137827 - DNA, 281 bp, Homo sapiens
tggatggacccctcggctcttctttctgcttcccaattcttagcatgtgcttgctcatagttggctctaaccaggtgtttgaatgaagaagtcttggtaagaattttgaggctgtttcattcagcacggaggattcccagtaacgttattttatctgccgtgaacataaaaagagaaggccgataacttaagttctgggtatccatggtctcttgctcaagaaagaatttccaacctgtagagaatgaatggattttccaacaaaaggcattaatgtgatt

SEQ ID NO: 137828 - DNA, 113 bp, Homo sapiens
ctttaccgtaccaataatcagagaattatctatctctgattttatgactagaccctcttcaaccccacatccacaattactccagtggggttgaagagagtctccgtcgaact

SEQ ID NO: 137829 - DNA, 242 bp, Homo sapiens
aaactatgatcagagctgtgttgggaaaaatctttgattgattttcaatcctggctgcacaacagaaccattgtatggcgcttttaatagtagagggaactgggccccactccaagcttgtttaattactatgaccagagtgtgtggctcagatatatatctatatctatagatctatctatatatatgtctatatgtatgtgtatgtatatatttaaggctccataggtgattctggtgtg

SEQ ID NO: 137830 - DNA, 316 bp, Homo sapiens
acagttaccctcatcaccactccctcaaaaaaagcccagaagccaaaaaagtgaaacatgtgcaagcaaaactccttctaatatccacaagacactcttacaatgccagaacaaatacagttaaaaaggaaatgaaattttataaatgtttgtggatcatcgttttagtttcagtttgaagttaaaaaaaaaaaaagtagtgccataataaaacaaaacagctagttacagctactctgaccaaagactgctctttcagcttcagttctgctgatgccagcagcccgtacacagtgggtctcctcagtccttaccg

SEQ ID NO: 137831 - DNA, 151 bp, Homo sapiens
atatttgcttatttttttaaagagtatttctatgtggcctttgctcattttcaatggaaagattatttctgtggagtcttttgtgtactgcctcaatgaaaggagaattatgaagatttaagacagaagggaaaattgatggatagtgatt

SEQ ID NO: 137832 - DNA, 272 bp, Homo sapiens
aggagctctgagggcagaaaagagaaatgtcccagtttagcagtcaggaagagattgaattcagactttgtctacccttttattcatttaggcctttgggctttggatgatacccacctacattggggagggccatccgctttactcagtccaccactcaaacgctcatctcttctagaagcagcctcacaaacacacccagaaacaatgtttaaccaggtgtctagatatcctgtggcccagtcaagttgacacgtaaaattaaccatccc

SEQ ID NO: 137833 - DNA, 115 bp, Homo sapiens
tagtgcctggtcaaaatccaagaaaaattcaaaactggagtaccagaaacaagagctggaaaggatgtaaggcattatatcagaccttctgtaaagaaaataaaggccaggcgtg

SEQ ID NO: 137834 - DNA, 618 bp, Homo sapiens
agttcgacggagactctctttgagaagatactgctgaagaaaagaactcacagagccaaaactctgcaaagctaggagtgaagtgtagtttctgggagtacaatttacacaactgctgtgtgatagtataaaatgctgtttcacaaagtagtacatgaaaggtaaactgtgtcaatataatttaattttaggctgtgtaaagaagccacgtctaaaaaatgggggaatgtatcttaagattggtgttccctctcctaaaactgcaaagtagctgtcactaaatcaatgcccacaaaattaacaaatcaatgcttaaatgcttaggacttcatggatttataccataagtaatacaaaaagcagtttttaaaaaattacttttattcttttacagttcatttgataaactggttctactgtatttttctatgaaatgtctattaaaggtactcttgcggctaggaatccactataggtgtccatcaaaatccccattacaaaaaataacagtccattatacgtttacagattccttttgactctcgataggcatattattatcataactatcgagagtctcgtcgaacgggtacgagctcgatcgagttgtttagaaaa

SEQ ID NO: 137835 - DNA, 566 bp, Homo sapiens
gtgcaatagtgatcaggacacaggggacacaattaggggcagcaaaggtttccaggagaaccatgctctagagtctgggagaatgttatctactccggaagaatgagaaaacagtgtttaggcacttaggctctctgtgtgtgtaagtaggtggctgggccacagaaattctattttgctaataaaaattttgtattttatgtcatctctcagtcttaggtggcctaagaaaacacactttatacatattaaatagctttaataatttctagcaatctaaaaaaattagttcttaataaccaccattaaaattatctgaatgtccaagattaggggcgtgaatatgcaaatggtagcatataaactagacagagttttatcctgccattaaaaaaacagcaattgtgaagaagatgacagtgcttaacgaaaataaaataacaaaaataatattcagaatagaagaaaaaggtaaaatatatgtgaatagtaacacaacaaacagtacaattgtgagtgtaatgtagctgcttttaaattttcctttagtgtataagaatcaagat

SEQ ID NO: 137836 - DNA, 467 bp, Homo sapiens
gaaaatagtgtatctgctgcccgtctgttttcttctttttctcacatggcaattcgtaggaagcaactttagtgaaaactatatttgattctcagtagacaggtttgactcagaaactgaggacattttactaaaaattccgaagaactttcatgtgtatggagagataatagcaagtatgtggtaataggtgcaaagtaaataactaagtctgaaacgtgaatagaaagtaaatcataaatgcaaacactacattgcagtaatctttttctctttagccttttcttacaaaatctgtggcttccgtacagagttgtaaatctttgctttggatgttttctaagaaacatctgagaaagcaagtgaagtcaaagaaagtattaaaaatgcagaaaaaatctataattaatgacatattccatattctctaatcatctatattttgtgatttttaaatatcttcttta

SEQ ID NO: 137837 - DNA, 451 bp, Homo sapiens
tttgtgttacaacagtcctaagaaaatgagattatcatcatccccctgttacaattgagaaaatgtaggcaacacgagggtaacttctaatgaataagccatgcctttgtttcatataaataagtcaactcaactcacattaacttttcaaaataccggataaaatttatttctaaccaatgcaagtttcaaagataagtacacaaattaaatttatattgaataataagcttgttaatctgatgcctttcggaacgcatttcacttagcaaacctcaattaagctatttcttatatggtttgattacaaaactgcctttcagcatattaaatacaaggagaaaaaactgaaaagccacaaccatttcaacttctgtaaattaccctgactgtaatgaggggcgccaggcaggttggggaagtatggaaattgcacactgcacacaccacc

SEQ ID NO: 137838 - DNA, 667 bp, Homo sapiens
cacagattgggtggctgcagcaactgaaattaattttctcacggttctggaggctgtacgtgcaaggtcaaggtgctggcacagttgctttctgatgagggctgtctttgtggcttgcagatggctaaccgccttgttactttgtccttacatggcctttcctttgggtgtgcgcactcctggtgtctcttcctcatatgaagacaactcctactggattagagcccactgttataatctcatttaaccttagtcatctccttaaaggcctcgtcttcaaatacagttacattggggggtagggctccaacagaagaattttggtggggaggggcacaatgcagtccataacaaagcccaagtctggtattaatatgtctatctgggccgggcgcagtggctcatgcctgtaaccccaacacttggggaggcccaggagggcggaacacgatgtcaggagattgagaccatcctggctaacacggtgaaaccccgtctctactaaaaatacaaaaaaaagttagccgggcatggtggcgggcgcctgtagtcccagctactcgggaggctgaggcaggagaatggtgtgaacctgggaggcggagcttgcagtgagctgagatcacgccactgcactccagcctgggcgacagagcgagactgtctc

SEQ ID NO: 137839 - DNA, 153 bp, Homo sapiens
tgagcaactcaatttggtttccttacctgaaaagcaagtcctggattagaagagctctggaatcccttctattgaaaaacaacaaatctcttatcctggaattcatggcccaccataatttagctaatcaaactcatctacaagcatccccct

SEQ ID NO: 137840 - DNA, 971 bp, Homo sapiens
gtcttccagtttagaggaagtagtatgaaggctgtattctggcatacattctaaaatggaagacattcctcttccattttagaatgtcttccagtttagaggaagtagtatgaaggctgtattctggcatatggtggtagtagaaattcaaatgaacaaattaacaaaaagatttcataggaatgactagcaggacttagagactaattattattaggtatatggaaatatgtccttaatataggaaatgggttcatcaaagaacattctagaagtttatagatctttgcataaatgttggcgggtagtatggcacaatgaaaataacatgggctttgaaattagcaaacctgggtgtcagttccagccccaccactatactagctatgtaagcttgagcaaatttctcctctaaatgggaataataaaggtacctacttcactggtttgctgtgaatattgaacaatacgattattgtaaagtacttagagcagcacttggcacacaataaacatccaataagtttctgttgttactattaaaaaaaaaaaaaaaaaaaaaaaaaaaaaaaaaaaaaaaaaagggggggggggcagaaaaaaatcccccggggggccccattcgcttcccccgtctttttggcacaaagggccccaaaggggggcgaaaaaaaagggcaggacggggcggggcggttaaaaccccgccggtgcggcgggaacacgctcccctgcggactctgtgggagagagcccacttctggggggcactaatggcgccccaaccacggaataagaccaggaaaaaaaccttacgggttaagggtgtaacccccgcatgtcggggcgggaaattggtccgatgtttgaatcgcgcggtgcaacataaaaaggagaatcaccgtattatctgcagtagctcatgagacatatgcgaatatcatatcaaaacgcgagaacacaagtaagag

SEQ ID NO: 137841 - DNA, 538 bp, Homo sapiens
aacacgtttatacctcccagtcaagaagagcattctgagaaaggagacttgccagcttccaaaggcactcagccttgacagcttggctacttcacgggctgactgcagctcaaacacctgttggtatcttggagccacagcacatccatccttccctcacgccaacatcaacctgatggtgagctttctgagtaaggtgtctttgttggttggttgaggccttcacgtccttcttagtttgggaggcacttgcatttcatatagcatcaccacatctatcggagttgatttggggaaggtgggtgtggagcagtgataaaggaaaacgttacatcctctgtggaaattccaggcctttccacttctttcaggtacaccagagttcactgtggtcattatattcagaagactcacacagtgcaaaaggcagtattttggggaatgaagccataaaccagtaaaataagcctcagactgtttccccaatttattattctcattattctcatctcccatacacagtatgttacatggggtg

SEQ ID NO: 137842 - DNA, 577 bp, Homo sapiens
agttaccttaattatatgagaaatatacagttctctcactgttcctgtaaattactgaatcgttactcatgttatagtatacagtgatcaaattctgttttgacaaatcacatattcaagtttttggtttggaaaatatattccctataatttatattttacatgcccagaacgtaatcctagaatttactaatgtaatgagggaatctggtccttatctagcagtgaagccctaacaaccacagagcagtacatcagaaaagccagggcctacttttttggcacagtgccctttccagctccttcttaccactgatgctaaacattaaacatgcatcatcacttcttaaattataattgactgagagcaggaggaagagcatttatataatttctcaaaatctacaagtggccagtatagacttctgcacccagggaaacttaaaaataagcctatgaatgtatgctacgatttaaataaaattatgtaaatgcatagaaaatgatatccaaatagctgttctgttaatgtggagggactgagcacttagtatcattagtttgaatcttctttaat

SEQ ID NO: 137843 - DNA, 166 bp, Homo sapiens
gtaccttgttgttaaatttgttcgcaccacactcacacgtgtagccctggtggagtccatagcgtcatcacaagcatagcgtggcaggcagcaggcttagggaagaatgacgtgtgccctccaaacatacttcccaagaagtttcatagctgccaggatagctgag

SEQ ID NO: 137844 - DNA, 408 bp, Homo sapiens
cggtccgatatgctcctaacggcaggaggctacccttggcctcttttgaggcacctcccaggcctggtgattgccactgtgtggttcctgctccaagtgtgtctgggcctggccttcccgtctcccttccctgatctgtgagggtgccaggtgatgatttagtgccttctgtaaaagggtgtcccggatgggacgagaactggaaatcctgcctcatctggaagtgagttgagtgaattgtcaggatatttatttggggcgagagaggattcagaaggaaaatggcagttgtcttcaagtgtttcaaggatgattgtgtgaaattgagagtgggcttgttctgtgttgcctaatcaactcatgtgagtaatgagaatgtgactctggcttcggataaaaagaggttct

SEQ ID NO: 137845 - DNA, 243 bp, Homo sapiens
tactgctgtatagaggtggaacacaatcactgctgactaggaatgcagagcccaggccctctaggtgcacccctgcttactggaggtgctgggaggcagtgctgcgctcctccgatgtgctagcagccactccccagctgtttctaagactagaacaggccacggaagcttaaaactgctaattgcagtaagaggctgagtttaggagttggtatacctgttgaattagttgagagaactagg

SEQ ID NO: 137846 - DNA, 262 bp, Homo sapiens
ctgcaggaccccaaacgccttttggcaaaaaccccctacaaggatcaaacgaatcttccacttgctttggtggtattacacattgggagcctcttgcttcttgcttcctttagacgctaactgcagggtgatttgtggttctggccaggggactgtcaaaagaccattccaagaaactcagaaaagagctttcatttagtcatgatgaatggggaaggcaaatgtcagctgaattcatttaactagcaacatattccctagt

SEQ ID NO: 137847 - DNA, 263 bp, Homo sapiens
atttatagtcacctggaatatttatgcacaatataaagaggctctagatgatttcattatattccatatttctgtaattttatattacaaaatagtaagtgggctcattatttaatttttccaaaacatagctttattacagcttactgtaaatcagatacacctttctctgtaaacattttgtatgctcattaaaagtttgcttccctaaatgggcatgatgaacaaatattagcaaaattgctcaagaatattttcctttg

SEQ ID NO: 137848 - DNA, 437 bp, Homo sapiens
ggaaacctcacctagagggttttgctctcctgagcagagggcagtgagcctgagtccttgctgagtctaaatccctcctgatgtccacacccttccacactaagatgtgcctttcccactgggacacggtcttctggtcactgggtcatgtcttctttagctctgggccatgagctcttccttttcttatctgtgctcagctcagtgcctccctctgtcttacttcctgtagaccctgcatgcccggcacgctttatcctcagaccactgagggcatcagagaaagatcccagtccatcctctcagtgctgagagctgaatcagtgcccctggctttgagtatctcaggcagggtaagggcagttctctctcgtggaggcctgcagatcgccacctgccccgcagtgggaaggaaagatgagaggtgagagctccag

SEQ ID NO: 137849 - DNA, 384 bp, Homo sapiens
ggagagtagtggctatgtgatgatcttcaagaggtggggccttgtatggtctaagaaacaaggttgttctttgtcctgaaagccacgaagagtcccaagggatttaaaagtgctgatggtggaatggtagggagagtttgcatgatcactgctgcattctagaaagtccacagacagaaaatgtgttagctgggttagatacagtaagactatcagaggaattcaggagagacaagggcctgaatgacaccactgggaacagaggccggcctcagaagactgttaagggggtaaagctacaggtctctgagacagactgggtaggatttaggttatctgtgctgacagagtgtagtgtagccccatgactcccacttaagagtg

SEQ ID NO: 137850 - DNA, 253 bp, Homo sapiens
ggtgagatgtgctcattagtctgtgctgtcgcctgcctgtgtcagtagtcaagggaccgggttcatgtccccagttgtagaagtgctgtttcattctaatgtaagtagaatgagtgcgaagtaaagttatttgaaaacaaacataatttcttcttagaaggtagagaatggtatattcgttgctaccccaaatgtttagttttggaatcacagaaaatagattataaatactgaactaagtcattggagttga

SEQ ID NO: 137851 - DNA, 386 bp, Homo sapiens
cagtatcctttctctgtaatacgcacactaacacgatctcaaacctgttgagaacagccatcagcttcccctgggctagtaaaagagtggtttgctgatcttagcaggcgtctttcccattccaggtacctctgcccagttctctgacctatcagagcatacagggtgcgtggtgccttcctgcctggagtctgtgtggaaacccacccctcctagcacaccttgttcagcaggcacttcctcattcttgtgctgacagctttccttttctgtcaaataccccagggcacagtacactagggactgtcttatcctgcttctaccctctacaccccacattcacaattaacaaccagcttgttcattccacagacattagttgaaca

SEQ ID NO: 137852 - DNA, 405 bp, Homo sapiens
ccatcattatcatgaaaagctccttgatgaggaagcagcaaacctagcactaaggaatgatgacaattagtcctttgctgaccttcattactggctccatgcaacactcctgggaggcaaacctagtgtctccttcccagatgccaaccctgagcccacgcaaggtgtctgaccccaaggacatctcttagcaagctggtgtgagcatcagcattggatcgcctccgtttctgctttctgatcactgttacctttgtatataatagagctgaaaatgtaatctctcagtggacagcagccaaacatgtgcattcagagttccagagccggccaggaacttactttcgccccggaagcctgggctgggagtttgcaagtagatagcgtgggccatgcaattcttga

SEQ ID NO: 137853 - DNA, 545 bp, Homo sapiens
acttcttaaagtaatgtagtgagtccttgttcaacagagccatggtttcttttagtgaggcacagcattagaatctaagattagagtgctaggtgtgttcatagttactgggatgcctttgtttctaggcctttttattgaatagagctagaaaatatctgcgtatatatacacacaggcaaatatatacctatgtggacacagacatgtatgcatacgctcatattacatgcattacctacacaagtatgcttattgtagaaattatgaatttacactgattgctacattccaatccatcccacagggttctttctttttttgagacagggtctcactctgtcatgcaggctggagtgcagcggtgtgatcttggctcactgcagccttgacctcctgggttcaagcaatcctcctgtctcagccccataagttactggcactacaggtgcacatcaccacgcctggctaggttttgtatttttagtagagatgagttttcactatgttgctggggttagtctcaaactcctgagctcaagcaa

SEQ ID NO: 137854 - DNA, 382 bp, Homo sapiens
agtgacactccatctcaaaagaaaaaaagaaaaagccttagaccattgcttcattgtacagataaaggaacaaaggttcagaggctggcctgaccttccagtagcacacagggctggaccagaataaggaatggaactgacatcttgggggagctcaagcactctaccatctgcctggtgggctggacttatccttcccctcatttgactcttttcctagctgcaaccttgagggaatcaccacctctgacttctttcctttgaatccaaggttactctgctcctcgatttctccctcatatcaaatttactaaccaatgtcagtatttgactttctttgtgacaggggatctccagtaacccattctaagagttaatgatg

SEQ ID NO: 137855 - DNA, 225 bp, Homo sapiens
ccataggctggtgctctcacatctttgtagttatatggaaaaaaccaggattatacaccagggcaagcaagcaagaaagaattatctttttctagcttagcttttgagttaagttagaaggagttccaaatatgtggcaggtaacactgctattcacatagataatttctgtctttttgatcacatgatggtcctttattggaaaacaaatacaggcaaaatcaa

SEQ ID NO: 137856 - DNA, 212 bp, Homo sapiens
ccattggtgaaggatctgcctcccacccccatctcccactgtttccaggcagcagcctgctgcagacgcagagttcttgggaaacctctactagggcagtgcagaaggaaaatacggacttggagcccccacacagggctaccaccctacagaccccagatttagagacccaccaacagcttgcaccctcagtgtggaaaagctacaggcac

SEQ ID NO: 137857 - DNA, 356 bp, Homo sapiens
agtcctatgcagggggaatgacagatgcaagacccatagacccaaggggcatgtcatctacatttaactttttttcagagagtcagggagtgcaacttccacctctgatcctattttcctagaaaataacattgcagtgaaaaaaaaccatcccacaagagtcccctggttccagcccagaggcggctgcccagctgtgagaggcaaagccaaaccagaaaatagctcgtctgcctgctgcccagtgatggagagcaccccgggggaaggttagcacgggagcatcatcattagatcagcagacagtggctccgctcccaggcccaggcagcctgctggatccgctctaatgatgg

SEQ ID NO: 137858 - DNA, 362 bp, Homo sapiens
cctacgtgcatatggggcaacccccaacatgctggcccctgccacttgcaatagatcagacccaccccttgtggttgagtgaggcagtattatgtcaattctaaacctggcattttgtttactgttgttgagtgttgttggtagtgggagaagaaaataggtcacagacagtgtgaagacacaaggagaagacagccatctacaagctaaggagagagggctgcaacagcttaattccttgtagtgttcataaagaaccaatcctgctgacagcttgatctcacatagcaaaataatacatgactttttttcctccttgatttccatgagaattgggtgaaagctattactcatataagcgg

SEQ ID NO: 137859 - DNA, 180 bp, Homo sapiens
tactcgggaggctgagacaggagaatcacttgaacacaggaggtgcaggttgcagtgagccgagattgtgccattgcactccagcctgggtgacaaagtgagactccgtcttaaaaaagacaaaaacaaaaacaaaaaaatggaaataaggtctcaaattaataacttcagcttacacct

SEQ ID NO: 137860 - DNA, 673 bp, Homo sapiens
tgtttgtttttttgttttttgagatggaatttcgctcttgttgcccaggctggagtgcagtggcgtgatctcagctcaccgtagcctcctgcttcagcctcccaagtagctgggaatacaggcatgcaccaccatgcctggctagttttgtatttttcctagagacggagtttctccatgttgatcaggctggtctcgaattcccaacctcaggtgatccgcccacctcagcctcccagagtgctgggattacaggcgtgaaccaccgcgcccagctctgctgtgtttttcttaaataactgtgcttgcttatctctgtcagagcacttagcacactgtagttgtctctctgcgtcatttctgtgaattccgttgagtgatgagtttcagtgtgtcttgggtctctaggtatagcagggaatctgttatgtagtagacataacatacatatcttttaaatgaaagaaatggagaactctcattatttgccactgtaataacaactagcattttgcttttttccctaaatttttgtggtaaacataaacatttacagtattaactatttttaagtgtacagttaatgttaagtactttctgcaaccaattattgtgcaactaatctccagaactcttgttcatcttccaaaactctgtaaactctataacccta

SEQ ID NO: 137861 - DNA, 179 bp, Homo sapiens
agggtccagggcacatttttattgctcatgcttggaaaagcactccaacttaaaatcttactatattttaagtgggcttaccaaaaattaaacaggcaccaaactcttaaatgaattaacatttgttttcaaatgcttcctgctgtacccaaatgctcctcccatgcccttcactctca

SEQ ID NO: 137862 - DNA, 181 bp, Homo sapiens
gccaaaggtcgctccaagcgtacaggagatgggccatacctgaggagagaatgtatgagatcaaaaaagaacaaatgttttattattacttgagcacaagtgtaacctaaatatttctatattaaagcttaatgtgctttcttaaagaatgcctaaagtgtaataaggtcataactgcatt

SEQ ID NO: 137863 - DNA, 264 bp, Homo sapiens
aaggcagcagtgatcaccatttatggagtgcttactgtgttaccttgctctgcactaagtgctttacatatgttgttttattgaaattcatacatcagccttaatcattaggtatcattatcccagtttgtggtgagaaaatgaaggttcaaagaggttgaataacttgcccaaggtcacaaagctagttggtaatagagctgagactcaagcaagacttaacaggccaaagggaattaattatcttctcccaaacctgtcccc

SEQ ID NO: 137864 - DNA, 250 bp, Homo sapiens
gagaaccactgatgtcgaccaacgattgtcctgagggtcaatgacaccctttcaaagccaaaattattttcatactaatatgaagacgtgatttgccctttgcacaatgctgacatttgcactgatggtggaaaagcaatggtaggtcaaggtgctggcccctccacaggaattacagtaatgacaccaaaccgtactggagctcttcaccaccacacgctcacagtaagaaaaatgggccgggcgcggt

SEQ ID NO: 137865 - DNA, 226 bp, Homo sapiens
attacagcccgttccctcccttggtgtttttgcaatcacagtgctccctgtgtgtcgccaggtgcctcttgtaagaggtgtgaagttgtggaaatggaaggacacactgaccttcccttagccttcagatactgcaggtacataaatcctgggtgattttatgacagagccactggtctcctcatcccaacctgctgctttccacctgaggtttacatggcacccg

SEQ ID NO: 137866 - DNA, 247 bp, Homo sapiens
cccactcctgggaggtcactgtatggatgctgactgtagtgtattggacaatcagcacagtgcgctacagtccagaactcccgggctcaagtcgtcctctcaccccagactcctgaatagctgggactacaggcatgcgccaccacacccggctactcctttttatcacggactacgacaaaggccatatactcatcatctttctccttttcttcctttctttttttgccagacaatgttaaagtaa

SEQ ID NO: 137867 - DNA, 163 bp, Homo sapiens
acgaggcctggacccctctcgccatagagctgccctggtgacacgcccatgcccgacccagtggggcttcagggcagatactccctgctgcagggtgcccttctccaaatgaaatagggcagccggaggagggagaaggaaaacaatgcaagactcggggccc

SEQ ID NO: 137868 - DNA, 381 bp, Homo sapiens
cccggcatggtggctcatgcctgtaatcccagcactttgggtggccgaggcaggcagatcacttgagattaggagttcgagaccagcctggctaaacatggtgaaacccccgtctctactaaaaatacaaaaaattagccaggcatggtggcgtacccctgtggtcccaggtactcaggaggctggggcaggagaatcacttgaacccaggggggcagaggttgcagtgagccaagatcgtgccactgcactccagcctgatgacagagcaagactccagctcaaaaaaaaaactagtgtggtactggcagaaagacagacatattaagaccaatggaatagaagaaactgcccagaaacaaaccttgtgtatatggtcaa

SEQ ID NO: 137869 - DNA, 154 bp, Homo sapiens
gaggcctctagcagggctcaggctggcgggcagtgccagcagttgcagggatcaaggtcagactctgcacagctaggcccatgtgtctcggcagagtccaccagtcccacccagcagctgaagggagaaagacgaggaggcagggagcagacga

SEQ ID NO: 137870 - DNA, 488 bp, Homo sapiens
gtgcatactgttatctttcacttctccatgtcaacctctgcactcggctttgaggagagaaagctaaataagatatggcccttgcatttttgggaattcaaagtaggtcagtgacacacaagccaaaatgcagtaatatccacaatccttagccagaaagaaagaccatagacagttctgtaataccatgtgacaagtaccatccaacaagcgaccaaacatgcaggacaagaagggagataatggtcacttctttttctggtgatcagtaaaaggctcaaggaggaaaagataattttaaaagatcttgaacaatgaataggaggttccaggcagacaagatgtatccaaactctttgctaaaacaagagctcagtgggggcattccatgagcaattaggattccatttcaggaagcatcacactgctaagtgttttgttccctgttcttacaattaacaccctcagcaggtagacaacccatcttc

SEQ ID NO: 137871 - DNA, 573 bp, Homo sapiens
agttcgacggagactctcctatctactattttctgccctgtcactgcattccaatcaaccaactaaccttctggtggactttaaagacacctggtgtgttcttgcctcaggattagtgtgccccatccccttcacctagaacattctttcactaggtatgtatgtggtttgctctctcctctctcaaatttttgcttatatattccattctaacacaaagccttccttaattaccttgtttaaactataacccaggctccttttccaactttatattataatttctatgggaaattatcacctctttctgtatattttacatgtgtattgttgtcttctcccactaaaatgtattacagtatacttaaggaagagttcttttggtctggtttttactgctatgtctttacaacatacaacagtgcctagtgcataggagcacaacaaatatttaataaatgacaaaaaacctgattgttttgttgagagttaagcagagatctcttctgttcaactataagctgttgaacagaagagagtctccgtcgaactagttcgacggagactctccat

SEQ ID NO: 137872 - DNA, 352 bp, Homo sapiens
tgccctcctcacctccctgttctggctcccagcccctgcacagggctgtggtctccctcctgtgtctatcctcactgcccacatgggcttttgtattctgtgtgccaggtggctgctgccccagccaccctaacaggtgctctctttctgccaatacctaccctggctgcacctgcccctctacccctagtgtctactctattagtttcctgtggctgccataacaaattaccgcaaactgggaagcatgaaacaacagaaatttattccctcacagttttgaaggccaaaagttggcaattaaggtatgggcagggttggttcctattggggaccctgagcgggaatctgc

SEQ ID NO: 137873 - DNA, 629 bp, Homo sapiens
taaaaaaaaacaggtttattagattataattattaaaatgtaaaatttacccttttggtattaatagtttcgtgatttttggccaatgtatgcaattgtataaccaccactaaaaaagagatacagagcatttccattccctccaaaatgttcccttatgtccctttgtagtcagtctcctccaccccagctgcctgcaacctctgatcatatatctgtcctgtaattttgccttttccagagtgtcatataaatagaatcttacaatatgtgggtttttgaggctctgttctttcacttaacataatgtttttgagagtcattcatgttgcatgtttctttcattgctgaatagtattccattgtacggttgtaccacaaattttaaatatctatatctatatatttattaaccatctactatgtgctacctacagtgagtcctgaccacttagcgaagtaggtattattatctccttattacaggtgtggaaactgaagtttctaaatgagagaactggcccaaggtcacacagctactgagtgatagatttggcattcaaacccagatttgtctgaccttcaaaccaagctctcggtttaggatgaggagagtgatagtacttggc

SEQ ID NO: 137874 - DNA, 211 bp, Homo sapiens
gtatttttagtagagatggggtttcaccatgttggccaggctggtcttgaactcctgacctcaggtgatccacccacctcggcctcccaaagtgctgggattacaggcttgagccaccgcgcccggccgatcctttactactttaggattcccactttcccttcagtttttgcctgaaggtttggtaacctacagtcgtgtccattcttca

SEQ ID NO: 137875 - DNA, 314 bp, Homo sapiens
accctagaggatcccaggttcgacaggagactctcgtgcctgtggtcccacctgcttgggaggctgaggcacgagagtcgcttggatctggggggcgggggttgcagtgggccgagatcgcaccactccactccagcctcagtgatggagtgagactcagtctcaaaaaataaataaataaataaaaaaagaattccaagagttccagtatctagtctaaatcttataaaagatttatgcattcctgagtactgtttaatactataactaaacactgatacagcacactaagacagttactggatacaaaaaac

SEQ ID NO: 137876 - DNA, 278 bp, Homo sapiens
agtgtgagttgtactaaagtaaaatcagtattctggatcccttaatgtgcacataattaccacttaggcttctaagcgaaatgatttgctaatggcaactaaaatgtgacatggcccagagtgaaaaaattgattcataacttgggaaggtttgactagattgcccttaggcaagtgcctagagggctttcctgtctctccctaaaccttgcttctgcagttccaatgtacaaaatagggatagggttgttgtgaagattaaatgaaactagggcagg

SEQ ID NO: 137877 - DNA, 362 bp, Homo sapiens
gggttaagatctgagggggaggcctggacatattttttgcactgactctgacggttgaggcagttgatttagttctggagtgcagactaatcagctgaccatttgctctcactcctctgaggtttagaagcctaagaagagaggatttgagccaataaatgactatggggtccttggaacccagtaagccctcacttctggtggagaagatgggcctgtggctgcagacagacctcatgtgaccctgatctccccctttgggtttgtgtgactctggttcagtgactgtgccttcctgtgcctcagttttctctcaatcaaataagctaagtggcaaatggactgtggattttcatgctact

SEQ ID NO: 137878 - DNA, 341 bp, Homo sapiens
ccatctggagagatagaaaatcagtcacgatactgctgtgcatgtgtaaaatagaagtttgtgcaaaatgcagtggaaatgtagagaagagactggctgcttatgagactggtggggagatgtcacaaagtagcatttgccatagatcttaaagaaagatttgccctttcttagaaacaggggatagggatggacattctaggtagagtgaatagcatatgctgaggtatgtaggcctgaaagaaatctgtgtccacgactgggcacagtggctcatgcctgtaatcccaacactttgggaggctgagatgggtagatcacttgagtccgtgagttcgata

SEQ ID NO: 137879 - DNA, 408 bp, Homo sapiens
gatgatttgagcaacactcgaccaacatgacctaagagacatttatagaacacatcactcgacaacagcagaacacacacttttcacaagtgcacatggaacattcaccaagatcacatcctgtgccaggaaacaaactggcaaatttcagtgaattgaaatcaggcatattatattctctggccataaggaaatcaaactagaaatcagtaacagaaaggtagtaggaaaatggccatatatttagacattaaacaacatattttaacccaaggaccagagaagaaatctcaaaggaaatttaaaaatacatatagccaaatgaaaatggaaatacagcatcaaaattttgaggcccaactagagtagtgatgaggtgagatttatagcaacaaatgcctatatttg

SEQ ID NO: 137880 - DNA, 146 bp, Homo sapiens
ttaaagaaaaagtattctttattcctagttctgaactcaatatcgtctttaaaatactatatatgtgaagctcaaaacacttaacactattatcaatatttggttggctagggatcccatataaagagaaatctacaagaggtaag

SEQ ID NO: 137881 - DNA, 427 bp, Homo sapiens
cagcaacgtaccattaaacagtgttggctcagaattcagagcaaagctgaatattaaacataaaagtaattggattttcaatctagttactttgaataaatgaaaattgaaaaaatgtattagaaatactaacagcagaaaggcattcccaatcacatgacttgcatttgaatatttttaggttaatagatattaaatacaggctcaatatcagagggggggggaaaggagtgttgacaggatacgatattaccaatatttaagggtacattcaagagacgtagaaatatgaaaccatagaaacattagctgcattctgtaatgcctaaaattaatctaaatgtcttaaattttggatgactctacaatagatttgaaataaataagtctgaaaagaactaaagaagaaatctttaataaactatga

SEQ ID NO: 137882 - DNA, 146 bp, Homo sapiens
agagggcctggcgctgtaggtggactagccatgttaatcacaaagtccattaggatgatgggtgccctgctgccttgccagggagcctgttagtacagaacatcatctgtggagctggagattgcagggtttgccttcatcagcgg

SEQ ID NO: 137883 - DNA, 358 bp, Homo sapiens
gaatggaccatatactagtccataaagcaaacctcaacaactttaaaagaaaagaaataatacaaagtacattttctgaccaaaatggaatgaaattagaaatcaatagcaggaaaaaattggggaaactcacaaatatgtggaaattatatgacacactcttaaataaccagcgggtcaaagaagaaattaaaaaagaaatccaaaaacactttgagatgactgaaaatgaaggaagcatagtaagacttatggaatgcagataaagtgttacttagagggaaagttataaccgtaagggcttttgtgaaaaaagaagagttaaataaataacctaaccttccaccttaagacggag

SEQ ID NO: 137884 - DNA, 483 bp, Homo sapiens
ggcagaattgggaccagtgaggtcataggaaaccagaagttaggagccacagaggaaaagagttgcagaaaagagcaagtagtcagccatatccattgactgctgctgttaaatccagaaaaaaggccttgagatttgacattgtgatgaccatgctgagtggacttcagccgactggtcgggaaaaaagcagattgaagaggaaattggaggtgaagaaatggaggtataggtatagcaatctttcaagaactttaactgcaaaggaaataaagaaatggggaaaggatttatgttttgtaaggtaagagatcctagaacatttgtactctgtggggtgatccagtaatcattctgtagagagggagacactgacgatacaggacagaaaagatgactgaagagtgtaatcctcaagacgagagttggatgagcgttggcctgatagacacacaccgtcaccagtgttccgactgacaccta

SEQ ID NO: 137885 - DNA, 360 bp, Homo sapiens
agccaggattacaggcgtgcaccactacacccagctaatttttttgaatttttagtagagacagggttttgctatgttggccaggctggtctcaaactcctggcctcaagtgatctgcccatatctacctcccaaagtgctgggattacaggcctgagctagcacacctggcctaatattatttagatttattccactgctttcgttttttacctttttaatgtggctacttgcaaatttaaaagtgcattagtaacccccattatatttctgttggttatagctgatctaggttagggctagtagccctagaagagggattgaaagcagggtgaacaagaaaaggaaagggagagaaga

SEQ ID NO: 137886 - DNA, 394 bp, Homo sapiens
ccggagtgggaagctgagctcaggactcccccagcagaagccccagctggacggcagacactccagttcctcttccagcctggcgtcctcagaaggaaaaggcccaggagggaccaccctgaaccacagcatcagcagccagactgtcagtgggtctgtcgggaccacccagaccacaggaagcaataccgtcagtgttcagctacctcagccccagcagcaatacaaccatcccaacactgccacggttgcacctttcctgtacaggtctcagacggacactgaagggaatgttactgccgagtcaagctcaacaggtgtgagcgtggagcccagccacttcaccaagactggacagcctgctctggaagaactcactggtgagtatggagcc

SEQ ID NO: 137887 - DNA, 774 bp, Homo sapiens
gtgatctagaggaccccagttcgacggagcccctctctggagataaaccactataacaagtttcttgtatatccttccagagagagtctctgcatatacaggcatttgcatgtatattatatagacatgtttgcaatatatatacaatcttcccctcctttggagctgggatttgaatccagacctgtgtaattctaaaatatctgcccatttcaccagacccacagcctctcagaccacagaagaactgggagctgggtgagtagttatcacaagagtgcagcacagttccactctgtaaaggtgccaggtgcatagggaaaagtgagggctggggcatcaggagactcaaaataaagtcctaggtctgaattgatatgttcctgagcaagtccttcccttcgctgggcctcaggtaagtcctctgaaaatgagagtctccgtcgaactagttcgacggagactctcagtgtagctccctggaccagttcaagagcaaactgcagaacctgagctacactgagatcctgaaaatccgccagtccgagaggatgaaccaggaagatttccagtcccgcccgattttggaactaaaggagaagattcagccagaaatcttagagctgatcaaacagcaacgcctgaaccgccttgtggaagggacctgctttaggaaactcaatgcccggcggaggcagcacaagttttggtattgtcggctttcgccaatcacaagtcctgcattacgaattagaagagagtctccgtcgaact

SEQ ID NO: 137888 - DNA, 467 bp, Homo sapiens
aggagaaaacagaaagaagcattgaaatggagtgacctgggggaaaagcttggaggaaatactctctccctgccatgtgacccaccccagttgaacatgggaggaaaggagcagcactatctgtttgggaaagctctttagcagttctaaagaaatgcccctcttttcttcaaccagaccactctggcttcctcctcatcctcccgtcccctcctcgtctttcctcctctcctcctctctctcctcgcccctccctctcatgacaatgtcctgagggcggtttgtgacatctaagaccttctccacgacagggcaaccattggctaggtagtagcttgctgaccaatcaaagctcaggggtctcgttcgtcattgtcctgggaggggtatgtatagggagaccaggcagcctggaatagacaattgagagacgctggcgaagatgaccaggaaacgacgagcctcca

SEQ ID NO: 137889 - DNA, 322 bp, Homo sapiens
tggcggaggtggcagtgggcatgtgcacttggctctgacacagccactcatgcaacaccctgtgcaatctcggcctgggcctgtgtgtcctgccctcattcctcgcgggtgactgtctcccctgagccactcttctctctattggattagctccttttatttccccctagggatgcaacacatttttatgaacaaacagcagtgttcacatggctgtgatgaggacgtactggggtttcccctggacatggcattcatctgatgccagtggtgggcaggaccgtgctgtatactttaaaaaaaccctagggggttctgttag

SEQ ID NO: 137890 - DNA, 205 bp, Homo sapiens
atacagcctttgcagaaaggccatttgtcacttgcaactaaaaatgcaggctctgaattattatgaaaggtttaaaacacctaaatctgttcccagagggtgtgctaatcaatgtgcctcttataagcttgaacacaataatccataacaatcactatggattaataacgggatttcagtgatttccccccacaaagatctacat

SEQ ID NO: 137891 - DNA, 315 bp, Homo sapiens
tggttttaaatttccattctgccccttattagctacatgatcttgggaaattggatagcaattgacacagtcgaccacttcctccttctcaaaatacttatttcccttagcttttgtgatgtaagactgccttgattttccttctgcttctctggctggtctttttttctctctctctttttttcagagcaattcttccctcctggaccctcaaaccatatattttgtgctgagtgatcttatccacataatggcttcagccacagtcaaaatgcagaggattcctgtatttcaatgtctagtctggagctctca

SEQ ID NO: 137892 - DNA, 657 bp, Homo sapiens
ggatgtattttgaggtttgttatgctgcagtgagcataataaaaaaaagtaagcaacttccacgtttttgataattccaggctgctaatttaggtaatggcagacaatagatggatgatacagtgtatacatgcacagcctgggaaacatcccttagccattttggctggggtttggcctgtgtttcctggtgatagtgcatggtaactagtgccactattcagtcaccttgtttagtttaagtatgaaaggtaaaaataaatttagggatttcatataatgccagaaaataaatgtggagtgaaagtagaggtttgctaggctgggtgagataacattgtagttcaaggtgatatcttaaaatgaaaatactcagagaagggctggactgaacaagtactatattgctttgtttgccatatcagtttacataaattattggtttgttgtcccagtctattatactgtactttggtaaagatcctcccttggtaatatacaagcttgatcaaatgacaacctcagaacagtgatgtatttggctgaatgatttttgaatgaatgaagtcagcagttgcagatagcccaagactgcctataaagaaggtgttaaatgagtaatttacagtgaaattactatgagcttaaaaagagata

SEQ ID NO: 137893 - DNA, 331 bp, Homo sapiens
agatgttcatatttacataggaatgatttcttagctcaataagtaaacccacatttgggagaaacaactggtctttcagctaagccatgatttcaacgttattcctacttacataacagattaagcatttatttctcaatactaaagtcaaaagaaacattgggcattgaagagctttatgatattctaaaggccagcttcagatctggagctaatgaagacgggtcaggaattacccagcaattactttattcactctattcagtgtttacacctagaagccccaatcagctgcaaatgatccgacttgaccaggaaatcagaaactttc

SEQ ID NO: 137894 - DNA, 481 bp, Homo sapiens
catctaacccaacacctggcacttactagaggcatcaacgatgcttgttgttctgtgtggcgaaggcacacctggattctggatggtcagtctcagctctccatctttgctgcctcacagggactccaaatgtggagcgtctcccactgcccttaattagggaaattcagcctcgcagaagacagtgaaactgatgaaagcattgggaaatggaacctaggaaagttaaagaattggcatcatttgatgtgagaaagagaagcgaagatgatgagagatcctagggaaaaggctacatgccctgtctttcttgagacaagcgtgtgcacttcctttgcttccactcttacttgtgtttatccttggagggacctttaattatctaacgcttgggtattggccacggtgcttatcgtctgcgtgtgaatctggacatggtccccaagctgtgtggtgctgtttgttggtgcggtccaggatg

SEQ ID NO: 137895 - DNA, 384 bp, Homo sapiens
gtctcacgagacgtgatagttttaaaaagaggagttcccctgcacaaactctctctctttgcctgctgccatccatgttaagatgtaacttgctcttccttgccttctgccatgattgtgaggcttccccagccatgcggaactgtaagtccaattaaacctcttccttgccggacgcggtggctcatgcctgtaatcccagcactttgggatgccaaggcgggtggatcacctgaggtcgggagttggagaccagcctgcctgaccaacatggagaaaccctgtctctactaaaaaatacaaaactagccaggtgtggttgcacatgcctgtaattccagctactagggaggctgaggcaggagaatggcttgaacccaggag

SEQ ID NO: 137896 - DNA, 525 bp, Homo sapiens
tgccaaaaaaggcagcacgcccctgaggctgactggcacccagagccaaagatcagcaacggacaagaagaggctggcgagggcttgaggtgcttcaaagaggaagctacacagatagtggataaatagcagggatttcttgtacttttgccaccagaaaactcatagtgggttggcctatctatcacgctttttaaagaacaggcaaaaaaggattaactagggacaagtgctcttccacccacccctcaggagatcaatttcctctccctgacacatataaatacacacatcctcgaagggtgagttagaaagtgcaccaggagctcgatgctttgggaggcaggggtgagaggattaatcgcctgaggccaggagttccagaccagcctgtgcaacacagcaagaccccatctctacaaaaatatttaaaaagttagccgggtatggtggtacaggcctgtagttccagctacttcggaggctgggataggaggatcacttgaggccaggagttccagacta

SEQ ID NO: 137897 - DNA, 276 bp, Homo sapiens
attcttttaataaattgttgggaagttatattagtttctattgctgctgtaaaaaattagcacagactttgtggcttaaaacaacacaaatctatcatcttacacttctagaggtgagaggtcccaaatgagtttcactgggccaaaattggtgttgtcagggttacactctctccagagactctaggggagaatccatttccttgcctttttcagcttctagaggctgcttagattcctagaataatggcttctttcctcatcttcaaaataact

SEQ ID NO: 137898 - DNA, 841 bp, Homo sapiens
tcacggtgaatgctgccaaaaggttaaatcacgtgagaacagagatgtgactccaactagcaccatgaaggtgactggtgatcttaacaagaacaattccagcagagaggtggtcatagagccagactacagaggatgatgacgggaggggtggtgaggaagtggagggaatgaaaaaaactgtcttttgagaaatgttgctatgaaacaaagcaaaaagaggccagcaattggagaaagagacgggtcaagaagaagttgtaaaacgtgggacatactagagtatgtttctcaacaattgcaaggattccttagggtgaggttgaagctggaagggtaggggcattatccacggagtaaaaaagtccttgaggaagtgagaagagaacagatccagggcgcaggtaaccacattgaaatttaaaacctctgtatgataaacattcacataaagatgaataatagtctattagaagatatctacagcccatgtatcaaagagttagtatagtgatatacattaagaaaaatgagaatttcataagcaaaagacaaatgaccaagagaaaataacatgaacaggcaggaggaaagttgaatggccaagaaaaatacaaaaaatcctcagtgtcatcagtaattaggcaaatttgggttaaaaaaagagatgccactttttaacctatctgattagcaaagtttttaaaatgtgataatatcagtgttgggaagggtgtgggaaagaagtaatgtcagacactgctggttgaaatagaattagtgatactatgttggatggtgtagggcagacaaagctttacctctaccttcataggaaccc

SEQ ID NO: 137899 - DNA, 336 bp, Homo sapiens
tgagctcgtaccgacgctctcatctgttgggggagtaggcataatgatatgacctgggagaggagtgaggctccctgggtttcacctatgaaactgttacaccacagccctcccctccataaccccagtccattagtgagggagtgcccattagccagatacactgatctgtctgttaagaggtaaattggaatcctggcatttaggagtcactgtggagacactggcaagcttgagggagctatgaaaaagagcaatgtccaatgccttcttgctcagggctccatcatggcttcgtggcatccctccagctccacgtggaaaccaggtctgctt

SEQ ID NO: 137900 - DNA, 282 bp, Homo sapiens
ctttccactgtactaacaccaggctctaaattccaagagggcaaaaaccttatctatcttgtttactcgtattcctcctgaacctaaaacagtcggtgctcaatacatacgtttgaatgacgaaatgaatcatggggtgtaaaaactagtgtgacatgggttctaaatgagaaaactgtattacaggatgatttcagctcatatgaaagaattttaacaattagccggacacaggggctcatgcctgtaatcccagcactctgggatgccaaggtgggcaga

SEQ ID NO: 137901 - DNA, 451 bp, Homo sapiens
ctgtctaattttttaatattttttagagacaaggtcttgctatgttgctcaagcaggtcttgaactcctgaactcaagcaagcctcccgcatcagcctcccaaagtgctggaattacacatgtgagccaccatatctggccagataagccaattgtgacatcagaatcacttaagaggatataggtcatgaagcacagcttgatattgacctgtatttgtgtgagtgttgtcttttgatcaggttttaggtgtcagtattatggttgcttaataaaagatttcggatgtttttccagtattttcagtgctttggaacaatatgtgcatcaggctagactcagtggctcatggctgtaatccagcactttgggagaccaaggcaggaggagcccttgaatccaggaggatccccaggactcacctggggaatataatgatcgatgtccctac

SEQ ID NO: 137902 - DNA, 164 bp, Homo sapiens
cacatccagtgttgacgtgactccagagggaagtggagcagacaggagcctcaagggtgcaaacgttaagtttgctgttttcagtctgtgcttggcactttcctcactagatctttttcacttaggttaaacaattctttctcccagtatgaggaatgccagat

SEQ ID NO: 137903 - DNA, 130 bp, Homo sapiens
ctagaaagaaaagccctcagagtggaaatctggccagataaaagtctacgaatgaataggaagttttcttaaaatgcagtgcttaaatatttcagtgagaaaaagatcttaggatctaccaagttggttt

SEQ ID NO: 137904 - DNA, 206 bp, Homo sapiens
cctagaaatttgcagatgtgcctccactgactacagaggagagagagggagggatgctgttgactttgaaatcagagagggcttcctggaggaggtgatgtttcagctggcgcttaaaggaggagggagacttcaccaggtggagtgtgatacagatatatattctgaaccaagggaatagttgagggtgagtatggggacttgag

SEQ ID NO: 137905 - DNA, 264 bp, Homo sapiens
cttaaccctccttcctttcatgtcaacttctctggagtggtctccactcgccgtgcctttctgctctgtacatgtcctctctcaaagtcactcatcgggtgtagctccaaagcctggtaggagagctttaaatagcaacatgaaaaaaaaaaggcgtcttggtaatctcttaaggggacatgtccaaggtaacttcaagggagctgggagaacaataagggctggcacaaccaatggttcccaggctccaatgaatactggtcc

SEQ ID NO: 137906 - DNA, 306 bp, Homo sapiens
ctgggagaggctgtctcactgcttcctgcagttcccctgatctggtccaaaaggaggaaggatgtgtggtgactttgcgaaagaattgtcacttagatgtctcttcatatgtcatctggtggttagggttttgtgtgccaccttccatacataattggcctctcactgccttgttaatgtcaaggaaaaaggaattagagaaagaagtttagaatgagggattgtgttttgaaaaaaatacaatctgaatcagtttccacacttccaagctggtgtggaatgcaccacacacacacacgcacacac

SEQ ID NO: 137907 - DNA, 170 bp, Homo sapiens
tctgcaatcttcttcacttagtatattgtacaagtctttatatattcttctacaacattaattttagtggctacaaagggtttcatggcataggtggacaataatttccttaactccttggagtctttcctctctcgcacatgttatgtctacttagggtccagcacaat

SEQ ID NO: 137908 - DNA, 182 bp, Homo sapiens
attatgagataaccactgaatgaatttgcacaatagacgtgcgtgcccttcatctgccgcgtcatttacttgctttcaaaggactttattattcacctgcccattcattttcacttagtcccacttatcgtcagctttttaaagaggtggagtgattccgtgttacagcaacctacagccca

SEQ ID NO: 137909 - DNA, 374 bp, Homo sapiens
ctctgtgcccaactggggtgaagtattttacatgtgtttcctcccctccacgaaaacctccagggaggtgccactgtcaccccctttcagggagggaaagtgaagctcagaggctcatccacagtcacagctaccgattcttgtccttttacccctttgcaaaactgtgtccaattgatagcgaggggaatagtgtcgactatatgtagcagacggaactagatgaataatataaccacaccatgggctgggcgcgggggtgtcacggcctgcaaattccggcattctcgggaggctgagggaggaggatcgccatgaggtcggagttcgaaatcagacctgggcaatctggtgaaagtccttctctgttaaaa

SEQ ID NO: 137910 - DNA, 340 bp, Homo sapiens
cttgactattacaaagtggcatataccccactttctggagtcagatgtactaccattgtgccacgaggtcacatatatcccaccttcttattattaaattgtgaaacctcaaaatcagataagctgcctccctcagctaagttgcttatcatcacaaatagggatttttgagttgctaatatcttcggcatgtattaattatctaattatgatgcaatttgacagtcagtgaacacgttggccaagtctgctggtaactggtgattttcatgtttcatgtttagaaacagcattgcttctaaagatattgatgacttttgatgaagcacaccaaattatt

SEQ ID NO: 137911 - DNA, 275 bp, Homo sapiens
ttctcttacgttgaaatggtctgtactcggccatgttcccttacgttgaaatggtttgtactcggccatgttcccttacgttgaaatggtttgtactcggccatgttcccttatgttgaaatggtttgtactcggccatgttcccttatgttgaaatggtttgtacttggccatgttcccttatgttgaaatggtttgtactcggccgtgccaggtcattttgggaggtaagtggggagtttcatgtggggttgtgcagtattcttaggtgtcag

SEQ ID NO: 137912 - DNA, 374 bp, Homo sapiens
gaggaaggtcctattcaagttccccacaactaaaaagtattgattctatgacaggtccatggagaaggaaagaaaataaatgggaaaataacagtgatctgattccttgatttggtttacttgtactgcagggttgttaaggaatcagagaaaaacaatcaagtgttagaaggcaaaccctaaatactactgatggtgtagaggggcacattctctatcatatgtgctcaggaaggtaaaagtcatcttcccaatactcttaaatcacacaacactatccacctactgtcatagctagtctcatttctgggctaaaaaaaaaaaatcttttcaagtgagacattacatgtgaaggttatttctaaatggtaaca

SEQ ID NO: 137913 - DNA, 553 bp, Homo sapiens
agaactcatgcagggcgcttgggcctctcaccaaaccagccagcagaaaactcaaagagccctctaatgactgctcatctgaggttcctggccctctgtggggggttctcaggagggcaaggatgcctgttctgctcctcttggggaggcagcctcctcaaccatgggtccactcagcaggcctggcacaatgaaaaccaactggaggctttgagtccctgagcctgtgaacaagttccttcagtgtttcactgctgtgttcaggtcaaagtgacaggctcatgttgagtgtggacttctcttactcttcttttgtctaagtaagtcagtatcctgcaaggtgtgggtgctgacaccagtagcctaggggcacagccccaagagcaactctactgggagaggaccagcaccagaacctgctgcgtcactgggctgccagcccttcacccagctccactcccaagccagtttttgttattgaaatagacaccctctttccaaagcagtgcaactgccagaacgctgattaaaaagttaatgattgggccagatg

SEQ ID NO: 137914 - DNA, 715 bp, Homo sapiens
cactctgccctgactcataggtacagtaccacccttttctctctgagatttttttttttaatcttattttactgtattaaatcttactaatattctgtaagggacaaaccagacgagtaggctacagtgaagaaatcttattttggagagttaagaaaccactatgatacttccaggtattatcttcagtgatgcttcttatctttattcagggactccaggtaatattcagctcctacagctaccacaaatgcagcaaatccccatttgaatcctttaaacaatacatcaaaaaaggaaacactctttgcaaagccacccatgtatcttcaagcttcattgtggccccacggatcccttagccctttttcagccagcttcttctggatagtttctaatggtgtcccttctgtcttccgttgtctgtaatctagaagttccattttacgatgtccatgctcatgtccatgtccatgggccatgtctgacagcaatctgacctctcaggacactcaactctctctctctgagatcttaatggtagttttccatatgtcctctacatcctttataacctcagtttcttccatcttaatttgttttctacctgcctttcatattagaggcaattctcaactgtttggtgtttcttggctatttgctggtgttttggggggtgcactgaaagctgctggatgcactcttcattggggaa

SEQ ID NO: 137915 - DNA, 792 bp, Homo sapiens
ggccaggcgacgtgactcaaacacctgtaatcctggcacttggggaggccaaggcgggtggatcacctgaggtcaggagttcgagaccagcctggccaacatggcaaaacctcgtttctactaaaaacacaaaaattagccgggcgtggtggcgcgtgcttgtagtcccagctactcgggaggctgaggttgcagcaagctgaggttgcaccactgcactctggcctgggcaacagagtgagactcagtctaaaaagaaaaataacaacaacaaagtgtggtctctaaaccagcatctttggagcttgttaggaatatagtctcaggcactgctgcagacctgctgaatcagaaccttcattttaacaagatccccaggtgattcatgtgaccccctcaacctcaggctttttgtccatccagtggggaggctaaggaagttttttgggggcattgctatggagtacttaggagagcctgcgatcatcaagatgacctttgaagcttttgtcctgtgggttgccacatgggctaagtcgtcccaggtttgggtaggtgaagcagcaggtcctaggtgtcatagattaagtgtcagatgggactctcagtacagagtggggaggggtgcagaggttgcaccagatcagggaagcaccccaaggtagggaggggatgaaaacttacttgatgcatgaggatcaaagaccttggacttgggcccagacttgtaccttgcacaccctgagtccttcacattagggttcataaccttttggtaactaagtgggtcca

SEQ ID NO: 137916 - DNA, 823 bp, Homo sapiens
ggccaggcgacgtgactcaaacacctgtaatcctggcacttggggaggccaaggcgggtggatcacctgaggtcaggagttcgagaccagcctggccaacatggcaaaacctcgtttctactaaaaacacaaaaattagccgggcgtggtggcgcgtgcttgtagtcccagctactcgggaggccgagggaggagaattgcttgaacctaggaggtgaggttgcagcaagctgaggttgcaccactgcactctggcctgggcaacagagtgagactcagtctaaaaagaaaaataacaacaacaaagtgtggtctctaaaccagcatctttggagcttgttaggaatatagtctcaggcactgctgcagacctgctgaatcagaaccttcattttaacaagatccccaggtgattcatgtgaccccctcaacctcaggctttttgtccatccagtggggaggctaaggaagttttttgggggcattgctatggagtacttaggagagcctgcgatcatcaagatgacctttgaagcttttgtcctgtgggttgccacatgggctaagtcgtcccaggtttgggtaggtgaagcagcaggtcctaggtgtcatagattaagtgtcagatgggactctcagtacagagtggggaggggtgcagaggttgcaccagatcagggaagcaccccaaggtagggaggggatgaaaacttacttgatgcatgaggatcaaagaccttggacttgggcccagacttgtaccttgcacaccctgagtccttcacattagggttcataaccttttggtaactaagtgggtcca

SEQ ID NO: 137917 - DNA, 292 bp, Homo sapiens
tgcacgattgctgagccaaagcagatcgaaagtcattttggtaagaggctagatgctgaccttgtattctgaaaatctgatgattctactgttgttgatgtgattccaagtaagcctgtgtgaacttctgggctattctcagggaagtgtttatgacacattgttgaaggtatcatcagggcagttgatccaagaagactctaggagctggctaagccacaaagtctgcccaaaaagctcagaatgacaaatgaatgttttgtacattatctccactataatgctagaaaaa

SEQ ID NO: 137918 - DNA, 339 bp, Homo sapiens
ttgctttcttttctcagtcaccatcagagatggtgggttgatggaaacctatggagggagagcctttggtcggctggtgactgggacgcccttccaaagtgagggtcccttagtgggcgggtacaaccgaggagcctgcttcactatgttttcttggaaggcgaggctggaagctgtggcaaggagatgggggagaaagggcagtttcctagaccctggaaatttcccgacagcctcgggggagtccacccaccgaaatctcccctaaataagagcacctcctctcttcctcccaaccttgttggacttagtcggccgccatctggatggcagactgtg

SEQ ID NO: 137919 - DNA, 333 bp, Homo sapiens
tgtatatgtgcatctgtatgtctatatgtgtgtctgtgtatgtgtgtgtctgtatgtgtatgtgtaactgtgtatgtgcctgtatgtgggtgtatatacgtttctgtgtgtatatatgtgtctatgtgtgtgtgtatctgtatgtgcgtgcacacgtggccatgccacactgccgggtcttgtctacattttccttagcagagagggagccccacagtggactctgcagtgtccacatccagcagtggccggcacatggcaggcactcagtttaggcagcctgagcctcctcaccatgcacacctcctaccccaggcccgggcaacgcagcag

SEQ ID NO: 137920 - DNA, 339 bp, Homo sapiens
atagcttatactgctgcgtcctgcagctgaagagagatagtggtctctctgtatgttcatgaccactcctctccagcgccatgctcaattctcacagcctctttattcttccacacttgaagggagacttttatagaagatgctttgaatattacattactgctccccattctttaatcttgcaagacctatccctcatcacattttcattaatgaatttgcccattacttcatggagaaaatagaagcaatgtgaaaacagccgtcatatccttctctcacctcattcaactacctctttgcatctgtactgaatgaggtgagagtctccgtcgaact

SEQ ID NO: 137921 - DNA, 413 bp, Homo sapiens
agaatcgagtcggtaccaacgtcatatgagcgggagtcatagggaagagaaagaaatggaagcacagcttctttcagacttccctgacaagcccatggcaatttgtcatcccctccttattttatttgggagagggaaatgtttcagaaacaaaagggcctcatcccctttattttccctgtgtatacattcactgctgtccagtgctgtagacaaacggtttgtttgaaaacattttgtgaaagcctgctttgttccacagcattgtctccactcttgaggagcagaagcatatatctttatgagaaagatggaggcttgagttatgaaatacttttacatttaaggagataaaggatgtacatatgaatgggcacattttactgcacacttcagacgcttatatgactttt

SEQ ID NO: 137922 - DNA, 361 bp, Homo sapiens
gagacccagtggttactgtgcacttaggaaaaccttcagccacatctttcttattagtttacagtgaaatgttatctcagggacattcaaacaaaggaggaggagtcatagggaagagaaagaaatggaagcacagcttctttcagacttccctgacaagcccatggcaatttgtcatcccctccttattttatttgggagagggaaatgtttcagaaacaaaagggcctcatcccctttattttccctgtgtatacattcactgctgtccagtgctgtagacaaacggtttgtttgaaaacattttgtgaaagcctgctttgttccacagcattgtctccactcttgaggagcagaagca

SEQ ID NO: 137923 - DNA, 550 bp, Homo sapiens
aagatgaactcatgtcatccagcaaccctgtgaggtaggtagttatgctggagtggacactgaggctaaactgctttcccatggcctcacagtgctaagtgatgaaaccatggctccagccctggtagtctggctccagagcatgtgtttggaaccactatattctgctgcttgtcttggttcccaaggtgggaggttcagatcctctatttatgacaccaaacacagctggccagtgctggaacgaatgccacgtgttctgtctctgagacttacccttcaacgagtgtattcagtgtgtttagagcctggtgtgcagtagcatcgggtggcctacatcttctgggatgcttgagacggaagacctgtgagtaggaagctaacactggctccatctgattgtaccattaggccgagttctcttttatcccttgagtggtatgaaactaaaacccttttatttcattgatttgaatatttgagtacctaatgtggctcagggtaggtactttctaaccttgaggcagttgagtaaatgagcacaataaac

SEQ ID NO: 137924 - DNA, 321 bp, Homo sapiens
ataacaccatcaaatgattttttaaggatatttcaaaaaccagtcaagcacacttttgaataaaaactttgcaaattggaattaaataaaggaacatgatatagaaaacatcaacaagaaacttaccccatgaaggtttgtttatagtcagtttcagcatcccctttgcttgtgaaggatgagtgactattgggtatatctcaatgccatatgtattattgaataggtttgttacagttttatcagagggaaattctatgaatggcagccagtgcataccttgaatgattgaacaaccaaagcatcctcctagaaggaaag

SEQ ID NO: 137925 - DNA, 515 bp, Homo sapiens
ttggtgaagtcactgatccatttatgtctcaatagttgaaggaagaagtcatgttgaagttcagtcagtatgagctagatgtggatgtatttaagtggttagttacaaagggaaagtccagcttgaacagaggccatgcagggatggggatgaggtgcagtatagatacttgggggctggtcagcttccaggggtgggaagtaacaggaaggaaagctagatcacagggatcctgctgagcttaagccatttagatctgatcttatgggcttgcagataggtaactggggcaatcatgtgataaaactaatgttttacaaaaatgatccattagtttgtagtatgctttgaaaacgggagagtcttaaagcagtggaataagttaaaccgtagaactacttctggcaagaggtatggagttctggtccttctgtctcatttgcatagccacctgctcccacatgtggaacatgcaggaaagaatacaggactgagaataagtgggttctgtgtgg

SEQ ID NO: 137926 - DNA, 486 bp, Homo sapiens
atgtcagattgataatttaggtagagttctggaaaacattaatctacaaacatatgcctgatagaaggatatttgcagaaatggctgcaagtgccatattgttccagctggtgagtgtggtccataaaaattcagtctttaaaaattatagtatagtccaattgtaggactgtgtgctcagtgaaaatgcactttacctatagatagggttgggagaaccaccctgtcttaccacagtgtatgtccgctcaacacactgccatgacctgggaagagaactttagggggacattcttatgaagcccttccctgtacctttttgttagttccttataatcccagaaattttctattagggtagataaatgaccataaaacctttctaccccgttgaggatgtttcttaggacttcttttatgacaaccatctaaactcagccacatctgcctctggcatgtctagtttggggccacctctctgcatcc

SEQ ID NO: 137927 - DNA, 841 bp, Homo sapiens
atggaacaaattcaacgggaaacaaccattatccctgaggcagctagagaagctattcagttttttacgaggttacttgtcggggcagagtctggcagaaacaatgggaacaaattcaacgggaaacaaccattgatcctgaggaagacctgaacaaactagatgacaaggagcttgccaaaagaaagagcatcatggatgaactttttgagaaaaatcagaagaagaaggatgatccaaattttgtttatgacattgaggttgaatttccacaggacgatcaactgcagtcctgtggctgggacacagagtcagctgatgagttctgataccaaacactcaaaacatgcattgggctagcagaatatccatgtttattaccagactggttctggaagaagctgtaaagaatactaaatatgttgggttataggggattgaccatgttacttttcaaaaccaggacatttaaagcatctactatgtaggtgcatgaggagtatgggaaaaacagaataaaggaatctgcctttaaggagcttacaatcatgccgggtgcggtggctcacgcctgtaatcccagcactttgggaggctgaggcgggtggatcacctaaggtcaggagttcgagaccagcctagccaacatggtgaaacctcgcctctactaaaaatacaaaaattagccaggcgtggtggcgggtgcctgtaatcccggctactcaggaggctgaggcaggagattcgcttgaacctgggaggctgaagttgcagtgagccgagatcgcgccattgtactccagcctgggcgatgagcaaaactccatctcaaaaaaaaaaa

SEQ ID NO: 137928 - DNA, 1285 bp, Homo sapiens
ggctaggtgcgaggctgggtttgaatcggccgaggcgctcgccgggacctggaatccctgtacgccgaggtgggagccggtggaccggtcccccagccggcccccacctccgcttcccggtgtttgagggttcgggcctcccgccggggagttcacccctcgggctcgtcagtagggctgtggctgtcgcctcttcctgcagcgccaggctccgcccggtctcacagtcggcttaggggctttgcgtgcactgcggttgggtggaaaaacccactcctggttgtttagacgttggcctgcagacgatgtcatttctgtattcctctaaggcaggaagtcattatgcaacttacacatattcatcagatttcctctgacttacccggacatgtacgtgggaatgatgtgcactgccaagaaatgtgggattaggtttcagcctccagctattatcttaatctatgagagtgaaatcaaggggaaaattcgccagcgcattatgccagttcgaaacttttcaaagttttcagattgcaccagagctgctgaacaattaaagaataatccgcgacacaagagttacctagaacaagtatccctgaggcagctagagaagctattcagttttttacgaggttacttgtcggggcagagtctggcagaaacaatgggaacaaattcaacgggaaacaaccattgatcctgaggaagacctgaacaaactagatgacaaggagcttgccaaaagaaagagcatcatggatgaactttttgagaaaaatcagaagaagaaggatgatccaaattttgtttatgacattgaggttgaatttccacaggacgatcaactgcagtcctgtggctgggacacagagtcagctgatgagttctgataccaaacactcaaaacatgcattgggctagcagaatatccatgtttattaccagactggttctggaagaagctgtaaagaatactaaatatgttgggttataggggattgaccatgttacttttcaaaaccagcactttgggaggctgaggcgggtggatcacctaaggtcaggagttcgagaccagcctagccaacatggtgaaacctcgcctctactaaaaatacaaaaattagccaggcgtggtggcgggtgcctgtaatcccggctactcaggaggctgaggcaggagattcgcttgaacctgggaggctgaagttgcagtgagccgagatcgcgccattgtactccagcctgggcgatgagcaaaactccatctcaaaaaaaaaaa

SEQ ID NO: 137929 - DNA, 1405 bp, Homo sapiens
ggctaggtgcgaggctgggtttgaatcggccgaggcgctcgccgggacctggaatccctgtacgccgaggtgggagccggtggaccggtcccccagccggcccccacctccgcttcccggtgtttgagggttcgggcctcccgccggggagttcacccctcgggctcgtcagtagggctgtggctgtcgcctcttcctgcagcgccaggctccgcccggtctcacagtcggcttaggggctttgcgtgcactgcggttgggtggaaaaacccactcctggttgtttagacgttggcctgcagacgatgtcatttctgtattcctctaaggcaggaagtcattatgcaacttacacatattcatcagatttcctctgacttacccggacatgtacgtgggaatgatgtgcactgccaagaaatgtgggattaggtttcagcctccagctattatcttaatctatgagagtgaaatcaaggggaaaattcgccagcgcattatgccagttcgaaacttttcaaagttttcagattgcaccagagctgctgaacaattaaagaataatccgcgacacaagagttacctagaacaagtatccctgaggcagctagagaagctattcagttttttacgaggttacttgtcggggcagagtctggcagaaacaatgggaacaaattcaacgggaaacaaccattgatcctgaggaagacctgaacaaactagatgacaaggagcttgccaaaagaaagagcatcatggatgaactttttgagaaaaatcagaagaagaaggatgatccaaattttgtttatgacattgaggttgaatttccacaggacgatcaactgcagtcctgtggctgggacacagagtcagctgatgagttctgataccaaacactcaaaacatgcattgggctagcagaatatccatgtttattaccagactggttctggaagaagctgtaaagaatactaaatatgttgggttataggggattgaccatgttacttttcaaaaccaggacatttaaagcatctactatgtaggtgcatgaggagtatgggaaaaacagaataaaggaatctgcctttaaggagcttacaatcatgccgggtgcggtggctcacgcctgtaatcccagcactttgggaggctgaggcgggtggatcacctaaggtcaggagttcgagaccagcctagccaacatggtgaaacctcgcctctactaaaaatacaaaaattagccaggcgtggtggcgggtgcctgtaatcccggctactcaggaggctgaggcaggagattcgcttgaacctgggaggctgaagttgcagtgagccgagatcgcgccattgtactccagcctgggcgatgagcaaaactccatctcaaaaaaaaaaa

SEQ ID NO: 137930 - DNA, 1254 bp, Homo sapiens
caagttcaactgtggctacatctttgctcttaagctcaagagcgtgctttaagttcaataaaataatatcattgttcatattaatgttattaaggtaaacttattcattttgtgaccctgcatttccttcaatatttgttctaaaactgttttgtatgagagtataagcataaccataaaaacctggttgggtaatataataaaaataatgtggcaacaataagagggaacaagattttggcgttcctttaaaagtttctgtatattttacttaagtataaagaaaattgttatgaatgataggaggaaggatttttgtccacctattaaaaaaaaactgctgtgaagcataggaagtttcaagcataaaatcaagcagtagataaatgttctttgaacttacgaatttcaaattataaatttcaaccatgctattaaagatattcaacacagtggatattccttttgctttcaaatttatctaaatatatgagacaggcaaaagctcaatgcaaaaggcatgactttataaaatggatccattttgccaacagctcaaagaattatggtaatattgtgggaactgagtgaaaattcagagtaggttttgaaatgtgatacaagtagaattttaaaaagaaaaagaaaaaatttctgtatttagctaaaatcataactgtttcctttgcaaactgacataaaaatgaagaagcaaaatgtgtctttagttatatccaagttccaaattcaagttaattactgctgctcctcactcttctaccttttccttcaaatttaaagatgggctttgcagagattaaagcttcagaaaaaaatatgggaaaatatgttaaaatgttgacctgaaaatgaagtggatgactataaaactcttgagagaattagactttttgtagcagtttattacatgataataccttaaaggagatcacattcagtgacctgcgttgacaggtaatatttaaaattaagtattaatgctgattaattcaggcagatgggtggtagcctaaagtatagacatttttccaatattaattttgatattaaataaatgacatcggctcttgttggatattgtaaaatttcctttacttcaactgtaaaataatttcaacagtgaaaggtataaagtaagatgaaaatttccatcatgatcttacctagagataacttctctttttttgagtcggagtatcgctctcgttgcctaggctggagtgcaatggcgtg

SEQ ID NO: 137931 - DNA, 477 bp, Homo sapiens
caattttttaagtcacattatcccctaaattctcattgtgtaagattcaaacaacatagaacacaaagttctcctttggccagctccttctgttcccctccctgtttgaattctcatgaggcttgatctttaacattatcatttctgtttgtgtattccttaggaaggctaagattatgaaaatatttttatggctttgtttttatgcataactctataaagagtttcttcctagtccatgaagaactttactttggaggtggtgttaaaaaggctgtgtaggccgggcatggtggctcatgcctgtaatcccaacactttgggaggccgaggcaggcagatcatgaggttaggagatcgagactgtcctggctaacacgatgaaaccctgtctctactaaaaatacgaaaaaaattagctgggtgtggtggcgggcgcctgtagtcccagctactcaggaggctgaggcaggagaa

SEQ ID NO: 137932 - DNA, 1349 bp, Homo sapiens
tgatccagaattgtctttctgaaaggaagcactcggaatccttccgaactttccaagtccatccatgattcagagatactgccttctctctctctgggattttatgtgtttctgatagtgaattgttgatgtatttgctactttgcttcttttctctttcaagacttgatcattttatatgctgtttggagaaaaaaagaacttttgttagcaaggaggtttcagaaatgattttggattttctgtaagtgtttaatttagttctaggggacagcatctctcatcccggagtaaatttctgcctttgacctgcatggattattttttcaggctgcggaatttctcggcacctacctgtagtatggggcacttggtttggttgcagagtaagaaggtggaagaatgagctgtacttggttaagcagttgaaaccttttttgagcaggatctgtaaaagcataattgaatttgtttcacccccgtggattccagtgggcccgacagcgcaacaggtttgcagatttcttttgaaattcctttttcccccctccctctgcctcagcaaaagaaaagaatccatataacaggttcatgttcaattgcttggcttttcagcacttattctgaagactttataatatttttaaacttgaccttggaacacagagggctttgtgggtgaggtgtatttatatttacttaagggtgcacattttaaaaatcttattctgtgtttgtacaaagacgcaaattttcatagtgcctagaaatagcacagatctattctactcaagattatttgtattttttcagggtattctacctagagcctgtggttaatcgcctccctgctccccctaccttttattccctaccccctcagggaatttggatacatgtgaggaatagtcctttgtttttcttatgaacctagaaaattacagatcataaaatctggatattaaagtagtttccaaaagcatctcatgggaaatcaaagtgctcggcatttccgagctggagaataaaatcaagaatccttaagagagaaaagaaaatggagatggaaatatgaattttaactgggaaaaataattggaaagctaaccttttcaaatactctaattatgaaagttggaaaaggttgtgatgctcaggattatcctgtaatgtgtgaagatacataaattagcacctaatttataggcaaattttggtaaaacacaaaaaattatggtatgtctaagttcatgaaaagtatgtaaatgcagtgggcctagaaacctggccacactgaaatacagtttaatgtggaaacttttctaaatacatattgtagcatctttgga

SEQ ID NO: 137933 - DNA, 161 bp, Homo sapiens
cccaagttacacctgaagagggcactaacacatccaatggtaatctcaggctaaggaaaaaggaaatcagtcttgtgccatttccaggaggaacagcagtaaaccttactgattcctcacccgttaattttattaccgaatttggggaaagctcttgtttt

SEQ ID NO: 137934 - DNA, 466 bp, Homo sapiens
actaccctcacaattgcctacatcccccaattccctctacactatgaaggaggtgctatttaagcttcaatcatctagccaatcttttggtgtcacatcttctatggttcctgtgtttatgcatgtatatgactgtatatgaaggtttttatttgtttttatttttttcttctgcctgaaaaaaataaaaagttttaactttttatctggactccttttagactcagagaaaagttacaaaaatagtacaggttatttccgtattgctcacccagactcccccagtgctaacatcttacataacgacatacagtacaataatcattgtcaaaaccaggaaattgaacctgcttggttgggaccggttgggagcgtggagagactccctagtgcagggtaagtgagagatcccccacgagccacatttccattgtggactcactcctgtaatcctagctatggaaga

SEQ ID NO: 137935 - DNA, 494 bp, Homo sapiens
cacgctgtgatgtcctgtgagtgcccgaagtttgaccgtgcagccacgccactcatggacttaacccctcgcatcactgcgggacattcagcagcttcctattttgtacggttgcgttgtcttacacgcacatgcatctgtccccccaactggaccctagcgttcttgtgggccatgtccttctctcacacttcctcgcacccctcaggatggtgaagagctgacacagagaagactctggtgagtgttggcggctgacctgagcaaccaacccccaacattggagcatcatcacggctgacctctgagagctgaactgcacaggagaatttaactacaccaggagcacttagtcattccttcccctgggtaacaggaggcagggcccagccatgcaatgaactgccaaatgcctcaggtatctgcttgatctcttgggtctcctaagctgcttctctcccagcctccctctctcattcatcgctcgtgttggc

SEQ ID NO: 137936 - DNA, 104 bp, Homo sapiens
atgaagagctctgtgtctgtggagattgctgtggtgtggagagttctgtgtcagtaaagagctctgtggtgtggagacctctgtgtatgtggagagctctgtgg

SEQ ID NO: 137937 - DNA, 271 bp, Homo sapiens
gattcttgcatcgggatggcctaaagccttctattcatagtgtggtgtgagaccagccacatcagcattacctgggaacttctaagaaagcagaacctaaggtcccattccagacctgctgaatcgaaatctaagatcctcagtgatttgtttgtgcgttaaagtctgagaagtactggctgaagcctttggaatattgataataacagtttcactttctttcagtatcaaagaatgttcctcaccctgagaataatagtaatagttaata

SEQ ID NO: 137938 - DNA, 404 bp, Homo sapiens
ataaaaacaaatctaatgagagaaagcagatcactggttgcctggatgggttgggggaaaggctgttggtggttcagagaattatggggagctgtgagaaaaaaaacacaggaggcaactcttgggattgagagatatcttcattatcttgattgttgtgacagcttaaggagtgtgtacatatgttcatacttatcaagttggacttttaaataagtacagtttattatattttagttgtacctcagtaaatcaataaacaataatagctgacacaaagtgttcttttaaaatgtcaggcactgtttttagttctttatataatatatataagacatatataaacatatttagaacaatacttaggtactcaataaatattagttgaaaataaatccagttta

SEQ ID NO: 137939 - DNA, 248 bp, Homo sapiens
ctcagcctgcctgcccttacttctgatttcccaagcagtgtgggagctgcatcccttcctcaccgttgttcctgttccgggccaccattcatcggaaagcaggccagcttggcagcagccccattcctattcctgcccccctccggcaccctgcccaggcctccggaagcccaaacagctgatctgagatgtcaataaggcccttccagctgcacctggcctggctgaaagggagccccgggggtacc

SEQ ID NO: 137940 - DNA, 351 bp, Homo sapiens
tctacagtcaggaagcaggcttgagcaagtggctcaagagctccagttgtttttattaagcttaggtttttattaagctagaagaatttggtaacacccccaggtatccttgggaggcttccaattggttacaccctatataaatgaagaattggctcatggccaatcagaggctgcagtggagttataccatatgcaaataaagaattagcccacagcccatcagaggctaaagctttcctttcagtttaattcaaggacgtcagccacaggttggccttaggctctgtctccagactctactttcctacctcagcttgccgccctccccttggtgttgagttcttgccc

SEQ ID NO: 137941 - DNA, 326 bp, Homo sapiens
tgccatgcactttgggtagcttcccatccagagatgtggcaaggatggcaggttgttccactgttggagatgctgagtctgacgttggcttaggatgacagacagctgtctaccctcagcagagtgtgcttttccctctcagtctgaaagtaatctgtttgtgaccctttggcatcagctctcttgcatcctgcctgaatcagtagtttcgttggggttggaaaaatggtgattttctttttttttttttgaaacagggtcttgctctgttgtccagactggagtgcagtggtgtgatcagagctcactgcagcctcaacctcctg

SEQ ID NO: 137942 - DNA, 328 bp, Homo sapiens
tcactatgaaaatccaagtgtgtcaaagaaatattgtaaaatgtacatatgatataaagccaagaagagccacatggcttctgtaagaatttgcaaatactgaaaggatgaaaatactcttactctactttttacaccaagaaatagcaaaagctttatagcagttgaatttatttctttgcaaaccagagaaagcaaaaagcagttagcaaagctatatatccctatgaaggaacgagaggcccggttttgttagtaactttaaaagctgcatcacatattaacagacatctgcttatctattcttttgctcctgttttcccagagc

SEQ ID NO: 137943 - DNA, 256 bp, Homo sapiens
acaagattgtggtgatggttgtacaactctgtaaattaactaaaaatcattgaattgcacacttaaaatgggtgaattttatggtcttaaattataatttgataaagatgtttaaaaagtgggtgatctgtgttcttattaaaatggattataatgtttttcaatatttcatgtgcagtggaacttttagccctagttctcttggccactggaatatgggagtggagtgaagtaggtaatctatgccttgcctaag

SEQ ID NO: 137944 - DNA, 154 bp, Homo sapiens
gcacctagcccctaaatccttatctttaaaaaagtcttagggcctctatgtttttcttttaaacaaggtcttgtataaagatggattgctctctagaagagaaaatgtttccagtttttgagtcaatgcctgtgtcatcttttgtcttctttta

SEQ ID NO: 137945 - DNA, 536 bp, Homo sapiens
cctgtatgttctgatgcatatatcccgttttttttacaagaaataaaaataaagaaaaaaaagaaaatctcttgcaaccaatgaaaatgaaaacaaaatataccaaaacatatgggatacaactaaagcattgctaagagggaatttcatagtgataaatacctatattagaaaagaagagaggattttaatttagcagactcacctagagagcacaactctgattttgttgagaaagcctatctccacagaacctaaaacacacaaactttcaaggtaggggagattggaatccaagaagaatgcaaaaacattttgcaagctggtaagtctctggactggagaatatctggatcaggaaggaggcaagatggtcgactagatgcagccagaaggaacatctcccaccaaaggactgggacatcagaaagactggcacactcctagcagatcttcacagggaaggcactgagggcagatagagggaagacacagatgctgggctgcagagggaggaagctgggaaccctgagcaa

SEQ ID NO: 137946 - DNA, 693 bp, Homo sapiens
ccgggcccctgctcctcagtggtgcagccacaagcagaattttcagaagcatggatgggatttccgacttcatctagacttcacatccgctttgttcagaaaagaaaactcaggcccggagacggatagttagtgatttgccaaaggtcgtgtagacatcagtattgctgccatcccaggagccagactcaaatctccttactgacctgtctatctcaacaccctttagaaagagagccaccaacactggagttggagaggctaggggtttgtttgaacagagaagggatagtgtgaggtcaaggatgcaaatttctaaaattctgagctgggttaaaagaaaaatctttctctactgtggtaatatccacattggaacaagggaccctcctctcatcccttcatcaccagactatattcaagtcacgtatccccacccagagggaaaggttagctgcagatgaagaagatggagcacaaacactattattgcctgattcactttgtggaaaattttctaatcctggccctgccatttcctggctgcgtgtccttgggatagcagaccaagatagcctgtccacagaggctgggtgcaagacccaggctgatccaatcctaagaccatatcctcctggcaaaatcagagaggagcgtgcgaccaagatgggccattcagatgctgtttcaaac

SEQ ID NO: 137947 - DNA, 372 bp, Homo sapiens
acaggcactccccaccacaccaggctaattttttgtatttttggtagagaggggatttcaccatgttgcccaggctggtcttgaactcctgagctcagcaatccacctacctcagccttccaaagtgctgggattacaggcttgggccgttacacctggccttagatccttttatttttaaatgtcagcaaacaactgatttttttccctcagttctttgcaggccagcgtgtaagggggaaagcaggtaagaaacaagtctccgggggcaagcacaggctccaagtagcacattaagaacctagatttccactggtctgtatcccattctgccttggacgcctttacttcctgctgctcactgagaagcct

SEQ ID NO: 137948 - DNA, 482 bp, Homo sapiens
agccaccgcacccagctgaattttccattctttcattattatatataattatttttttagaaattactttttctcgtggattattatattggactatgttccttaaaatgggtaaaattcagaatagttttaaggttcaattcaaaagccaaacccagagtgagcccttgccagccagtcaaaagtccttttaccctggaatggctcgtgcatctataggcatagacgttgaaagtcttaaacgacatccttcctttacagcgttaaatatctgttcctgatttcagaaatagacaatataataacacaaaacataagagaaatggatgtagagatgaaaacatgtagggcaggcatttaattggtgggatcacatgctcagtaattgttttgtccaccagtgattgattctgcttgtgtattgactatttgagaacactgtctctgtgaggcctggctgactcttggatgtcttaaactga

SEQ ID NO: 137949 - DNA, 766 bp, Homo sapiens
aaatcatcataccctaaatcctgtagagatgtgacaagacatacatagttatcaataagttgtatctaataacaacaatttttaacgcagcacaaaactgaaatgtactgccagtgatttcaaggtaacacagaaatacctgcatattcaaacaataaacaacatccgtattcagtatttttggtttaaaattaaggtaatggtagccaaaaagcaacatctattgtggagaaatttgactcatttaacaaaagacaacttagcttgctgggcctgaaggaagaactcataagtatttgtcctatctcccagcctgtccctcactactagtattctattatctcgtattacatgaaaataagtaatacacatggtactgttactttgatgccctgaggaaagctcaacttgctgtattcatgccattttatagtcccctcccatatttaatgcacactgggttatgtgaccagcactcaccattggaacattagcaaggatgaggaacacagaagcttgataaataccggcacactagggcttggaaaggtctttcacggaactgccatagctgccatgctatgaagaaggccaagctggctgggcacagtggctcatgcctgtaatcgcagcactttgggaggccaaggtggcagatcacgaggtcaggagttcgagaccagcctggccaacatggtgaaaccccatctccatgaaaaatacaaaaattagctggacgtggtggcacgcacctgtaatgccagct

SEQ ID NO: 137950 - DNA, 529 bp, Homo sapiens
catggatgtgtccacagggaggaggcagaaggatccagagctttgcactgtgtgctgatggcaagcccatgaagagaaaggacagagggagcaggagggtcaggagacagtaaaatggattctgttttgacatgggttgttagtgataaccaatcatcaaggtgagaatgtccagtagattttggaaggaggctctgacaatttggagatgcatcaagactaccatttagctccagggaatcaaagatgttgatgtgacaattggagaaataagatcagatgaaacagccaaaggagacagcctagaagatgaagatggcacagagagaacatgaaaaaaaaaaaaagagagagagagaaagaggagtcacacatgtggttcactgacaactaaacaaaatgtctgagattacaaatcatcctgccaaatactgcaagagtcacacacaatttgatgctgctcacagccttgagaaaggagctggagtgaggaacacagccaggcatagacaacactctgaactggaga

SEQ ID NO: 137951 - DNA, 190 bp, Homo sapiens
acagggacgtgtacattataccagccggatccacatacctggcagctgcaacctgttaaacctgtgtttttttcttctgtgtaaacactataaacaggaaggcaaacgtcatccatttacgcagaagagaaaattgatgatgaaaaactgtcactgctttgcttaaaaaagtctaaggtaaagaacgtat

SEQ ID NO: 137952 - DNA, 566 bp, Homo sapiens
ttgcacacaggctgtttcctttgctcagcacaccattccatacactcccttttaaggtccactgaaaatgccaagtttcaggctatgaatgaagtcttttccatcgcccttatcagaaggaaagtctccctccctttgatcccacacagcactttgtctgtagttctctgattacaccaaacacattctctactatactatagtgatttgtattcatagcttatctcccccttctcaatcacaagtttgtggagaacaaaaaagaagtttgttattcattttacatacctacatagcacctgacgatatctcaaataagagaaacctcatttttaaattaactgcacactgtacagaatgatctacaagttttacctgcaatgactattaaaaagggctgagttgacaatcacgactgtgaaatgagtttcaccttcaaaacccagcttcttggctctatcacatagctttaaacaatatccaatgcttccctttttcttttggtggttgttctgtgttttgcctttagaaggaggatggaaagaactgaggaagcagtaaaagca

SEQ ID NO: 137953 - DNA, 653 bp, Homo sapiens
ttgcacacaggctgtttcctttgctcagcacaccattccatacactcccttttaaggtccactgaaaatgccaagtttcaggctatgaatgaagtcttttccatcgcccttatcagaaggaaagtctccctccctttgatcccacacagcactttgtctgtagttctctgattacaccaaacacattctctactatactatagtgatttgtattcatagcttatctcccccttctcaatcacaagtttgtggagaacaaaaaagaagtttgttattcattttacatacctacatagcacctgacgatatctcaaataagagaaacctcatttttaaattaactgcacactgtacagaatgatctacaagttttacctgcaatgactattaaaaagggctgagttgacaatcacgactgtgaaatgagtttatatttataagctgcacatctgggatcagttgacttatccatctgctaactacaccagtaaacagtatgtctgggaccgtcaaacccttgcatccatcacaaattcctgctttaattgtgtgtttacgtggcaaacctctgcttaagtatatttgaagactgttttaagcagttgtaattgctcctttcttcttcatattaactttaacacattttatttacc

SEQ ID NO: 137954 - DNA, 318 bp, Homo sapiens
ggccggcagattttgagaggaggggaatgctggcgtggtggcagcctagggctgccaggctctgggtgtgtgttgggagggggggttgggggtgtgtgtgtgtgtgtgtgtgtgtgtatgcacacgcactcacgctgggcaggggtgaaggggacaggccaaaatggaagtggggcaaagagtccaaggtccagacgctgagagctgccacctatctgtccagtgtcattctgtgtagcccctatggtaggctgaataatgacccccagagatgtccacaacctaacccccaacatttgcgaatatgttaccttccat

SEQ ID NO: 137955 - DNA, 368 bp, Homo sapiens
cgtgctggtccgggattgtacgcgctctcctagggaggggtctgagctcaccctggcagcgcccgcgtcctcgccagcgcccgcgtcctcgccagcacccagccatggttcgcgattgtaggcactctcctagggaggggtccgagctcgccctggcagtgcctgcgtcctcgccagcgcccaaccaggcttgtctcctgagtgttgatcacacccctgacccggggtctgggagccagttcctggctgctgatgtttctgcacggatcgctgcaggaggaagacctgtacatctgtaaaaacacacatacctggtgctgttaccacacctgagaaactcacagtcactctctaaggctgccaggtgc

SEQ ID NO: 137956 - DNA, 410 bp, Homo sapiens
cagcctctgtgctgcagagaccctcagggtggggtggaaagtgtgcctgggtcccaacacaggggtccctagagaccacggggagtgttttgggaccatggacagcaggagtgcaggaaatgctccagatttgcagagaaggaggtggctggaggttatcttgggtagagggaggtctgaggctgtgagtgccaagtgaggggcaaggtacccaggcctctgaaaagcaaggacaggaggagaggtgccacctgagcgtgccccacctgggcatgcgcccatctgagcccctcctctgctggatgcgcggccacctgagcccctcctgacctgggcgcgcgcccgcctgagcccctcctctcctgggcgcgcgcccgcctgagcccctcctcacctgggcgcgcggccgc

SEQ ID NO: 137957 - DNA, 711 bp, Homo sapiens
aaatcaagtaacctctattattattataagcattataatgcttgagatggaaactcaaaaatactcatttaatgcaaaaaggcttgaaagtaacaatagaaaaagtccccaaacaataaaggaatgtatgtgaactgatcactcaagcgatgttttcaccagctctgtatcaagaagaagagggggaaaaaaaaaaaaagctcctgcaactttacagacactttgttcctccgacccatcaactgcatgaaagatatgctggcaaaaagattgaaggttccagggtcttgagtagccaagtaatcgtgctttagaatcaaagggttcttttcagcagaccacagttgactcctacctttaacacaacactcaacattccaggagaggtttttgccttcccttcaatccttccaacacacaagttgaagactaagagggaggtaagccttttttttcccctactttcacccaggggtgccctcttaatccaagacttgtgtgtgtgtgtgtgtgtgtgtgtgtgtgtcccttaacacagggggcaatgactcttatcactttcaattacattatttgtaaattgtttttttaaatatgttattctagagacaacacaaaaaaccttaatttagatttttttaagtctctaaacattaaatgtattgacacaaaatttaaaatacaaaacttttagaatgttactttgacgcg

SEQ ID NO: 137958 - DNA, 738 bp, Homo sapiens
caccacagggtctgacagggcttaccgccatacctgtactgcactccaaacagtgggacaaagcaaggggcatgaaccagaagctgcacacaccatctctgctcacccttactggccagtcacatggccatacctggttgcataagatgctgaaaaatgtaacttgtattcagccagccatgtgcccagctaaaattttttattcaggaagaagaggaagacaggtactggaagataaccagcaatctctcccacccccacgcttgtctttttcaaacagaagcagcccaatctggcaaaagtaccgatccttagatctggagacaaaactcaacaacgggcttctctgacttttgtcagacatcttgcacatcacatgtagatagagccagagactgtaacgcatcattgtcagcgggaagaagatacaagcttggagatatgcatcagaatgactacccatgcaaattcttgaattttcacctgagggaggtgttggaggaataaattgttctacgggacaaaatcaggtgcaatatcaaaattccatgtacccactctagttgactgaatacagtgaagcatttccagtacaacaatataggaaaacttcaaataaaggggtattctctaaattccactaaatacatcatctttggcctgaaactatcttgttaagctacttgttgagactcttcactctagatatgcttggtgctgcctttgcattcaagtcct

SEQ ID NO: 137959 - DNA, 295 bp, Homo sapiens
ccatgattttaaatgattcactggaaaagtacaaaatgaacttcccctctctgaagcaaaaagttgtatatttctccactgccttttcacatgaaagagaaagaaaattggattttgccagtgggattctcaccacctagaggcagaattaaatattttatatcacaaatttggacacttttaacttactttttaaattcttagagcagtgtgtgtacacacgcaggtattgttacctgtaaataagttagacactctttgagtgtttgaggttttaaactacaggaaagattga

SEQ ID NO: 137960 - DNA, 279 bp, Homo sapiens
caccactctaaccctctctgctggttcagcatttcttcacctctgcaacctgctgcacaagggggagcgtggcaggggtacgggggtctcctgcagtaatcgagaggctctgtttagccaaaggcactccagatcaggcatggttctgttggattttctgctaatgttcatgacactccaccaaccacccgggcctttgagtcaccaagaatatcacctggtaaccctatgtgatttcagtaacatagtgacttctgacactctgtagcccatcttccc

SEQ ID NO: 137961 - DNA, 149 bp, Homo sapiens
ttcgatatgtcagggactagaacaaacgctttggtctatgagaaattttgtggatttaaagatgtttgtcatctaaacattgatcatcatggacagtgtcacccctttattgaatggacagcatatggaatcctggggtcatgaattgt

SEQ ID NO: 137962 - DNA, 388 bp, Homo sapiens
taacactctaagtttgcatagttgatagtaaattgtacttgaataggtcgaagagcaactctaactaatttatttgcctcctttttttttctagccagtaacttgctttattcttgaaatctgataatttccaaatgtcaggagaggcagcattgtaggtcccatcatgtaatgtcatttggaggagtgctgagcatggactccagccagatcgcctgcactcaggttccagctcaatcccttactctctgtatatgatctcaggcaggtcataaacactctctgactcagtttcctcatctgtaaaatgcagatgataataggacccacctcctgaagttgttctgaggattaaatagtatactgtgtaactgagaactgcctcatt

SEQ ID NO: 137963 - DNA, 398 bp, Homo sapiens
ttggcaacaccctcacagacacacccaggatcaatactttctatccttcaacccaatcaagttgacactcaataatattaaccatcacaaacacttagaagacaggaagagcaaacaagaaggaactaggaaaggaatggttagagagctagggagtgggagcaggagtatgagtatgtaaaaggccactttttatgagccagatactgccaacatgcaaaaaccaaaagaaaagtaccccatgccttgcaggaaggtcacttccaaagtcatatcttacccacagcaccagcaaaatcctaagaagtcacaaataagagctagctccacaaatgactcagtaacaaagtttaaacaggtatgtgggaggttattatgttaaaaaaaattttccgaaa

SEQ ID NO: 137964 - DNA, 389 bp, Homo sapiens
acatcatggtagtacaagtactatataaaacagtattcccaattcttctctcttgtactcttatagaatgactatcattcatttcattcacaaataagctataatcactgaatgcattgtcattgttattttgaacaaactgttctgttagatcaataaataataagaaaaatttaatattttaccttctttttttctttcctaatgctcttccattttttttaatacagatctgagtttctgccgatatatttttcttctctctgaagaactttttaaaatattacttgcaaggcaagtctactggtgacaaattttctccatttttgttggtctcagaaagtctttagtatttactacttcactttaaaaaattgtggcaaaatata

SEQ ID NO: 137965 - DNA, 521 bp, Homo sapiens
atgctttccaatgaaccaggagttacaaggtcctgaaaaccacaagtgtgttacatcctttaatagataaagcaaagctgatattaatgtgaatatactttatatttacttatattcgtgttaatttttctttgcctgtaatacatatttttatataatggggaataagaaacatcttaggaaaaagaaaacaaaaaataaaatttcactgtttacactgtgccttggtccagtaaccctgcactgcacatatacactttaaattggtgtcttggggaaccacctcggtatttcattttaatagcgcatcctggagaatatatttgagtggatcacatattacaactgatttaaattttgacccatatagaaatgttttcaaaaatatgtctgaagcctggatactgtaaaaatgtttatcatcatagaataataaaaggctagccattagttactcagaaattgttcagtaaatctaagatgacttagacataaatagttatgagtgaatatagttcatc

SEQ ID NO: 137966 - DNA, 382 bp, Homo sapiens
agatttgaagccagtcgggctagagggtccatgatgtcatcagtcacttttctccaggtggcttccaagaacagggaggaatgagagagactcagaggtagcactgagatgaaggaagtacagagggagactgggctgagcaggccctttcggtaacaagagggataagtgaactcacctgtattaagtgtccaccaggcacactttgcatgcatcatctcattttaatcctcacactaggccctgaagaaaagcattttacaaactggtcaaaaaacctcaagagagatgaagtcatttgctcaaagtcacttagattgagtaagggcagagctgtcagaaaactagtcagaaagggactatgagaggtgacactctgata

SEQ ID NO: 137967 - DNA, 536 bp, Homo sapiens
atcccgtcaccgacatcctgaggtataaagtagcagcgttaccattttatatgatgcaaaaagtagcagatcagaggttgacatggcttgctcatctccttacaggcatgagccaccgaacctggcctgcttgttactttagacccttcttatgttttgtttgttttttcagggaaatgtttttaaagaaaaagtgcccctattgcctatttagtgcattggtttgaataaaaaattgttgttttacttctgcctttgaatgtggcatttttggacaaggtttgtcattccagaatattctttccctaaatagaggcattactgtacttttggaaattaagcctttgtaattcattttttgatgtaggcttaattgtatgcctgatctcagcaaagactaaccatatactcatatagtattgattttgtttcaacttgtttagaaatatttgttgcttattttatgatgtcgttttattccattgatttgcaaagtgatgtgattgtatttggtgtgaacacttttcttcagttgt

SEQ ID NO: 137968 - DNA, 425 bp, Homo sapiens
tgagtgaggtgcttgaggatcttcgtgcactgctcggatggacaatggcagtattggaaatgtgacagcaatggccttggagcctgcagatttccccaaagagaaaatccaattagatggactatcttacgtcagcaaatgaaaacagaaggtgaatgcataatttcatgagaacattctttttctctgcttattagattaggtgatctaacaaggcactctgcttctctcaataccaggaagtaaaatgcattttaactgtgccaggagttgattttgctatttgccgtttgttgtgggatgacacgtgacacctaaatattctctcatttaaacaatatctagcatgctgcacaatgggaataagatgctccaggaggccccactgctgaatgacacagacccagagtggtcagggctccatg

SEQ ID NO: 137969 - DNA, 108 bp, Homo sapiens
ttttccacggaaatgagcacacacagtctctgtggaggtctgtaccttcccaaccctttctgccagggccacccctgcaaatcgcgctcgtcactgagggagcctcgg

SEQ ID NO: 137970 - DNA, 321 bp, Homo sapiens
aagttgcagtgagctgagatgaagccagcctgggtgacagagagagactttgtctccctctcccccgcaaataaataagtaaataaaggaatacagcgtacaaaagcctactttatatctttaaattggttttacattttgcttttctgattctattgtgagaattagtacttctccaatagttgttggtctttatgaagtatgaagacttagtagctttgaagataaaattaaatattcgaatggcagtgatgccacagtcactcaggattcaagaagaagcattagccagtggtgatccctaccagccccgtttcctct

SEQ ID NO: 137971 - DNA, 556 bp, Homo sapiens
agaatagtacctgatacacctgacattagctgtcattgtcatcatgttgatcatcactcacaggaattgaaatctcccctgtattgcccctggaatactagtagtcaaaaacatgttgatttaattggaaatgataacttatctttatttatgttctctttggacactagtcagtccttagctacagttactagaggcaactagactctaagtgaattttgctacttgtattttattgcatgacaataatggttaagacctggcttaagcaaaagtgtgatgcaagttaagttcggcatacttcatctctcttttctgcacttttctcctttttgtgggctttctgatactcagaccaaggctctatttctcccattatggggagaagtgtcttatagacaaactcagagttgtttgttaatgactttaagtatcatttctcaggaatgtttaaatttcatgacagggtactagagagggtaatgcttagcccgaaattcagaatatctaagagtggatgctgttgatgtgtggtagggctgggagacagttagca

SEQ ID NO: 137972 - DNA, 329 bp, Homo sapiens
catgagctaccatggccagcaagaaatctttatttcttaaaacagatcttcttcatgaaaagaaggtcttctctggaatcagtgatgttggtacaaagtaggagttacaaactcagacgtctacagaggcttagcagataacaaaaaggcagcctgtggtgtttatgctcttgaatttgtttttgaagtacttataacactctgtttatatttacagaaatttctttactgtaaaaaaattagaaatgttagatgtgatgataaataacactaggtgttcaccctcaacactgggaagcagcagggagtgttgaggactgcatggaaat

SEQ ID NO: 137973 - DNA, 249 bp, Homo sapiens
ttttaaaatgtctttttcttatatatttcattttttaaagagatgaggtcttgctatgttgccgggcttgaatgcagtggctattgacaggtgtgatgtagcttcaaactcctagcctcaagcgatcctcccatttcagcttcccaagtagctaggactaagccaccttaccctccaaatcaaatcagtaactaaatcctctgaattttgtcttatgtcttttatttttgagatggagtctcactttgt

SEQ ID NO: 137974 - DNA, 314 bp, Homo sapiens
tcttctaacatttttgcccacagtgctatagtatttactttgggattggaaccagatttttccctcttaatcagcaattttgatatctggctagacttttagaggttctctttttcatcattctttcggattctgtcctgttgccagagtttgttgcttctttttgtttttgtttttgttttttgagacagagtcttgctctgtcacccaggctggagtgcagtggcacaatctcaactcattgcaacttctgcttcctggaagttccaatgattctcgtgcctcagcctcccgagtagctgggattatagacg

SEQ ID NO: 137975 - DNA, 378 bp, Homo sapiens
aaaagggagaggaaccctcagttcgggaactacctatctctttcccagaaaactcatgaataatccaccccttatttagaatataatcaagaagtaaccataaaaatggatgactatttttatgcctatggactagcccttcttttattcctttgctttcttaataaacttgctttcactttactctatggactcaccccaaattctttcttacatgagatccaagaaccctctcttggggtctgggtcaggacccctttccggtaacacaactactctcactttacagaataggatataacacattttgcactttgttattaagggcagcacaaatacaaaacttaattttccaacagtttctctattgtctacaat

SEQ ID NO: 137976 - DNA, 581 bp, Homo sapiens
cccagggacctcacccttcagtaatcacccaccccctgcctggagagtggggcccaaggatctcatgccccaaggctgttctggcctaggtagtctggtcctaggtctgactcactccgaggtgacctcagggttgtcccctcaccaactgagctcattccatcaaacaaatacaccttaactcatgagaggggatggctggagccagactgcctgggttcaaatcccacctccacctcttcctagttgtgctaccttaggcaaggtgctttacctctctatgctctgagagcagtgagcacacagtaagctccagataagtatttgtcattagtgagcatctaccatgtgccaggtactgtgctgggacacggtcctgccctcaagaagctcacagtctggaaggaagttggttggactcaggagtcctccagactctctcaaggccccaagaaggggaaggaagagaaagctttgcactggcctgcctccttgaggaaacaccagtagctgcttagggacccagatcagaactcctggtaccatgcaggtgagaacttgatcttgaccagtcccatcct

SEQ ID NO: 137977 - DNA, 567 bp, Homo sapiens
tcttgcttttggggtttgtttatatttgtgtctgccaccttggttcttcttcacactatgaagtcttgttggttgctttcagaaaaactcaggatcatagtttttcttaaggacacctgtgtgaaggaacaacaagaaaactgataatctatttatcttaaatataggttaagtggtttaaagatggtgctgaaattaaaaagggcaaaaaatatgacatcatatccaagggagcagtgcgcattcttgtcatcaacaaatgtctactggatgatgaagctgaatattcctgtgaagtaaggacagcgagaacttctggcatgctgacagttctggaagaagaagctgtctttaccaaaaatcttgccaacattgaagttagtgaaacagacactataaaactggtttgtgaagtctccaaacctggcgcagaagtgatttggtataaaggggatgaggagatcattgaaacaggaagatatgaaatactgactgaaggacggaagagaatcctggtcattcagaacgctcaccttgaggatgctggcaactacaactgtcgactcc

SEQ ID NO: 137978 - DNA, 184 bp, Homo sapiens
ccaagaactctatgatttttatgcactcctatgctaccttgcatgctgctttatacatataagaacacaagagaagtttgtaaactcagttgtaaaatgggactagttatttctgatctatttccttcaaagggctgttttaaagatggaatgagactacatttgtcagcgtgttctgttttcc

SEQ ID NO: 137979 - DNA, 429 bp, Homo sapiens
atagcacaaagactgagtcgtaagatatctgtaaggggactgccacacaaagagggcttctattaggccactgccctactcaaaacattcatgatgtcccaccacacacaggacagattccaagcctcttggataagactgaagccctccatcacagcccatcaatccgtttcctggagttcggaaccacagccatgtgcctcatcagtgtaagactgagtctcagctctcacttcaaggaggactcaagacaagcaaaagaagtaaacttttgctgggtgcagtggctcacgcctgtaatcccggcactttgggaggccaaggtggtggattacttgaggtcagcagtttgagaccagcctgaccaacatgatgaaacgttatctgtactaaaaatacaaaaattaggctgggcgccatggctcatcc

SEQ ID NO: 137980 - DNA, 404 bp, Homo sapiens
taatccctattctattcccctgatctttatgcctatcttgaaataacggcacgctgttatgatcactattgcattataacaaaatttaaattcagttactgttaaatgtctcaatattttttatataactagtaggatcaactgctctatttctaccaaaaagaaagactgacaagattttgattgggaatatgtttaatttattgattaatattgggaaaattgccatctcaacaatattgagttttctcatctatgaacatggactatttatctcactagttatttggatctttcatttttctcagtaccattttatagtttttagtgtataagtcttgtactcattttgttaaattcatttccacattttttatgctatcgtgaatgaaatattttaattt

SEQ ID NO: 137981 - DNA, 298 bp, Homo sapiens
tgggctcaagtgatcctcctgcctcagcctcccgtatagctggggctacaggcacacaccaccatgcccggctgaattttatcatgaaaatgatcacaatggagatgattgtgtgctggtgtaaaatctgttttcctgctagagagaaagcatggactagttgagggcatggaaaagaattggtggtgaccggattcaggctcagatccctggctcctcctctttgggtcagattctcaagagacaggatcataagagcctctccactggttctcagattctctgtgcataacatacc

SEQ ID NO: 137982 - DNA, 311 bp, Homo sapiens
tataattaacaaccttggttttattttgtgtggggggtactgttaagaaatggaggaggaaagaagtagtactgaaatagaaaacattgactttgtatcctgtcagccttttaggaaagatattaagtctcaataaaataatatattccttttcttttgacagaagtgtttctaacatgtgtcatcaaaatggataaggtgtacctaatcactgttgacacagtttctacttggagtttaattttcctactcttttccctcttctcccttgcccattcatttccacttcctctctctctctctcgctcgct

SEQ ID NO: 137983 - DNA, 572 bp, Homo sapiens
ggtggcgggtgcctgtagtcccagctactcaggaggctgaggcaggagaattgtttgaaccgggaggcggaggttgcagtgagccaagatcacaccattgcacaccaggctaggtaacagcgagagtccgtctcaaaaagaaaaagaaaaaaaaaaaaaaatatatatatatataaagaaatttccagtctgtgtatgcagctttgaagttttgaattgtttttgtaaatgatgtagtaaaaggaaatgggtaacccagaagattcttttagaaaacaggaccctggtgctgggtgtggtggctcaagcctgtaatcctagcactttgggaggccgaagcaggtggattacgaggtcaggagttcaagaccagcctggccaacatggtgaaccctgtctctactaaacacacacacacaaaaattagcagggcatggtggcatgtgcctgtagtaccagctactcgggaggctgaggcgtgagaattgcgtgaacccgggaggcagaggttgcagtgagccaagatcatgccactgcactacagcctgggcgacagagcaagactccatctg

SEQ ID NO: 137984 - DNA, 220 bp, Homo sapiens
ctaaaaataggaaaattacctgggcgtggtgacacatgccacctactcaggaggctgaggcaggagaatcacttgaagtcaggaggtggaggttgcagtaagccaatatccgagattgcaccactgcactccaatctgggtcacaaagcaagactctgtcttggggggaaaacaaaaaagttcccagctgattctaatgcatagccagggctgaggacca

SEQ ID NO: 137985 - DNA, 287 bp, Homo sapiens
aaaaggaaaatggcagtttgaaaaatcttttgacgttgagtaaaatataactgcatgaactgtaccattgaactatgaagcagttaatggcaatgaagctggagtgattttaataacgttcttttaaataaaagtcactggggtcattttacaactccagtcactgtgttcattcctagttgagttcataatggacttcataatagtcttagagtctagtgtacctctctctgtcattctctctctctttttctctcccctgatgacctgcctctctctgtctttca

SEQ ID NO: 137986 - DNA, 190 bp, Homo sapiens
ggcgtgagccaccgcacctggctgaagatgccttttttaaaaggctgactgtgggtacttaagatttaatgataaatttaaaaggaggttcctcttctatagaagaggtcttcacattcagctgaaactattgttcaagctatcctcacattagaaaaagctgagtagcaatttagtgacgggaaaaatg

SEQ ID NO: 137987 - DNA, 297 bp, Homo sapiens
attctatattgtcctataaatttggttttgttgtttaaggccattacgagacagtagtgtctaagtagtgtcctcctttcaaaaaatacattgttaggaaattaagagtgttgattaagggtattaaggaatagttccctaatgagcctgttaatttaatgaaatgggattgctttagatcagctcctctgtataagggatcacagagacatgctgaattgagatatatggtttttgtttgtttgcttttgtttttgttttgtttcattttgttttgagacaaggtatagctctgtc

SEQ ID NO: 137988 - DNA, 414 bp, Homo sapiens
gcaatacttggaaaggctagagactgttgacttagctgaggttctcaagaatccatatgtttcttgtcctctattaatggttaattacctttagacaagtgaatgtcatctattgaattaaaaactttaagcatctggaattgttagcctaaatttggacctgacctcgagtttctgtttagttgtctagataaaggtggtatgtccttagtgctagaaacacaaccaacacatattccatgccatttgctagttctttatatatgtagtatatttagtgcttgcaacaacccagcaagctaggcattctgatgtccaattctcaggtacagtaactagggcccagaaaggataaaagacttgcccaagtgtgtggcagacccagcggcacagcctctcatcccccaggccaga

SEQ ID NO: 137989 - DNA, 222 bp, Homo sapiens
cccttcaccttctaccatgattgtaagtgtcctgaagcctccctagaagctgagtagctggcatcatgctttctgtaaaacctgcagaaccatgaggcaattaaacctctttttctttataaattatccagtctctcgtactcctttatagcaatgcaaaaatagcctggctcagagtggtggttcatgcctataatcttagcactttgagaggccaaggtg

SEQ ID NO: 137990 - DNA, 189 bp, Homo sapiens
gacggcaaattaggtaaagagaaggagcctgggagcccagctctagccaggggcccgggactgcagacccaaggcaggacagtgaaagaggagagagccttaattccaattccccctgttttcagacattccattccagtcctaccacatcttcctcccaatctttgtctcttccaaactttcccttac

SEQ ID NO: 137991 - DNA, 246 bp, Homo sapiens
agatggaccaaacacatgaaaatgtttggtcattttaaaaagatgacttgcaatatggcaactgggccataaagagttaacaagaggagtatggcatgagtataggcctttcaaagtgaaagacaggaagaagcacaaaatacgtgttggataaaataatttcttggtgatgacattagcatggaatagttaccatcctagagaaggtgctagaagatacaggggaatgataagagtcatccaaga

SEQ ID NO: 137992 - DNA, 371 bp, Homo sapiens
tgctatgaggtttaaagaaataagataccatcttgcttgctatttgaaatttgggtacctagaatatttcggtctctgtgacagacagattaatgcccccctccccaccccaccgaagatgttcacatcctaatcctcagaacctgtgagtatgttgccttagatggcaaagagactttacagatgtgactaaattaaggatttttgagatgggaagattatgccagattatctggttaggcctaatatgattataagggccgtttaaaggaaagaggcaggcaggaggatcacagaggagatgtggtgatggaagcagaggtcagagagagagagagattgaaagatgctgcgttgctggttttgaagag

SEQ ID NO: 137993 - DNA, 532 bp, Homo sapiens
gattaacccgtgagtgccgagggaggaggtctggattgaccatagatgagggtacacatgatctcactgcatcggggctctcacgaaccaggcactctgttaaaagagtgtatcagggaacagggtctacgagaatgctgtagctcatggtcataggtctcacctgagtcagtggccaagcccggcttccgaccctggtctcttgcctaagcacaagatctctcttctctgccaccaccttctctatgccacacggaggcacttaggcagagcagagtcgctgtgacctgcggctggtgtggtagcagtttttacacccgaggttaacagctgtgatttaagaggttatttgtctaaattttcgggaatcagtttctcagggaggagacaactaacacattgggctcgggaagctagtctttttagaaaatatttatagcatttcaagacagtttggtggcaattggatctagcatctgctattttcctcactttccaccatggctttaaaacccatggcagttaagacaca

SEQ ID NO: 137994 - DNA, 276 bp, Homo sapiens
ggcatagggttcctgatggtgggggcagggggctgtggatagaagggacttttggggtatctgataaagttctctgacctgtgtgctgtttgccttaggattcatttagacattcatttgatttctgtggctttcaaattgttgtttgattttacaataaaagattttctttaaaagttcctgctctttccacaaaaatatttggtctccagagcacccggattgaactgaggcaactgcccctcccatgtcaattccagacataagggtctgtgg

SEQ ID NO: 137995 - DNA, 759 bp, Homo sapiens
ggggcttctgggcgtgatctatgaagaccacaccctgcagagaccagcgagaggcactcagatgtgggcagggcttaggctgtgctgaagagagagccagagaggaaacctccaaccctcgtcaggcccagaggtgcccctgcaagaggagcaagtcctcccaccagccacctagagctgagccccagctcccttctaccccaaaccaggaggttgcacaattttggtttgagaggaggaccaggaggctgatgggagtcacagttgttgactcagtggctgatgggaattgtgttctacactcctccaaggactgatgggagttatagttctcaccttttgggggctgatgggaattgcagtttctgcccaagggactccagttatcagacctagagatggggagacccattctcccctcacaaagccctcccctctcattcccatgggccctatttagcaggtgcttccctcccagatggctgtgtatgtattttcttttctttttttgctttcttcttctttccgttgttttgttattgttttaactataataagagggccagaggcagtcaagccctggccaggtcctggcggcccatgggggttctggggagggggaggggggaagtcagtgggggtcagaggtggagggtgaagaatgagaaagttggggagttaggcttagctcaggaaccatgtgtccctgcccactcccctccttccttgcccctccctacctccctgcctctacatggc

SEQ ID NO: 137996 - DNA, 572 bp, Homo sapiens
gtgaggggagatgtaaagagatcactattgtcacggaaggcgctggaaggagctctgcttagaaaaaatgcctttctctaggaggtttcatccagcatgggaacacaaaacaccagtttaaaatagctaggtaaggcttcacagtctctcaatgtgatgtgggtgtcctgagtcgtgaacatcccattgtgcaggataaaatgctggtttctgagctgtctttcaagacacaacccaaatgctgtctttgccatggtgccttccttgggaacccaagccaggtgaggtctgccttttctctgatgttgcctaacttttcctctttgtgtcccttgagctcagggacatgcatcccctgttgtacctagcacagaatcatgcacaagcaggtgcttgttaactgttggtgtgtaccaacaaacatttacggagcacctattagcaggagcacaggccaaggagctggatagatgagcgtggagtttgggggagaggtctgagctgagatatacatttgtgagtcatcattgtatggatgaggccgggctggggaggatatgagcgtagaatga

SEQ ID NO: 137997 - DNA, 450 bp, Homo sapiens
ctataaaaatgtgcccaaactcagtggttctttaacagagaacataggtcaccatcaggaggcatctggaaaatggtttctggtttttataatgccaaccctacttaccctgagtatgtggcacaggggaatcagccacggatcctaagcagctaaatatccttccatttgcaggacaatcccataaaaaataattctcttgcctccaatgccagcagcacctccatttgacaaactgttaattaacctaatcctcaccatctagacatttactattaacgaagcaatcaactttcatcctaccagggaaggaactggattaatgtagatttggaatgtaatctgtggtctaatcagccagtgggtgagaagcacctatactatacctaagatattatcccttaaaatatcctagacaaagcaaactattttaatagtggtttcctctgg

SEQ ID NO: 137998 - DNA, 128 bp, Homo sapiens
tcaggatttattggctgtagcatgataactcatcaactatagttgagcttgcaggaatttgagcagaaaagttaattaacaataattttaaaactgccaaaagcggctgcaagttcagtctgcactct

SEQ ID NO: 137999 - DNA, 375 bp, Homo sapiens
gcccaggcaggagtgcaatggtgagatctcggctcactgcaacttccccttcctgggttcatgcaattctcctgcctccacctcctaagtagctgggactacaggtatgcaccaccacgcctggctaattttctatttttggtagagatggggtgtcaccatgttggtcaggctggtctccaattcttaaactcaggtgatctgcccgcctaggcctcccaaagtgctgagattacaggcgtgagccactgtacccagcccaaaacacatttttaaatgaaaacaaaccaccactgttaattggtagtgtactctgtagctcagaagctatcctctagtacaaaaaaaaagagtttaagtaaattaaaaaaaacc

SEQ ID NO: 138000 - DNA, 371 bp, Homo sapiens
  misc_feature (191)..(191): n is a, c, g, or t
agttatttgggatgaatatacatgcctggtagaatcctgtatcttgtgatagagcagactgcagagctttgtctcgctggcctgttttctcatccacaaaatggggataagacttaccttatgaaattgacactggtgctatccgaatcagatatcatgaagagaaagagtcctgagagttggcgacatgntccaagttccctgccaggagtctctagcagaggagtcgctgcctctctcacctgcatgtacagagggactgggttcagggcactggcgacagaatgtctcactgcgagaaactgcctgggacatcctgactcctcttccgactccttgccgtgcttcatcgggcaatcatcttggccact

SEQ ID NO: 138001 - DNA, 370 bp, Homo sapiens
tcatgaacataagaggttaagcctacctgggtagggacaggaaatatgggggacttaatgaagtttcaaggaggagtgactctatctaaccttaaaagatgagtataagccagaaagagaagggaaggaataaagttgctacataaagttatagctaatgcaaattcatggagacaagaaaaagcttatgttcaaagaactgcacataattaggaatagctgaaagacaactaggtagtggcgagataggatggtatgggccaaatcaagacctttcatgacaagcttaaggaacccgaactttatcctataggtaaggggaagcattgaaagattttaaattggagaatgacatgctcagatttgtgtt

SEQ ID NO: 138002 - DNA, 236 bp, Homo sapiens
cgaaacaaaagtctccaaaatgtgtacgtgatacataatacaaatatttgtaatatttagcttaagaaactacctggaaagtaaaaatgtgaaggtaagctacataagttcttgtttctctgaggtttaatagtttctcaaattttatccatgtgctcatcatcttcatggttttgccatacccagtgatatgtttctgctcattatcatgtcattactgtaaatggtaagctgtg

SEQ ID NO: 138003 - DNA, 520 bp, Homo sapiens
gccagttgatatgtattttgcctgttgacatgggcaatattgacattttggacagaataattgtgttttgggggatggagggtgtgtcctgtgtactgtaagttgtttagcagcatccctggtctctacccagtagatgccagtggctctccccgctccaaatatcacaacccaaactgtctccagacattaccagatgttccccggggtacataagtgcccttggttgaaaagtgttgtttagagggatgtctcttgaggcatccctgagatttctttcctagtgaatgtattttcatctaaatgtgtgtaaaatttgccaatgatgaatattaggacatcgtgtaagaaagaaccaagatataaatttatctcaactgggcagtattcaaattcaacatcctaaaatttctaatggataaatgtaaagtcctacatttaaactcaaataataaatttcataggtataaattaaagaagcattgtcttggaaaaaataattttagttgaataaattcac

SEQ ID NO: 138004 - DNA, 364 bp, Homo sapiens
ccctcctggagtgactgatggggatcagaggtgcagatatgagcacaggcaaatcaggaatgggaagagcaggttagggaggtggctttccagcagtagtgcagaagcaggactggaggcccctcccagtgaagcaggttctcctgaggccatggcaagcccttgcctaccacactgcggtccatgacaccagtctggtagccaaatgctgtcatagtgccttccttcaatgccactatttctgtacctatggcattcattattgtcatccatctttccatgcgtgtgtgtgtgtgtgtgtgtgtgtgtgtgtgtgactctgaggttaactctccccctctctactcagatggcaccttctcca

SEQ ID NO: 138005 - DNA, 464 bp, Homo sapiens
aggcagccaactccttgagatctagcgggagagcaaaagggagtgtggtggaggatgaggctggagaggtgggcagggggcctattccatgaggccttgtataccagggattggggctccagtaatttaaccagtggtgaacatgcctagttgcttcagtatccagcccatacatacccatcttgtccacaaatatactgcgaacaatttcctttcctgatccccatacatgatcaaaggacattccctttatactccaaaccattaccttccagtcttcaccatcagtgtggcacagaaaaatacactggtttttgcttttgtttttgtttttttgagacagagtcttgctctgtcacccaggctagagtgcagtggcacgaacacgggccaccacagccttgacttcccacgcccaagtgatcctcccacctcagcctcatgagtagctgagactacaggca

SEQ ID NO: 138006 - DNA, 638 bp, Homo sapiens
aaaaccacccaccggttaatgattctctaactcaacggcccaggtttcagtacttctttgctgtctgtaatataaacatgacccctacttacactgtcctacctatgtggccaataagagtgttgtcttcgcagttggaacccaaaagccctatgggatggaggatatgcactgtacttctttgtaaaagtgtcttgacaaagctgatgtccaatcaacatttaattaccagactgtccaagctagaaatgaaatacagttgattgcctgagtcctgataatcttgctaacaaaattataaaaggcctatagtatggccaatatatttggctaatggaaatgattttcttaaagccagaaaattcagctacccatagtgcttaaaaccagccttaaaagaacatgaacaggatggttcccaccttatcgagatcactggcattccatagtatccattcattcatatcctcctcctaggccgcatgaaacacctaccacatttccctacctcctaaagcaaacaaaactcttttcctccctcttgctgcaaaaaggtttattaaaagccgtatgtagtgtataaagcctttcaaaaatactagcaatccatgcctttctttttttgagatggagtcttg

SEQ ID NO: 138007 - DNA, 632 bp, Homo sapiens
aactaggctgtgaggcccttaagggtcttcaacttgtccctttcctccacgtaactttctcaaacgccccagttctcagtaacttttctcttttgctgtctgtaatataaacatgacccctacttacactgtcctacctatgtggccaataagagtgttgtcttcgcagttggaacccaaaagccctatgggatggaggatatgcactgtacttctttgtaaaagtgtcttgacaaagctgatgtccaatcaacatttaattaccagactgtccaagctagaaatgaaatacagttgattgcctgagtcctgataatcttgctaacaaaattataaaaggcctatagtatggccaatatatttggctaatggaaatgattttcttaaagccagaaaattcagctacccatagtgcttaaaaccagccttaaaagaacatgaacaggatggttcccaccttatcgagatcactggcattccatagtatccattcattcatatcctcctcctaggccgcatgaaacacctaccacatttccctacctcctaaagcaaacaaaactcttttcctccctcttgctgcaaaaaggtttattaaaagccgtatgtagtgtataaagcctttcaaaaat

SEQ ID NO: 138008 - DNA, 206 bp, Homo sapiens
ctcacagttttccgtgctgtggtacagaaggatcaatcaatccaccaatctgctgtttccttggggtgaaatagattctttcactctctatgcataacctgtgttcatgctgagcacacagtcccttaggagccactaggtcccaggcagatgcatgagaagggttggacaaagcacatttccttgatgccagtaacacatccacc

SEQ ID NO: 138009 - DNA, 514 bp, Homo sapiens
ggagaactgtaaaattttagcagagactgatcttccaagtccctctaagatttcttgagaatccctctcaggaaagctttggattaggttcagttctgttaactatcttctggtaacaagagggcataagtagctgagcagaagaaatatcagagttaaactggccatcttacaccaccatcttggggtccatccatattttgcagatccgcctctgaagagcacagctgtgtggaaacaggaagtcaagaaccagtggccatttatttcaccagtgggacgacaggctctcctaagatggcccagcactctcagagcagcttcagcattgggttcaccgtctgtggaaggtagggaagaaaactctggttttgggtttgaactccccaaagagctgccaatatgtgtatccaactaatcgatacttctccttgaattgctataagatattgccaattaattgctaccaaacagaacttgtgctggccgtgcccaacctagcttagtaaatgac

SEQ ID NO: 138010 - DNA, 389 bp, Homo sapiens
gtctgatactgagagaataagtgagggagagtctatagagagagagcattcagggcaacaagctttggagaatggccatgtttagaaggatagaccagttagcaaaataaaaagaggattcaagataatcagaaaaaggatgaggacagtaaaatattatggaagcaaaagaggagagagtttcaaggagaatgtaagaagaaacagcagcattatgaaaaggagagtagtagaaaatatcctgagtgaactctgataggtgtatttcgaatgagactttcaagaataaaagggagataacctcaataacaggaagagagattctgttccaggtttgtatagcagcctaaacaatgattgggaaacctttcctttagacacactaagtc

SEQ ID NO: 138011 - DNA, 232 bp, Homo sapiens
tataatcctcaacagctcacaccacacacaacatcaagcctttaagtatcagttaatgcaacatcaccaccagcagcaccaccaacctgaacttcagcagctgcagacccggcttccattatttcatggggatacttttctaaataaagataagaaagctacccaagggccagacttacccctgagcccagcagagtcagggctaccattaacccatccagtgtctttgtgc

SEQ ID NO: 138012 - DNA, 527 bp, Homo sapiens
tacaaggtcaaattctttcatttcactggtactgtatagctagtgctacttatttgaagtaaattactcaatttgttaaaaccctgcaggtaaatacacattacattggccctgtggctgtggttaattggaatagaagctgaaccttctgccttggaaccaaatgtttctgtagcatgcacatgttgggttttggatttggggcagttcaatttccccttcttctccatttattgtgtgttttttttattgagacggagtttcactcttgttgcccaggctggtctcgatctcccgacctccagtgatccacctgcctcagccttccaaagtgctgagattacaggcgtgagccaacgcacctgtgccatacctgggtaatttttgtatttcgtgtagagatgggattttgccgtgttgcccaggctggtctaagaactcctgggttcacaacatgccactcatctcagcttcccagagtgttgggattacaggtgtgagataccatgccttggctcaaggggttg

SEQ ID NO: 138013 - DNA, 947 bp, Homo sapiens
tccctccttttattttcaccatttaatatttagtggtttatattttatcggtcctcgttttttaattattgttaggattttggttttttttggacgcgcccggcccattttgagtttaaatcaaaggagacagaaattttctgagaaatcctcctttcttgaatcctttatacacaacattttctagcaattgcataagcaaattggaatctaatcattgtccaaagcttttcccttgagtaagggaatttttcattgaataggtgtgcacaactgattttttactttttaggaattttttagcttctcagttcagttcacagatttttgtaaatttttaaatacaacatttaagtcatacattatagtctgcaagtaggaccatctaattttatgatacttaattatatcttattctagtctcaactgctagttctacctaaatagtacccattactagtattcctgtagaagaagggttggtaatatatctggaccactacctgtgtctataaatgaaattttattggaacacaactcagttcatttattatgttatctttggccacattggtgctacggtggtgcagctttgagtagttgtgacagattgaatgacaggcaaagcctaaaatacttagtatcttgctatttaaaagaaaataattggctgagttttattttagaggagcagattgaaagaagaaaacaccaaagtgggggccagtcaatatagtcataatgtcatagaaggtgataaagaatagattatagaagtatatacgaagtatacattacagcgtagacaatcagatgaatttcttggggaagggatcagtctaagagtcatgttaaagtctgctgtggaggaagatgggtagtctttaacaacatttaaacacttcgtacccgttttcattaaaaatgtaaggcacacgatggccagg

SEQ ID NO: 138014 - DNA, 1353 bp, Homo sapiens
aattagcccactaactccaaactcttacactatgcttaggcgcagactgctgcgaacagagtggtgatagcgccctttttacaaagtaagagcagagaggaattgggtttactgataaattccttctagcctttttttaagtctgtttttgaagtattatccttcaacttgaatcagttaggcttgtttatggccaccattttgagttattaattaatttatttatttagagatgaagtttcactctgttgcccaggctggagtgcagtggtatggtttcggctcactgcaacctctgcctcccaggttcaactgattttcctgcctcagcctcccaagtatctgggattataggcacccaccaccacacctggctaatttttgtatttttggtagagacggggtttcaccatgttctccaggctggtctcaaactcctgaactcaggtgatccacctgccttggcctctcaaagtgctgggattacaggcgtgacctaccgcgcccggcccattttgagtttaaatcaaaggagacagaaattttctgagaaatcctcctttcttgaatcctttatacacaacattttctagcaattgcataagcaaattggaatctaatcattgtccaaagcttttcccttgagtaagggaatttttcattgaataggtgtgcacaactgattttttactttttaggaattttttagcttctcagttcagttcacagatttttgtaaatttttaaatacaacatttaagtcatacattatagtctgcaagtaggaccatctaattttatgatacttaattatatcttattctagtctcaactgctagttctacctaaatagtacccattactagtattcctgtagaagaagggttggtaatatatctggaccactacctgtgtctataaatgaaattttattggaacacaactcagttcatttattatgttatctttggccacattggtgctacggtggtgcagctttgagtagttgtgacagattgaatgacaggcaaagcctaaaatacttagtatcttgctatttaaaagaaaataattggctgagttttattttagaggagcagattgaaagaagaaaacaccaaagtgggggccagtcaatatagtcataatgtcatagaaggtgataaagaatagattatagaagtatatacgaagtatacattacagcgtagacaatcagatgaatttcttggggaagggatcagtctaagagtcatgttaaagtctgctgtggaggaagatgggtagtctttaacaacatttaaacacttcgtacccgttttcattaaaaatgtaaggcacacgatggccagg

SEQ ID NO: 138015 - DNA, 692 bp, Homo sapiens
ctcgccttgcgatatgcccagggtctgcacctatgggcagtgcttggagccgaggcatgagtgtatgtgtatgtgggtgaaatgtgtgtgcgtgtgtgtgcgcgtgtgagcgtgtgtgtgtgtgtgtgtgttgggggacaggtgagaagtttctcccccctccacccactgtgggggcgtctcccttccccttggcagggagcaggtgagggagactcctggtattttttgaacacccgtcattcccctgtgggtctggcggcagagccatctctcccggggagcctccctgccctggggcctggacagctccctcagcactagttgctggtgcagaccggcttcgtccagcgccccctcctggcggcctggacctgcagggaaggggcggtgccctgcaggatgccaggggaagccgcctcgggcctcggcggaggggagagggtcgcttgagcgccatgtgtttgccaaccttgtgttcatttccacaggacttggacctgagagttagggtttccaagaaagaccctagaagtcccctgcctgtctccccactctggaccctagccggaatcagatgttgggacctagtgggttcctgccacctggaacttaccaagtcccgacttcactcctccacttactcctcccgggcaaagcctccccgcagtgctctggtcccagcgctgggc

SEQ ID NO: 138016 - DNA, 119 bp, Homo sapiens
ggtagatactcctccctccaggaggtggagtttaatcttcccctccccactgaatgtgagctggacttaatgaataccttacaaataaaagagtaccagaaagagaaaagtagtaacta

SEQ ID NO: 138017 - DNA, 331 bp, Homo sapiens
tgtctcagtttctcacaggacccttggagggaccccggacttcatctgttttgtaggatgcagagtcctggctgaggcgctaacttctaccctcccctgggttggactaaatgagctcttgctgagcatggtgactctcacttgtagtcccacactttgggaggccaacgcgggcagatcatgagatcaggagatcaagaccatcctggctaacacggtgaaaccccgtctctactaaaaatacaaaaacttagccaggtgtagtggtgggcacttgtagtcctagccactaggcaggctgaggcaggagaatggcgtgaacccctgggag

SEQ ID NO: 138018 - DNA, 122 bp, Homo sapiens
ctaagtttatcagccaactcctaagctgataactccttagttatcaagcattaatcaaactgttaccataaaaacttgtcctgaaatattacaatttaagaaaatttgggcaatactagata

SEQ ID NO: 138019 - DNA, 427 bp, Homo sapiens
cttattataatgggcaggtgtcctttttacaaaaacacttattaaatgaattaagtgcttctgtaaataaattataagcaatgtataacaaaacaagcaactgaaacgttttgtttctgccgaactaacacaggcagatactttttatttctactttacattgtaaacagttcagtgtgaacatctgttcatttctaatattttgtactttttactgaacacacaaaataaagtatcttatgaatagcctaaatatgtaatttcctacacaattgtgagcctacaaatatcaagctttttaaatgattactgaaatggttttactactaacttttaaggagctgttatgggggaaggggggaaatagtccccatccctaaatttcgaggtcctcaaaaaagagtatactgggaacctcaaactgcaa

SEQ ID NO: 138020 - DNA, 336 bp, Homo sapiens
gttccaaaagatttggccattgttaaataaagctgaaattcacttttaaaatatccaaatacagtaatgaccactgatagtcaacattcattgggcctcactaggtgcaaacttattggtgagttattaaatatattacctcctttaggccaggtgcgatggctcacacctgtaaatcccagcactttgggaggccaaggcaggcagctcacctgaggtcaggagttcgagactagcctgcccaacatggcaaaactccatctctactaaaaatacaaaaaattagctgggcatggtggtgggcacctgtaatcccagctacttgggaggctgagg

SEQ ID NO: 138021 - DNA, 119 bp, Homo sapiens
ggcgaccttagcaagtttcttaacatctctctgcctcatctcatctcatctatggcatatgaattatactactcaccctacgtaatcttaaaaaattgcactaaaatgagagcactctt

SEQ ID NO: 138022 - DNA, 462 bp, Homo sapiens
ggaacttgcaggctagtgcagaacatgtaagaaagctgtaatctcagcaatgggatcagtttctttatgcaattgtacacacatagaatttctatagaaacacggaagaggaagagcacaacggccagtctacacctcagcaggtccatgcctgatgaccacctgagagcatgaatgcatcacggagcggggggcctgtcaaagagcaagatggcagcaagaagaaatattgggacactggtgggtgaagtcagaagatagactttgcctgctttgcaattttattagagattgaccttaacagtgcagaacgccaagagtgatgcgaaatatagtctatgtgagaatgcaaatgtgttgttccaatcatttaacaggaggccatgtgaccattgccatttcacttcttttggtggcctcagcagcaggggcaacgagattcctaatgtttgataagtttgt

SEQ ID NO: 138023 - DNA, 447 bp, Homo sapiens
gggattacaggtgtgagccactgtgcccggcccttgttttatttttcaaataaatgcaggaagaaagaaagagaaagcagaggtggccatatctcaagtaagtcatgccacccccaccacaaaaatccgtggaggctgagaaatacaatacctggcaaaactcagcaaacataaaagccagcagttattcaaagatatttgttgagaaaccactagggcccagttactagagctaccgagatgaacactactttaaaaaccaaaccaaacaacctgcctcatggaggcacttgcccctcagttcagtggcaagtatggtaagtgttctgcagaaaagctaagcagctgaggggagcggcaggggcccgagggtgtgcattagcattctcttcagtgggttcagggagtcacccccgggggcggtgggggcggggggtcggggagcag

SEQ ID NO: 138024 - DNA, 486 bp, Homo sapiens
atcaaaggcagaaggtttgtgtgtgtgtgtgtgtgtgtgtgtgtatctgtaagtgtttaaatcaaggggagattgcatttataaatcatactggccttatgaacatcctctgcaataaatatactttttagccttaactataaattatatattttagtgtttaaaaaccttccggtgtgaaacatctaagataacccttaaaaaccacctgttctctaggtaaacctctgaggtccgagacaatttagtgcatgtgtgtttgtgtgaagttcagtccatttttatcttgtatagattcttgttaccactaccaccgtcaggatacagaactgttctatcaccacaaggctccctcatgttctttcataggcacacctaccacatgtacagttattaaatgattaatatacagatagcagttgttcaactgaaatgataatttaggataagtgttacaaatctaagcacttacaagcatcttaatat

SEQ ID NO: 138025 - DNA, 316 bp, Homo sapiens
tacattacctctcctgttaccaatatgaaaaaaaagaggacctttggttcctcagaaaaacacaaactgttatttttttaaagaaaaacttatcaagagatgaaatcggaaaaacttaagtctttaattctgcccttgggaatgtaataaattattccttttatattccaatacacaaagaactcttgtagacaagaatcaggctcaacaaactaaaaacagcatgtacctaggatcctggcagtttacaggtgtttgattatccttaaccagagtaactcattagaagcatttaaaactatttaggaggggggag

SEQ ID NO: 138026 - DNA, 326 bp, Homo sapiens
cagggaccacaggggtgagctccagttttccactgcttttttcaggggccaactggtgagtccaaggaggagaagccagtgagcagaggggcttcccccagtcccagccaaagcagctcccctgggcctgctttacctcctcaacttccacagaggatcccatttgagcaaaggactctccttagctggcaggaggttaagtctgcagtggctgatggcatctctaccaccactcagggaccacctgccagagaaggaagccacagcagaggagaacagagaccaagaaaggacctgtcaatactatttaagcccctggatccagc

SEQ ID NO: 138027 - DNA, 194 bp, Homo sapiens
ttttgaaaaacagggaaagtgggtttgccgtgtagccagatatatgtacatctcatggacactgccatctgtttagatgcctagtgtgcatgtgataagctctaaatttcttagactactgggttcactgatggtaccagacataattttatatctttcccccttgaaggtctggatgtacgccattaacttaa

SEQ ID NO: 138028 - DNA, 314 bp, Homo sapiens
taataaaatgcttgtcaaaaattgcttgaatccagggcatctaacatattgacaggaaaatcacgagaccaataaaaaccaacggtaacactcactatttgttttttcaatgatgctgctaccttcatctctgaataacttgggaccagaagaccagcctgctggagcaggaagaactccaatctagaagtcagggacatgggatctagttcagttgatgctactagctaggtaggtggccctaaataggtcatttactttgttttttctctttctcagggtttactttccttaatcaaggggctgactagacc

SEQ ID NO: 138029 - DNA, 459 bp, Homo sapiens
taaaatgttcaattagataagctctaagatgcctttgagcgggaaaatctaatgcacaatgactctgttttattagtatctgcatgaattcttctggttttgagtccttgacagtgttttataaattaacattctgcagcatttagctccatttgttaaaaaaaaaaaacaaaccctaaaactaaaacatttcagtgtaaaaccaattagtaaaatgtagcactgctgtgacctttatgctacaatgtaaagtaaccttggacagcaatgtggctgactctaaggtgtctctcccctccccacccaggtctcactggctcctgccctggccttgccaccacctggcaggtggctaagtctctatgggcatgaaatgacggagcttgactactagacaacagaggtcccttcagctccccaaataggcaattttacacatttctattttcttgttttcca

SEQ ID NO: 138030 - DNA, 133 bp, Homo sapiens
tcctgtctaaatatagcatgcttgtctccccaggcagctgggaggaggggcctgcatgatcatagatgagggtgccttgtccacctggctctgggctctcactgagcatgctcttccttgggacggcttctca

SEQ ID NO: 138031 - DNA, 496 bp, Homo sapiens
gtagagacagagttcaccattggccaggctggtctggaactcctgacctcgtgatctgcccacttcatcctcccaaggtgctgggattacaggcgcaagccacagcacccggcttctatgaattcttacaagttcctttattcaacggtcatttactgagaacatttttgatgtccaacatcggacccgtcttaagatccaaacatctgacgtggttggtctctgtccctgtgaaatccacaaccttcttggaaatgttaaataataatatctaattggagtaacaggagtgttaaacattattatgtgggatttttctgattaaaaccatcaaatgggttgtgtaaagaccaatttcccattgtcttctaatgcatttgggtcacactggtgttgccagttccttgttctttttcttccatctcatttatctcagtctctactgacattttcatctttctgccattctctctttttttttttttaagccctgtat

SEQ ID NO: 138032 - DNA, 273 bp, Homo sapiens
tcaagatgtcccctttttgttctctgtcctccccagggtagaccctacttctctcccctgaggaagtcctgactccttggacggtgacagcttcaggcatggccctggaggcctgggagcacagaggccccgtgtgcttcgaggacttgaggcaggaggcgggcagaggcgcccagggcgtgagtgtggccagcaggacagagggcaggactgcgcttctgacagtggtctgctccggccaagcacctgaaagatggggagcccttcacccca

SEQ ID NO: 138033 - DNA, 221 bp, Homo sapiens
tacctgaggctgggtaatttataaagaaaagaggtttaattgactcacagttctgcaggcttaacaggaagcatgactggaggcttcaggaaatttaaaatcatggcagaagtgcaggggaagcatgcacatcttcccataggagagagagaaagaaatgggaagagcaacacactttcaaataaccagatctcatgagagctcactcactatcatgagag

SEQ ID NO: 138034 - DNA, 331 bp, Homo sapiens
cctcacatctttcagatctttgcccagatgctatcgtcttactgagatcttctctgacctcccacctccctgtttaatgcccctgattctaccctcagcactctgtacacctgccgagactctacattctaggcaggaatttcttttgtttgatttacttttgtatcctaaatgcctaggacattacctgattcacactaggcactcaataaatacttgactaagttaagtatatggaattacatatccgttgcgttcataatttacatctgctattataaatttaccatggatcttagattttgaatttatacaagtgtgtataatttcc

SEQ ID NO: 138035 - DNA, 256 bp, Homo sapiens
tcctattggagttacccaaaggacttcgttcccccaaaatgagctggggtcggtgctggtatctcctcttcccctggggactcagcagacacaggaggttccacgttgcctggcatcttttagaaactcaggccccagcagctttttaatgggtactgaccacctgctacatgccaggcaggatgtagatgatttgcaggcattgaaatatataaacctggaaataaacaaaatgctacagaacagttcctaaaga

SEQ ID NO: 138036 - DNA, 385 bp, Homo sapiens
ggagaccagttaaggagttgcaatgtgaaagatttgatagtagcattaagaatgggcaaaaatagatgtactcaagagatgcttcaaagtagaattgactaacataatatgctgaatttggaatagaataacagatgataggcctgaccatcatagtggaaggttttgccactcactgagataggatacagaaaaagcaaagcaggatttggtaggaaagataaccagtttgttacgtgctaagtataagatttttgtggtacatgcaagtagagtgatctactgagtatttagatacattttctgaaatttggggaagaattctgagctgcagataaagattttggaatcataaacatataatggtaattgaaggctgagatgg

SEQ ID NO: 138037 - DNA, 247 bp, Homo sapiens
tatttttagtagagacggggtttcaccgtgttagccaggatggtctcgatctcctgactttgcgatccccctgcctcggcctcccaaagtgctgggattacaggcgtgggccaccgcgcttggccaaaatctgcattcttaatcacaaacttacgcattgaatgttaaggctaaaaggtcatctggaaatgcttaattttaaaatattttcaagcctcaccacattagagcaaatgttaatgtagag

SEQ ID NO: 138038 - DNA, 643 bp, Homo sapiens
tttaaattaaagaacatctcaagtacttcaaattaccttcccctgacagcagattatattttactttattgctaaaatggagtttggctgtcttttatggctgtattcatcattttcactctatttttttgtgcactatttgcatcatgcatttcacattttaatagttgtagttcatgcgatgtgattttcaaacaattgtcctatttacatggcaagccatctgcttaatcagcagtcactttattttcagtcttttcaaagccactttccctgaaaagcaaagagacaattcaatccaatgtgccaagctggtcccctccagtgaccatctattcaaattcacacaggtgatcttttggtgaaggaaagaaggtgcacttcaacagcattgtcacagcaatgtggaacagatattataaaatacaagatgaaacattgccttcaaggaaaaaaagttaatttttcttattctgtgtacatgagtatctgatggttgtaaggttgagaataaagagtaaagttgggccaggctcggtggctcatgcctgtaatatcagcactttgggaggctgagggaggtggatcacaaggtcaggagattgagaccatcctggccaacattttgaaagcccgtctctac

SEQ ID NO: 138039 - DNA, 240 bp, Homo sapiens
tggaggtaccacacaaatatcaagaggaacatcatgatagacgttaaatgcaagcttgcactagctcttttaaaatgtactgagcatcaacactcatgagaggaagggaaaacaaaaataacaaaaatgtgtcaagcaaacacaggtaataaatgtaaaataaaatggaccatatcaaaataaaaaacttaagcctcccaaaggctattttctagaaatttctttatccaaaatctatgg

SEQ ID NO: 138040 - DNA, 212 bp, Homo sapiens
agatgtgggagaggaaagtcaagcttgaaaaatgggtaacaggatcccaaaatccttcatcacacctgctagaggcagaggacttcagagtcagcagtgcctaactgttctcccacgtaacaaattcaaatgctctttccacttgccattttgatacaggtaaacagaaaatgtcctagtattctatccccagggagactttccatgaaggg

SEQ ID NO: 138041 - DNA, 285 bp, Homo sapiens
agagggcaatcattattcaggtttaaaaataaatatgacaagttctttaagagataccaagtggaatctgcaaggcccagacaagagctccacttcttaaacaatatgtgtgtggaggctgtcaaagggtattgcaattactgagctccagttagaaattcaggccatctagagttaatgactgtgtcccggtgaaattacagcaaagaaaacaaagattgaacaaagtatcttcgactaaaatttctaactgttaaatcatattagagaatatagaagcaaatt

SEQ ID NO: 138042 - DNA, 246 bp, Homo sapiens
tgagtttcctagccacactgaccagtgcagaacaacaattatacacacacacacaaaaaaaaaatggtctagaagctaaactattcaatggccacagaggctcagaactaacgataattatgaaacataagcccctttgtgaaactgcagaaatctaagaaaaggcattgagcttccaagtaaaattattttcagttgagtcaaatctgaaccttaaaaggcaaataatcatagcaaacatctggg

SEQ ID NO: 138043 - DNA, 129 bp, Homo sapiens
ggggcttctgaaacaaacattgtactgtgagctctcagggaaagggaggaaaaagatgttgataaataaggaggcaatttcttgaggcaggggacgaggaaggaggcttactatttttaatgccctcag

SEQ ID NO: 138044 - DNA, 508 bp, Homo sapiens
taagtaaacatgtagcaacctagattattatagtatattgaacaaatagtgtgaaatgtaacaaaaagtctcctaggtactatataaggattttattagatactagatggtctatcctaaaataatattttgatactgttccatgacagagtcctgaaataaggtttgtatgtgtgtgtatatatgtaaatatgtatgtatgtgtgtacgtatgtatatacacatacactctggtatacaaattctcattcaatattatgtcaactatcaggtatagtatgaatctaccattatgtatatttgtatgtatttcatcagctactttaatttattttagggtcaatcattacaccaaacccatccttcctaagtggtctgcttcatttctgtcaagttaagcagttttaacaaacatattatgcttaaataaaatatggatggtatttttattgaaatataatataccataaaattcacccttttagagtgtacaattcagtactttttc

SEQ ID NO: 138045 - DNA, 114 bp, Homo sapiens
tcctctccccctcccctccccaggcgtatggctgcagctacgcttgtcaccatccgagactgcattggccacaggagatgtggatgatttttccatttgtcctgatgtttattt

SEQ ID NO: 138046 - DNA, 301 bp, Homo sapiens
atttcatgtaagaaagtggagtaaaaacttttagttgctggatttaaataagatattggtaaaatacacacaaaactaaaaacagtgattacttgattagcaggacatgtcagggtgaggaaattggggtagctggacctttcactatacacttgaaattattattttgatttttgcaccatgtgaatagaacttctatgtcaaaatgaaacagaaagataatgaagtgagatgaaataaaaaccagccagattgttttgctacactctgagatttgagagcctctgacttaaattgcatg

SEQ ID NO: 138047 - DNA, 575 bp, Homo sapiens
tatgaaataaatcactcataaataaagaatgctttctttattcacatgctgagtcctttatgctagcaagaaaaatagagaatatagaatttctttctcatggagctaaacaaagagcctacttgctgattaatgaaactgagataaaagtatcacatattacgtttgactatgttatcttctccatcataaggtacaaatctcttgttttcctcattttcaatccaaagagacaaggatttttgccaaatttttctactaatggagcccatcttaacccatctaagatatgaacatctttattctggtagacatcaaggtttgtgaaataggttttatatattgccagccatcatagtacattgtataggtgatggtgacaggacataaattgtacctgttattaatctcttcagatgcaaattaacttcaattgaacttgcgactttgttctttcccaagttaaaccaaatcctttgtttcatgaataaaaagaaaatttagtaaaatttcctgtttctttgttatagctgcttacaaagtgaataaaagtgttttagacagtctgcaaacaa

SEQ ID NO: 138048 - DNA, 444 bp, Homo sapiens
cccctcggtgttcgctcagtatggaagtttttctctatcattcggcgaagtcgactcatctttgttccggtcactctgtgtaatgtgtgcatgattgtgaaggatactgaggaatgaaaacttagtgtacagaaaaatggaactactggggctttgcagctgttagaaaagaagaagataacattctggttttttggaggtacaggactgattccagaaatttctgaggcattttggtgcaccgaatcaaatgctgagtggacttgtatttagtggccccctagtgtcaagaagtaattaactaccagaaagtacgtctacttaaatacactatcaggtttacccttttactgcacagttgcagaagttcccttaattacttcacagcttgcagcgtgattcagttgatgaacaaaaagaactgtaccaaaagaatactttcat

SEQ ID NO: 138049 - DNA, 142 bp, Homo sapiens
tctggtccaggtgaggggccccacaccaggggcatcttgccaccaggggcatcttgccaccaggggcatcttgccagctgagaaactccgacattcttctgaaggcccccccatgggccacaggcgttttcctctgagtatc

SEQ ID NO: 138050 - DNA, 350 bp, Homo sapiens
tagatataataagaccatgcagaaatagaatcattttttgtatgtgtaaaattaatctaggttaaaatacagagagaagattgcgtttggaaaaaaaccttttcccacattttctccgggctcctctttataaagcaattcatgtagtaagaaatcatttttgttcccactttctcttccttcccaagacagcatgggcatctgtgtcacttttcaatgggtgattccgtcataattattcttcatactatatcattgagtctgaagtaacaaatacaggttacatttagatacttcttatatgcatcctgtgcaacccctcctcaccacaaacacacttacactcacag

SEQ ID NO: 138051 - DNA, 319 bp, Homo sapiens
tttcctgggtactcccttcgctcaggccctcacggtccctgacttagagctgctcacgcagtggctcctcaacccaccagcatccccaggggcgcttgcatctttgcaacccacttgtcacactgtggccagggtggctttcaaagacatcaatgtggccatgctcataccctgccttctgggtcccctgctgaggacagcacagcacatgctgaaccctgggccctcttcatctctctacgtgaacgggaatgggctgagatctccacctactcctgccaggcgtgacctgagggaagctcccatcagccccacaacg

SEQ ID NO: 138052 - DNA, 241 bp, Homo sapiens
atcatacagtagagcgtaaattaaagtagaaccaaataaataacataaatagaaaacacgaggttggggacataaaatggagttgaaataaagctatctaccttagaatgagccacaaatctgaaaactctggaaccttagtttcactgtcctgaacaactctaaagtcaatcttcaattttcggggcaaggtgtctgatctgtgtgcctggcccctacctggcttcccttctttctccac

SEQ ID NO: 138053 - DNA, 335 bp, Homo sapiens
tttctattcaactgagcagagaagctccagggagctgcagaccttccatgggacccaacaagggcaggcatggagctggacccagagccaagaagaccagacgacacaaatcatgccttcaaagaagaacccaggagttcaacccaaaatgctgatcaacttgtatagtttcctgtctccacctccagttctgggaggtgaaggagtgaggctgggcggtcccagcgtctcccgggcctgggagaactcgtctctctttccacacaggggctgggatgaaggcaggcaggctaacattgcagtaggagatttaggagcttcgtgtgtaagggcga

SEQ ID NO: 138054 - DNA, 380 bp, Homo sapiens
acatttcccacagtttttgtgggtttttatttaagttgggaaaacttcggaagtttgtgtgaaagtataaataagtttggaaatgtcatgattagagtttgataataaacatgcaaaagcaaatgggaaactctattaaagtcagatgtaacattaaataatgttttctctaaaatgtatttgcagagagaagaacagtgatttatgtggatttgaaacaaagactttggctgtaatttaaaataaaggttaaatgtgaattcttcagcctgaacatggatgaagttttttgtttttaagagcttccttagtgattgttataggagcctctgtgcccttttccaattatgggcacagaaattatgcatgtatttatagat

SEQ ID NO: 138055 - DNA, 549 bp, Homo sapiens
atgctacttttccccaagggaacaaaattaatcatcatttattctaaaggtagggagacctccgttgtttctagtttgtgatcgttttttaatggaagaatgaataagcccccgaaacttgtatattgttaagaacaaattctggcttccctcacccccaccaaaagtatactgtgcttctgatatttaatccatttgcaatattcaactaaaagtacctcagaggaaaactaatcgatgttttttttttttcattttaaggcattaagtaaatgatttctttttgctactgacagatgaaaattaatagcagaaaagcagaaatattgtttagcatgtgtttctaaaaatatgagccttagatatatgattagtaagaaacccaaattcatcggtattgtgtcattaaaagaagaaaattaagtaaagaaaaatgcaacatatgaggaatgaaaaaaattgatattagtctaaacaaaaacataggctatctgctaagattctcaaagaagcacatctacgtctttaaacctacgtctttctcgtttt

SEQ ID NO: 138056 - DNA, 424 bp, Homo sapiens
agccagtgcctggactcctcaccttgctgggccaaggctgtgaattgcagggcactggctagtcacacagaagggcatctggagaagctgttggccaggaccaccaggttcccccatatgtagtctgggagctgctagccccgcagggccatgagagaagcctttctctaggggtccccaactgccagagaagccctcaggagagccacagctttgcccagaccccagagtagcacttggcatgcccctgggccaggtggggccttgtctcaggcagcaacttgtgtgtgtgcacacctacctgcccacacctaccatgcacacaccaacccacacacatatctgtgttgctaggagcagaaaccatagttttataaaacagcctggatcctgattacatgtgctctgcctgtgaagactttct

SEQ ID NO: 138057 - DNA, 446 bp, Homo sapiens
tagtgacagagggctactttatattgggagtatgagaatccctctttgagaatctttgtcgcatctttgggttgttgtttgtcttagccctttttatgctgcagtaacagaatactgtagactgggcgacttaggaagaatagaaatttttctcacagttggaggcctgaagtccaaggttaaggcacatccatcctgctgatagatgcatcccccaaggggaagatccctgtgtcctcccagggcagaagaggaaagagcaacccccaggcagcctctcctccaagggcctttgatccctttcaaagggaggagttctcacagcctagtccggtcttcatactaacacactgaagacacttacattttggagaagacaccttcacaccatagcatgtctattggtatagttgtaaagtttctttataaagttaaggaaaaaaaaa

SEQ ID NO: 138058 - DNA, 394 bp, Homo sapiens
  misc_feature (370)..(370): n is a, c, g, or t
tgatagaactggggacattgttgttaaagagaagtatggaatagaagaactatacataaggtaaagagaagccaggtacaaaacaatgatttttaaatgaaggattcaaaggactatggctcatcacaaataatggaatgaattggtaaggtagtgaagttacattcaggataacatgcttcttctaaaagtgactataaattactcctacaattaaaatttttcacttattcgtgcactctttcaacatttattaaggaccttcttgatactctggcaaaggacataaacattaagcctttgatgtatttattacagtcaacaggacttaaaaaaatagaatttcaggcagactccctgtgcaaaatanaatattctggccccgaacctccgt

SEQ ID NO: 138059 - DNA, 472 bp, Homo sapiens
tattctaaatgactgagttgtccaccccataaacactatagaagccagcacagcaaagatcagaatgatttttaaatgaaggattcaaaggactatggctcatcacaaataatggaatgaattggtaaggtagtgaagttacattcaggataacatgcttcttctaaaagtgactataaattactcctacaattaaaatttttcacttattcgtgcactctttcaacatttattaaggaccttcttgatactctggcaaaggacataaacattaagcctttgatgtatttattacagtcaacaggacttaaaaaaatattgtgaaactggcctaaacaaataaaacacatcaaattatctagcggggtgatttggaatggaattggaggaaaacagaaacgtgttggtacgaactggaaggaaatggttgtcatcaacatgaactccagggctgcttggcttgaatcctggc

SEQ ID NO: 138060 - DNA, 1056 bp, Homo sapiens
tggaaccagcagactgatttgtgtggtagaataaaggtccaagaatagcaagaaaattgagtaagaaacaaggaagataggctttatacaaatgagataagacttgtaaagttagagtaattaagacctggtggtattgatgcaaaatagagacgtcagtgtaatgggggcagaactatgtgatatccgtggggaactaaccaattattcagtaaatggtttgggaccaatgggcttagctggcatatgggaacaaaataaaataagattgtaactttcagataagttaaagccaggaaaaacaagactttaaaactgtaagaaaatagaacattttaatgttccctgagtagggaagggtttataagaaatagtacaaaaagtacaactcaaaaagtaaatgataatatatttatctatattaagacttaaaaagtctgtgttttataggaaaccataaagtgagaaaaaagtgacagactgagagaagatatttataacataactggattagtatctagaatgcatgaagaacttgtagaaatctataatagacacaagcagttcaatagaaaaatgggtgaaagatgagaacaggtagttttagctgagaaaatctgaaaagtctgcaaagttttgcagcctcactaacagggaaatgcaaattaaaatacacatattacttcacacccgttatatttacaaaaaagtttatcagttctaagtagaagtgaggttgttgaaaagcaggtactctcatgtactcctagtggccgcgcacattgatgcacctgtttgttgttgagatatgaagtgaaaatcacagatacctgtaaaaatagcaaatttttcgatgtatagcaaggccctgtgccagattccatgggtgtagtggattgcatacccaactggtcatcagagtcacctgacaaaatctgtttttaggctgcgtattttctggtgatcttccagagttggggaagactcctcccccacactagagttcagtgaatacttcactggggagtcaaaacataaatacgcatgataaataat

SEQ ID NO: 138061 - DNA, 398 bp, Homo sapiens
aagcaatcctcctgcctcagcctgccaaaacattggggttacaggcgtgagccataccacccggcctgcattgggcgtttctatgctgtttgtcaccgtggcctggcagggctggcctcctgctgctgtgccctgctaagtggaccagtttcccttaccgcagtagaccgtgattgagtgtggtgtagcatctctgctgaaacgatggcagccctgggacagctgcggcagtgtctcctcctggcttcttggcatgagatggtgtaggcggcgcctgacactctggagggagtcagagacattgttctgcaggggtggggggatttcgtttgcctgcagttgcggcccggcgttactcctgggcacagtgcgagcccacccgtgccactgggagcacg

SEQ ID NO: 138062 - DNA, 373 bp, Homo sapiens
ccaagtagctgggattacaggtgcccaccaccacacctaactaatttttatatttttagtagggacagggttttaccatgttgaccaggctggtcttgaactcctgacatcaggtgatctgcccactttggcctcccagagtgttgggattacagtcataagccaccacatctgacctccacatctgttttaatctttgaagtgtattataagttatagttctccctgcttgaaggtaatggaaaagttgagactgggttgcctgatgagagatgtagggagcttagtattaatgttgaagattaaaggagagcctgtggttttaggtctaatacagtagattccttctcctgttatttaattggaatgaatt

SEQ ID NO: 138063 - DNA, 655 bp, Homo sapiens
ggcccggcagccctgttattgtttggctccacatttacatttctgcctcttgcagcagcatttccggtttctttttgccggagcagctcactattcacccgatgagaggggaggagagagagagaaaatgtcctttaggccggttcctcttacttggcagagggaggctgctattctccgcctgcatttctttttctggattacttagttatggcctttgcaaaggcaggggtatttgttttgatgcaaacctcaatccctccccttctttgaatggtgtgccccaccccgcgggtcgcctgcaacctaggcggacgctaccatggcgtgagacagggagggaaagaagtgtgcagaaggcaagcccggaggtattttcaagaatgagtatatctcatcttcccggaggaaaaaaaaaagaatgggtacgtctgagaatcaaattttgaaagagtgcaatgatgggtcgtttgataatttgtcggaaaaacaatctacctgttatctagctttgggctaggccattccagttccagacgcaggctgaacgtcgtgaagcggaaggggcgggcccgcaggcgtccgtgtggtcctccgtgcagccctccggcccgagccggttcttcctggtaggaggcggaactcgaattcattt

SEQ ID NO: 138064 - DNA, 200 bp, Homo sapiens
aaatccagaacatgacagcttgggtaatgacaatttaaaaaaatcatgatttatggtacagaaccatggaaagtgtcaaaaattggagtcgcaaattatctctgaaagccagagtgtgaagtgggacagaaaacaaaagatttgttgaaagtgtctttaggagcaggtagctgccctgatgttctccccaagtccaacaa

SEQ ID NO: 138065 - DNA, 282 bp, Homo sapiens
gtattttttacaccaaggggtaacagtctaagttcaagacaggcttataaacaaaggattaaaatgcagtgagatgtgtctgtatggatctaccagtagattgaagcatattacagtgagtttcttgtgggccaaaatggccagatcatagtcatctgaaatagtttaaccaaacacaatgtgctacataactcctgataataggagacagagagagcttcagagaagccttaatatttgagtagaattctaaagaaagatttggattttatacagcaaaca

SEQ ID NO: 138066 - DNA, 405 bp, Homo sapiens
cacatgtagactaaacaggatcgggactgctggtggtactcatccctgtgctctcctggttctccaatgttctacatggaatatgtatgcatctctgtcagtggagaagtgaccccattctcaaacaaacaaacaaacaaacaaacaaaagaacacttggcatcctcccacacaggaaggagttcatgtcttgttctagtcatatgcgcggaggttttctgtagctgaaatcctagactgcactcctagactgcacatgtgatactctccacattctcccaagttcctcccctctaccccgtcacgcactagggcactctggcaacagcagatggggtgacatgggagagcaggttcactggactttactgctgcccaacagatttagtgaaccatcgattccta

SEQ ID NO: 138067 - DNA, 126 bp, Homo sapiens
ggaaaccaaggcctattttagtaaagcaacttgcccgcctcaccgagctaggaagtgttaagagacagcatttgcacttggcaatggactccagagatctctgtcctgtgctatagatgctgaact

SEQ ID NO: 138068 - DNA, 296 bp, Homo sapiens
ggagaaagagcaggtttgggggctaagagaaagttattgagctcaattttggacaggttgagtcagaggtgggcatccaggaggaggtggcctgcaaggagctagatagagggtctagatccagcaggagatttaaacaagagatttggtttgagactatggtcattgtagccatgggctttggtgagctggctctagcagaacgtgtcagctgagaaaagaggggtccaggaacaagaaagagccttgcccccatttaaggggtgggcagagagaggggagcccacaaaggtgaa

SEQ ID NO: 138069 - DNA, 321 bp, Homo sapiens
gctgggattgcaggcatgagccattgtgccaggcctcttcttgtgtattaacctgtatggagtaaagaattgtaacatgttttttgttgttgttgttttgtttttcctttttttcataatactataaagactggaggggatcatggtaggtatcctgagcaatatcacctgtttggcatatgaagaaaatgaaggctagagaagtgaagtgacagcaaactcttgagatagtaagctagttagtgtttataatgctagagagaggagagagaaaggcagtatagggtttaaaaaacctggatttcagagtcagacctgaat

SEQ ID NO: 138070 - DNA, 399 bp, Homo sapiens
ccaatcagtgagtttagcaaggttgcagggtacaaagttaatatataaaaatcgattatatgccagcagtgaacaattggagtttgaaatttaaaaaaaaaaatgataacaccccaaataaaggaaggaaaagaaacatctaggtaaaattctgacaaaatatgtacagtctgtatgttgaagactgcaaaacactgatgaaagaaatgaaagaagacctagatgaatagatagattctttcatgtagaaaagtgtaaagaaattacaaaaaaaactcctcggaccaatcagtgagtttagcaaggttgcagggtacaaagttaatatataaaaatcgattatatgccagcagtgaacaattggagtttgaaatttaaaaaaaaaaatgataacacccc

SEQ ID NO: 138071 - DNA, 318 bp, Homo sapiens
tgcactccatcctgggcgacagagcgagactccatcccaaaataaaaaataaataaataaaaaatgaaaatacaaaattagcacgtggtggctcccatctgtaatcccagctactggggattctgaggcaggggaatcgcttgaacctgggagaggaggttggcaatgagcggagatcacgccactgctctccagtctgggctacagagtgagactgcatctcaaaaaataaatgcatgctttagagctgttaatgaatggtcactacaaatactactgcttcaccaataaaaatgagattagatgtgttagggtgat

SEQ ID NO: 138072 - DNA, 423 bp, Homo sapiens
atgagctacatgccaaccaggggaagcaggaagtgcaggaggagcatgtttgctggagccccagcagtcaagagtgacgacccagggtcactgcagaatcacattcacagcgcactgctgtttgtgtggagagagggaaagggggtggctgtggaaacatgagacatcactggagctgggagtccgctccagagagaagaacggggagacaggggagaggcacgcattccactgcatttctttcgaattctcactctttttaaaatttttcttaccatgtgctaatgttctgtttgcaaaataaattcaatcaaacaatttcaaatgaataaatgtagctgatgccttatcaaaataaataaatataagaaaagacaggtgggtcactgactttaatttccaagtgataaagacacaatacat

SEQ ID NO: 138073 - DNA, 377 bp, Homo sapiens
agatgcgttgctcccggctgtctttcctctggtatctgccatctaagtcccaactgtgaccccagggattggaaagggagcatgacagtttccgtccctactcccatccttcaaccacccagcccagccaggaagccagcagagcccaggctaagctagctgctccttcttttgtctttcacggccaggcaggcgtcacaggggaaagacttgggttaggtaacaggcggaactggacaggaggcgctggggaacaggctcccctccaccaggtgaactctcttggctgtgcaatgtggtgaatgagacaggcgctctcagaacctgacacccataaacatgtgccacactctgtgatatgataatattggggtcag

SEQ ID NO: 138074 - DNA, 521 bp, Homo sapiens
tcgaggccagctacagtggggctgaggacagaagcgtgatggggtgggcttgccatccttgcctctggtgggcacagcaggaggaacattgcatcccgacgtaggggctggcaggacggggcccgggcagccgtcactcctgacctgtcggatgatggagaggggctcctgtgcattaggagggcttgtgggtgcctcatcgttcactgatggaggcactccaagcctctgctgctccctcctctccttccaggtggggtgggttgtctctggggccagcatggcatcgactcggcttgtctctggtgctatgttgggcgcctcacgtctgcctgtcccttgggaaccttgtctgccattctggacctcgtgcctgagttcgcttgggtcagaattgtccttgatggtgttctggagacacgcgcagttagtgagcaggcccagggggatccagacacaccagacacatcccctcaaaacctgagtgtggttttcacagcagtgagagtcaccctggctga

SEQ ID NO: 138075 - DNA, 187 bp, Homo sapiens
taaaaaaccctctctaatattggacagttatgttatgatttattttcctctatctacacaacgcttgaacaagtatggctgattgccaaaaaggaatgctagcaaaagtaattccttctgagctttctgtgacatagtgaccgattattatttctgtgccgtagatacatgctactgagcattatta

SEQ ID NO: 138076 - DNA, 472 bp, Homo sapiens
gacatgtgcacgagtcagcaagaagctttgacgtgcatgccacagggatccactggccaccagccacggtggttttgccaggtggcatctgctctgaaggagatccaaggtcaagtctctcagctctccccaggccccactgtcactcaaaactcaggatgtctcaatctaaactcctctgggtaggtctccagactggctctccacctgacctcttgtccagaaggtccacaacacctcgagtctataagcctgaccccagggagatttctgtaacctattgtatccacccaggccctgcacgctctcccctatagcgtctccttcatccctctcttctatcaccatccttgttcaacccattgcactccagcccaccttggctctccatggcttacttgtcaaagcctctagttcagtcttatgcttgttcaatagtcctgcaaatatttagtgatcacttactcaccta

SEQ ID NO: 138077 - DNA, 346 bp, Homo sapiens
ataacttcgttttatgaatatattgaagtttatttgcccactcccctactgacatttagattgtctcccataatttcatgattatcaacaatgctaaatgaccatttttgaatatgccaccctgcacacacgggacagtttctgttgggacaagtctggttttgcagtttcctatggatggaactttaggcttctaaggctgttgtgtattagaaacatctgctgttaacggaaactctgtcaggagattgtctttgttaagaatatagaccctgggccgtgcgcggtggctcacgcttgtaatcccagcactttgggaggccgaggcgggcggaacacaaggtca

SEQ ID NO: 138078 - DNA, 583 bp, Homo sapiens
caaaaatctatgtgaagaacccctcatcctaattattactcaggatgaatctaatagatgaaattattctcctttagaaaaaaattaaaagacctcacaagtaatagaaaatgtgcctgtgtttgtgatacgcccatgtgtggcaagagacgctggctggaaacatgtattggcacagtcaatacattcactagaaggcaatgaaattcccaaaagtattacactaagtatattttcataaacaaatcaacaaaaacgaagataataatcattctggtcaatgactgacccaagccctagagctagaacctaatcaggaaactagaatttaaaaaacatgaggcaagagacaagatatcactaactctaatgattctactatttggagtttctttgaagatagataaattcctttctacttccttcaaacaatgatacagtaagcctggtagcacctagcatgaaacaaaaaaaaagcatttatttttcttctgattactaaattaataatatgtcactgttttaagaatcctcaaatacgcaacaactctattgcaaaaatcttccagaaacttactctaca

SEQ ID NO: 138079 - DNA, 734 bp, Homo sapiens
aatagctccttacatataaaatcaactaatttttgacaaagctgtcaaggtacttcagtagggaaaggatagtcttttctacaaatgtgttggaacccctggataaattcatgcaaaaagaggaatttaggctgggcacagtggctcatgcctgtaatcccagcactttgagaggattacttgagcccaggaggaggattacttgagcccaggaggtcaagaccagcctgggcaacatggcgagacctcatctctattaaaaatacagaaatttctgggtgcagtggctcatgcctgtaatctcagcactttgggagtccgaggtgagcggatcacgaggtcaggagttctagaccagcctgaccaacatggtaaaaccctgtctctactaaaaatacaaaaattagctgggcatggtggcaggtgcctataatcccagctactcaggagactgaggcaggagaatcgcttgaacccaggaggcagagattgcagtgagccaagatcgtacctgtgcactccaacctgggtgacacagcgagactccgtcctccccaccaaaaaaaaatattagccaggcatggtggcatgcagttatagtcccaactacttgggaggctgaggtgggaggattgcttgagcctagatggcagaggatgcagtgagccgagattctgccactgcacacactagcctgggagacagagcgagactctgtctcaaaaaaaaaaaaa

SEQ ID NO: 138080 - DNA, 338 bp, Homo sapiens
aagacatccaacaaaactggccattactttatacttctaggtctcagtagatacaggagaggtaatttggccatgggagaaagaaacaaagtaatagaatatggaagaaaatgaggattgtgaaagagtaattcgcatttagtagacccctaataaatactggttgaatgaatgaacaaaatgaaagagaaacatactagaaaatagattgggctgcagcggagacttacatctggaaatatcctgttgtggtattgggtcaagtattaaatactggtgtgcttattttagccaggacataatttcgccactgatatagtagggaccgccaaaggggg

SEQ ID NO: 138081 - DNA, 297 bp, Homo sapiens
gtgtattatgaactgaagtgaatcagttacctgaacttacctgacttcaggatggtaaatactcttgatttttttcttcaggcagattttttttagtaaagagcaaaaaatctgtattgtatttcagaaaattgcaagtctgtggtcttatttctaacagtttgtcatagcctggagcagttccagaacctgaatgaagtcagggctacagaacagggaatatgcatgctcttaagaccccttgatgtcttgctgtctggcttgcctatatcccctcagttgctgaggctctgcgct

SEQ ID NO: 138082 - DNA, 280 bp, Homo sapiens
ggtggatgatgaaatctggagaatactattagaattttcttttttggagttttgtctgttggtattactattacaaaaagaacaatcctaagtatgagtgtgtgtatatgtgtgtgtgtattttagaagaatctatgcaaaatgtttttcttaactttatttttttgttccccaaacgagaagatattaaggtaatataagctggaaaacttgctgacttgttttaaccccacatataatttaagactacatatatgtgtgtgtgtgtgtatacatatat

SEQ ID NO: 138083 - DNA, 394 bp, Homo sapiens
aaattattaaagggtactttttaagcagaagaaaaattatcccagttggaaggttggaaataaatttaaggacaggtatgtggattggcttattgactgcataaaaaaattataagaaacagcaataataggagcaatgcagttataaaacaaaagagtaatatataagtcagaagagggctaaatggattaaatttttctaaggcacttgcattgtttaggaggaggataaaagtataagttgacattgataactcaatgatccatgacaactcaaggatacattttgtaacctctagggtaactctgaaaggataataaagagatatatgacatctaagctaacagaagaaaatgggactaaattttcaaaacactcaatacaaaaagtgga

SEQ ID NO: 138084 - DNA, 448 bp, Homo sapiens
gggaggtggctccaaagcatgtattgtggtcttgaattttgataagcaggggcatattcttagttatagcaagagggaaggtggagacgatgggtttatagatttggggctaagcaaatggagctcccctcctgatggtttctgttttctcagtgaaggcaagggcaactcttgagggaagagggtgaattggagatttgagagagaacatgtcaaacgatcattttcgagtaggaaaatgaacttactagaagaaaatggctttattgagagcctctttgagattaaggtcagaaactaagaatgaaaatctgattctacagtctttcttgttcaacctcagttccttggattcagtcatggagaattaagtggttgagattacccaaggttagactttatccaggtgagtacatcagagagacagacagacagagagagagaagtg

SEQ ID NO: 138085 - DNA, 413 bp, Homo sapiens
tgacctcaggtaatccgcccgccttggcctcccaaagtgctgggattacaggcatgagccaccatgcccagctttcatacttttttataagagatagggtcttgctatgttgcccaggctggcctcatactcttgggctcaagcaatcctcctacctcagcctcctgaatagctgagactacagatgtgtgccattgaacccagctaccttttcatacctttaaagaccgttagaatattccctttcatgaaggacctttttaaatcgtttgcccatttttctactggattatctgtcttcttcttaccaatttatagaactttttagtattgcagataaagttcctcatcggatatcttctctccttctattgggtacctttttattgtcttaatgggggtcttttaatgac

SEQ ID NO: 138086 - DNA, 168 bp, Homo sapiens
cctcattaagccttcggtttcctcttagaaaaactgtcaataatgctagaatccactccatcaggttcttgcaaggattaaatgagatgcttcatgagcatagtgcctagaacacagcaaacattcaacaaacaaattgaacatctttttaaaaagatcttcagtttt

SEQ ID NO: 138087 - DNA, 321 bp, Homo sapiens
cttgagtgtcataccctagccacctgactgtcaggggagcagtatgtggcacttgaggccttgggctggccatgcaggcccaccacaggtggcaaggaatcatgaaccccagctgagtcccctgcaggccttgcctaaaggagaagccagtgaatcaatgtgttacttgaacaaatatagggtctagggctggccaaaagggacagtgaagttggcttctcaggccacagtaggccttcacggtactcagcaggagaccccagcaggcagcatcagggcaggggtgttgaccatccctgacccaagcacgaggatcagaat

SEQ ID NO: 138088 - DNA, 207 bp, Homo sapiens
gggaatgtgtttgggggatagtgagtcatccacgtggttcaagcagagagcgattgtaggagtgaggttagatatgttacccagaaccccaggatgaaagctggaactggacagaggcacagagtatgtttaatcaggggataggcatgatgagagaagtcctttaaaatgacaaatccagcaactggctggaggctgagaaggctg

SEQ ID NO: 138089 - DNA, 311 bp, Homo sapiens
gggaatggtgcccacaggcgttttctgctgcacagagtcctttatgtgccttgtgagacaaggattcttgaaggcctcactcctcagtgggatctgaggccagccgtggcagcttctcctggcgcaggttagaaatgcagagtcccaggccccaccccagaccgactgagtgggaattggcaggggatgtgtgtgcacctgcaggtgtgggtaacactggcctggagcagagtgctctaacgaaagcccacaggccaaatccggcccaccacctgcttttgtaaataaagttttattggcacacagccgtg

SEQ ID NO: 138090 - DNA, 410 bp, Homo sapiens
caactccgtgggttggcaggagactcacacctgccgctcagggattagcaggaactgcatctggtctttttgataaggaaggctgtttcactgggcgccctttgccaagggaggactgggagagaaacttggggtgaggcactcctgatttcacctgatgtcaaagcagcacctcatattagagcttaattttaggccttacactgcacggtgggtacccagtgggtcctgctgactgcccttcatctcctgatttggtgcactccttcctgtgatctgaagctcaacacacagcctcatccctgccagcttgggacaggggccattccaaaattcaaggccaccagagcttttcgtccttttctcttgctgctgatttgttttctttttttctttttttttttttttgg

SEQ ID NO: 138091 - DNA, 771 bp, Homo sapiens
cactggcctaacctgtttagtctcctggagaatttaagtggcagcaggggagagctgtgccttttgtgtgtcctgaaaggcacatacaacccctgcagcctgcgggttaagatggaagattataattaatcacaaagatgtggctgaacgcgcagtgttcttccttctgctgcttcctgctgccagggaaagagccagtggcctctaaacgacccgtgagagcagctctgttgccgtgtgcagcattggcttcagatccttcttcctcagtcctgcctccctgcagttttggctttcctttttctgtgctttttctcttgacttgccaaatttgggcttagtcagggctgtggtgttaacgctcctaatgagccagctcacgccgactcagagcctgagcagcggtaatcagagctgaagacaaaagcaggggcggaggcacgcgtccaggtgtgctttctgcagtgcctctctttgtccaaacattttacagactccagaggggagagggcagggacaatgtgagaagcaatgaactccccaaggaaattactgtttcaataaagaaggaagattgcaagctgcactctgtacgtgtagatgagtgtgtgctcatgttttaaaactctgaacatgcaaattattattattttttattatactttaagttctgggatacatgtgcagaacctgcaggtttgttacataggtatacacgtgccatggtggtttgctgcacccatcaacccgtcatctacattaggtatttct

SEQ ID NO: 138092 - DNA, 233 bp, Homo sapiens
atggcgactccatctcacaaacaaaaatactgaggaaggtatgaaaacagccaaaaaaataaaaataaaaataaaggaaagtacatgaagatgcagcaaagctctggtatcagtaatattctgaaatagaaacagccattccttcctgtagaaagtctgtcttgagtttgaggagtctctggaggatgtatgatgggcaaagctgaagttgtcacgatctgcctaatcaagtg

SEQ ID NO: 138093 - DNA, 378 bp, Homo sapiens
ggaagtgagcattttagtcaagaaacaagtagaatgatctatggttggactaaaaggtaggatttgtataagggcgtattgactgggaaggtaaattggagccatactgtgaggacctcgaatgggaaatcgaagcctttgtcttaaactggcatgtgctggctctgtgtgaacagggctgtgatacaaccagagctatcccttagaaagattgacatgtatgtgtgcatgttatttatgttccagtgttttctttcccattaggtagttgaggtttgtgtgggtccgaggtaagcgcctgcagctgtaacagagtgtgagtgtccttgctcagggtgacagctgtacttagtctcagcgggtatgtgggttgaaggt

SEQ ID NO: 138094 - DNA, 377 bp, Homo sapiens
atgcctaaatctctgtgacataaaaaacaggctcttttagagttgtgagactgctacttgaaatcaggcaaagctgtgtgattcccagctgtttccaccacttgagtattgaataggatttattaagaaaagtagtggtgttattcttggataacttagttgtatctgtgataagtttttttctcccactcaaacctttccaaattatatctgaaggcaatattttcagattcattcctgaaatatttaggaactctgcacagtacattgtagaaagggaaaagaaaatttacatttttttgagaattactgtgcttgctatttgtgagactccttttattaaagcaattctcatggctttcttttttttgtgtggg

SEQ ID NO: 138095 - DNA, 389 bp, Homo sapiens
atttttttttctttttttgttgtttccagtgaagttggatgaaattagcaaataaccttaaggaatagctccaacagcagtcactttaatgaaataagtggaggctgggtgcagtggctcacgccggtaatcccagcactgtgggaggccaatgtgtgtggatcacttgaggtcaggggttcgagaccagcctggccaacatggtgaaacccccatctctactaaaaatataaaaattagccgggcgtggtggcacacgcctgtaatccgagctactcaggaggctgacacacaagaatcacttgaacctgggagacagaggttgcagtgagctgagataaggccactgcactccagcctgggtaacagagtgagactccgtctcaaag

SEQ ID NO: 138096 - DNA, 331 bp, Homo sapiens
agtcattctgaaaatacctacttatggtttcattcaaagcatccctctgaataaagagtgatacttcctaagtggaaaggagagtcttgctccttaaatgttttgtaaaaagtgtttgacaaaggatcacttaagggcaaaatttacaccaagaaaaacagagttcaaaattaaacacttcccatttgaaaacttttttaaataccatttgtcaaatagtgcaagtctctaaaatcataaaatcatatatgtgtagtattagtcccaaaagtaagagcaggacaaaactctcctgtccatagccaggctctggccctgaggcatgacgcca

SEQ ID NO: 138097 - DNA, 185 bp, Homo sapiens
agaagggatattcaattcaatctgtatcttaatttgttctttatagagataaatatcttacgtaagatttacagcctgtatctaacaaagatggcttaggcaccctacaatttaaaactttgttgttttatcttgaactccttattatgctctaaaggaatacaagacgccaaacaatggatttg

SEQ ID NO: 138098 - DNA, 245 bp, Homo sapiens
ctctaaagtcaacatcaagtttatgacttgtctgttttgtcagaattgattttttatttttattttttgtggctccgaattagaaacttcatagatatgctctttttcctttaataaattacttaacattgacaaaggaaaaacaagaaagttgtacattttatttgtaagaaaaaaaatggagaagtaattttgatcactctactcaaagttgccgttttcattttctgggtgcatttcattta

SEQ ID NO: 138099 - DNA, 280 bp, Homo sapiens
acacattaaatagctgtggtatactgctgaaatacatattaaatagctgtggtatactgtttctttggtggcctacaataagccatgcatcctggtattcacacccttgtaaaaatctctttctacactgaattttgcttgtccacgtaactagctttagccaatgaggtacagtagttgtgaaggaaagagaagattgataaaaacaatgtaccacggttgctattaaccggggataccgagtctcgaacttcgtaactcgtggttcatagcctggttt

SEQ ID NO: 138100 - DNA, 322 bp, Homo sapiens
ggtcaattcattaacaggggagaaaagacagaaactatgagaaatgcaaaccatctgctcaatccagatgcaacagcacatgcctcttatatccaaagctttttaccagaaacacagatctaatcctctcataaaatctccaacagaggtattcagacacatttgtatcacaaataaaaacaatgccaaaatcatcattaactgagaccttttaaatatcagtcaagacttttaccagtgagtacacattgataaaacaatattagaacagcattagagaaaaacagggttggatttctattagccttattcagctattcct

SEQ ID NO: 138101 - DNA, 189 bp, Homo sapiens
catattggagttattttatcccaatgtaaggaaggaacagttcctaaaaaagccttcagaggctcccaaccttcaattcgacccagggcaagtcctttctctttctgagtctcagttttctccctattgaaatgatgagagcagtcctggctttttagagaggttgtaagaacccaaggcaggctccag

SEQ ID NO: 138102 - DNA, 343 bp, Homo sapiens
aatggaacccactacgtacatagtagatgctcagtaaatgtatgttcgctgacaggcacatatctgtggaaccactgattagtctcttctagccccagctgtaaatttataggtgttggaatttaacgaatgccattaagtctcaattctgatatagacccggccctcctagacagttatggcataagtaactgatgagccatcatctgaagaatcacttcagaactggtcatcactgaaaccaaattctgcttggactttgaaaaagttttcattggagaaccttaatgggcaaaggtatagattaaccaaaagtgatcattattgggcaaaaattcttgat

SEQ ID NO: 138103 - DNA, 201 bp, Homo sapiens
tgctgggattacaggtgtgagccaccacacctggccttagtgtcctttttatcctttgtcttttcataaatgtccctcgtcaagtctactgatactagttaaggccactgatgcagacagaatggcagagacatttccacagcacctctttaatgagcgtgtgttgggtgagtggagtcagggaggcactaagttaaactg

SEQ ID NO: 138104 - DNA, 465 bp, Homo sapiens
agtcacagtgagtgggtggaagagccagatcgtgctcttagtggttatcataaattgtggaggaagacccaaagcaaagcatcttgggaggagactggtgagctgtcttgctggatgataaaaagttatcaagataaagaatggtatggtaagggaggagctcagcacaggaatgaggcatgaaatagaatggtgtacatggggcagtgtgggtagttaggtatggttgggactttgagtgagtgggaaggttcataatgataattaaggctggagagatgggcaggagccaggcatggaggaacttgtactaaataatacctgttttaccttgtgaatggtaaggatataggtagagtagaactgaaggcagggagatcagtgagcaagctattgcaatagtattagagatttggggagcctaacccaggattactagagataggattggaaaaggggagattt

SEQ ID NO: 138105 - DNA, 446 bp, Homo sapiens
ctcatttgagttctatgatttctgcgtggctgctacagagctggaggaggtaaagcaacagtattttctcagttgtgcgagcggcattacattataataaataggtaatattaagctgggctgatgagagttgcaaggccatttcacttccttaatcctacatttcagtgacttaaataagcacatatctaaacagccttcccttagacacaggcaaatgcaacccatgattccacacagcccttaaaatggcaactcgcaagatgtacacaattttaaaattgtattagcctattcatagcaagattcttcattaacctatgtgcatattcaatgttgaccacatgccccccaaccccacccaccaaaagaccagttagagatctgagatgtggaagagtgctattcagtttagatatttttttctcatctattactttctagat

SEQ ID NO: 138106 - DNA, 760 bp, Homo sapiens
ttttgtctaccaccaagtcctccataaaacttgccctgatttttctcaaatgaaaatacaataatcattccctctccctgaatgttcaaagcactgtttcaggacctgtctcacagcactcatcacattcaattactattataggtatttgtatgtttgtcttatcacctctctcaggtcataatctgcttaagaacaggatctatattttatcggttaatttcccaataaccactatctttttacagcacagcaccttgaacaaagtacgtactcatataactacgtcttgaccgaatgattgagtagctacttagaaattcaattacagactacctgtaccatttagaatggagagggagatattagacattgcagaacaaataactttttgtttcttacaaacaaattcaccaaagtaaagtcaatattacacatacagatgttttcaaaactcaaggacatttcatccttcaactatctggtcaaatatgatgtgatatgtttatatacatacatacattcacaatagaatacctactgttaaataatcaaatctatgcttgataataaaagtatgtaaatgttttaactatataggcaaactggaattttaagataaaatcaaccattcaaattacaagtggaaacacagagaatgaccaagcaatttgttccaaaaaaataaaaacaaaaccaaaccacactaagctttagctatttaaataccaacaaaacttgagaggcagaattttatggc

SEQ ID NO: 138107 - DNA, 167 bp, Homo sapiens
  misc_feature (12)..(12): n is a, c, g, or t
tggtcccctgtnatccacgtgattgccagctggaagtcacgcatgttccagcgaggctacacccggccaagctgcacctgctgccctgggcccctcgtggaaatccatttgttagagcccacaagcacctgcccaacccgcacagcactccatgcgtggattgccag

SEQ ID NO: 138108 - DNA, 425 bp, Homo sapiens
gcaggcactacaaggggaggctagcgtctgaagtcccactttcccaatatcacagtgatcctcagttactgtacattccatgtatgtaatgggaatcatagtgtctaccaagtaaggctgccaaaaccttgtcaggaggtggtgagtatactcaaagaacccagtacagagcctgacatagaggcatattagctatgatcagtattgctgttaatatgctcaaaaccttaacgactctaagagaagtagccctgagcaaaattaggacatgcccagtttgttttcagtgcagctataacttgtctttttctttcctcccattctttgcccctgaaccaatactgtcatggatcagtgctcacacagccttaaaatggatctgttctctgtcccagtgtctctgagtgttactttctaaataaact

SEQ ID NO: 138109 - DNA, 607 bp, Homo sapiens
gtgtttgtttgttacaacgccaaggcgatcgactcaaccttttcttatccaaaaggaataaggtaacaaaggaatattaattttacatctgtacaaagaaaaaagctggcagaaaggctcagtgacttattctgcctttgttaattgcatggttcttgcagtatctttggtgtcattttcacttactatttcatatttcacactggtttgaaagcgtctgtacctcagggacagaagggggtacctttggaggggaactcacagagcaagttactggaagcctgatatatttcatgttgattgcacagtggctcccttgtatttcagatgaagaattttaattctttataaagggtctaagtggcttctctcactgatgaaggggagctcaaataaaagtagaaagaatgagaaggaaacatacccctttggctatcattcatatcttggcggattctcttctgtgagttacccttcattcaacaacaaaaaaagagggctcccttttattcctcctcagatacgacacacatttagcgacccctgttttttccacagagcttctccctgtatccctcctttactctgacagtgtcttctgtagctc

SEQ ID NO: 138110 - DNA, 535 bp, Homo sapiens
gttttacaagttttgtcaagtttttaagagagatgatcagttttttgaaccgttttactttttagagggagtttggagttgagaattaaactttgatacttcctgttgtccatcccctagccaacacacacattattataataacatttaccgagtggcttttttctgtatgttaacatttacattgatgttcccatagattataattgagaatttttaggaaggttcttcaaaatcgtttgttgcttaactctgataatttttcaatttgggcagctggtttgattttgcctaaaacaaaaacctcatcatttaaatacagttactttaaacaattaatgtaacaataaacaaaattcgggaactgtaacaggaaaaaaaatcacccatgatcttattatcagtaaagcactgtcatcatttctatatttttcattctctttttttcaaggatcatgcttagttttgcatacacacatggaagggcaggctgtagcaggaagagagacgggatcactcgcccctttctctttgg

SEQ ID NO: 138111 - DNA, 211 bp, Homo sapiens
ttttcacagggaacacaatatgcctgtttatgtagtcttaggcccttcagtaagattatcttctcactacaggaactcctagtttttaaagtgaattcctaatttttaaagtttttatagctatcatgaatgatatatattttttgaaacagggtctcattctgtcaaataaaatattttcaattaaaattttgaattgttactgcatgta

SEQ ID NO: 138112 - DNA, 418 bp, Homo sapiens
tctcagcttaccgaggacgaagaagatcatctaccaactaatgcatgtcctacggggcacctcagagcaggaaactgacccaagttcggtgggaggaatgagtgtgcatgtgtgtctgtgtgtgtctagggaaagcctcctcaagaaggtgcctcctgagctgcctgctgcaggtaaagtactacatcagcaaagaatgtgagctggaatgttccacagcatgggcagaggtctgcagaactggacagagctgggcagttgaggaaactacattgtttatacttatatttttaatttttttctccagctatgtgctagaggtggtaaaacattaactgttcccaaggatgagaaaatagctgaggatgagcatcttaggaggggaaggagatgaggatgcatgacccctagaggcata

SEQ ID NO: 138113 - DNA, 282 bp, Homo sapiens
ctcctcacactcagggcaggccagaagtggtaggaaattaacacactctccccaccaagagcagccctcatccaatagctaagtggaatcggtgtctatgcgctccagccttctcccctgggtggggtgatactgaggtgcgtgttctgcactgcctccgagaactgcccagtggggtgaagctccaggaactcacagcagcttctctgtgggtgatacacctgttattggcagccttcccttcctcggtatttcctggagccatctctttattttatttta

SEQ ID NO: 138114 - DNA, 448 bp, Homo sapiens
gattaagtgcatttcttagatactcactacttctctgacattaaattttgtttcagttgcttacatcaacgtttcaaaacccagaaataagaaaattattgttcgaggtcaataaccatgtttataacaacttccaacttaaaatggaagaggaatcccttggagaacacacatttccttatggaagtttcctcaaaatttctaataggaatttcaactaagttaaagtactaatttaagtaggacaagacagaattctcttccttcccagacactattacaagccaaaccacgtttcacaggaacacgtcctgcctgctaaggtgtcccctaggacaaagctgcttgccagctgaccatcacttgtattgcatactttaaaaagtgtggctaacagaaaggaggcaagacagatgttatttaaataaaagcacaaagcatctgttca

SEQ ID NO: 138115 - DNA, 437 bp, Homo sapiens
ggcctgcacatgggaggggcagactgtgattccggcctgcaggggaattggagtgggagctgcccctgtgagtacccgcacatgagccaggaaagatgagaaaagagggccaaagactagaggtgcagaaggtggggacacctggggaatgagaggtttggacaaagccattagagtaagcttgtagggtgacctataaaccagaactgaagggagagacagatcagcaaaccagaggaggaaggcagatgggcagccagaccacgcggtgaggcccaggatacagagctaggagggcacagcgagcaggcccagtgtggcaggaggacgtggcggctgggaaggcaggtgtgggcagatgggggagatgtgcactgtcctgtcttcgccaagaagccctcccacgttttcagtggcacacgttctgtgagccaacc

SEQ ID NO: 138116 - DNA, 219 bp, Homo sapiens
  misc_feature (167)..(167): n is a, c, g, or t
tcattataggaaattaggggcaaccttgtcatgagatttgtttaggagatgaaattggaaggcttcagatggatgataggggtaaggaggaaaggaggagatttaagtgaataagagttgaggagagataggatggcttgagcccaggtaggttgagcctgcagtgngtggtgtttgtgctactacactccagcatgggtgacagagtgaaactctgtt

SEQ ID NO: 138117 - DNA, 434 bp, Homo sapiens
ctccccaatgcgctgatagcttccccgtcgcgtgtaacaatatcacacattctccagtgtcacggaagttatattctgacaataaaaagatgaacatgaatttataatacaacatcagggagtcgtaagtcttgtgaaggaaaacgaagcagggcaaagagatggaggatgatgagggaggaggaaagctacagtaggcaagatgatcaagggaggattctctgagaagatgacatttgagcagacacctaagtgcaacaggaggcaaaggcatacaaatatctcggggagaagatttccaaacaaaagcaagagcaaatacaaagatgttgagaagaacagcaagaaaaccaatgtcaacagactgcagggagaaaggagagtggtatgagactaggtaaaaagaagagggctgaatcttgaagagccttgag

SEQ ID NO: 138118 - DNA, 388 bp, Homo sapiens
aactgaccccttcagacttttgtaaacctttgatgccaaaatcagcatcttctactctgatctcttctctgaatctgagacttgagtatccaactgcctgctagaccagccacttagctgtcccaaatgtcctaagctggacacatcttcttcaccaaatggcttccacctccagccttcccagtttatcatccatctgatcacctacatcagatacccagtagccttcctcaaaatctttatggccctaacttacactcacctcattttttcagcacctgatttcatctcctaaatatttctcatgtctgtctatttctatttctaatacctccacactggtttaggtcctcctcatttctttcttagacaacagcaaaagccccta

SEQ ID NO: 138119 - DNA, 320 bp, Homo sapiens
gcaacaagctctcctgggcttccagccctgctgggagagagactgtgagctaaccaagccccagctctccctggacatgtcaggtgcctgtgagtgagtcttcggcctctctagagcctcagtttgccttctcgaaatgcggagtgatggcaagcagtggctctcacccaggggacccacagagggacatttggcaatgtctggagacatatttggttgtcatgctgggcagggcttgcggggggtgctactggcatctggtggatagaagccagggatgctgctgaacatcctacaacatacaggacagcctccacaaa

SEQ ID NO: 138120 - DNA, 209 bp, Homo sapiens
aatttattatttccataggtttttggggaacaggttgtatttggttacatgagtaagttctttagtagtgatctgtgagattttggtgcacccatcatcctagcagtacacagtgaacccaatttgtagtctgaaaagacatgttattttctatagtcttaagcaggaaatccaaagtgcttcagactaattaataaccttatacttac

SEQ ID NO: 138121 - DNA, 398 bp, Homo sapiens
ccgaggagggcagatcacttgaggtcagaagtttgagaccaacctggccaacacggtgagaccttgtctctactaaaaatacaaaaattatttggcatagtgacacatgcttgtaatcctagctacttggaaggctgaggcaggaggattgcttgaacccgggaggcagaggttacagtgagccaagatcgtgctactgcactccagcctgggcaacagagcgagaccccatctcaaaaacaaacaaacaaaaaattaaatttggctctgagttctcatctactggaaaggtgtgtgagaatcaattgtgttatatttaaggaaacccatttcttaggggtctttgaaaatctaaatgagacttacatgagatcaggaaaatgggagaggagagctgc

SEQ ID NO: 138122 - DNA, 465 bp, Homo sapiens
tctggagtttgtctccactaaaacttatgttaaaacatttgggcaggcgcagtggctcacgcctgtaatcccagctccttgggaggctgaggcaggagaatcgcttgaacccgggagacagaggttgtggtgagccgagatcgcgccattgcactccagcctgggcaacaagagtgaaactccttctcagaaaaaaaaaaagataaaggcgccagcagatttggtgtctgtcgagggcctgttcctcgtagatggtaccttcttgctgcatcctcatgtggtggagaaaggtggaagactccctcaagcctctctgacaagggcactgacccccttcgtagagcagagtcctaacaaactagtcacctaaaagccctacctcttaataccaccacagtgggttccagcatgaatttggaaggacacaaaaattcagaccatagcattttgccccggcccctcaaa

SEQ ID NO: 138123 - DNA, 487 bp, Homo sapiens
ttaaaatggctatgctacccaaagcaatctacagattcagtgcaatccataccaaaataccagtgacatgcttcacagaattagaagaaatgatcttacactttgggaggccgaggcggacagatcacttgagatcaggagttcgggaccaacctggccaacatggtgaaaccccgtctccactaaaaatacaaaaattagccaggcgtggtggcacgtgtctgtagcaagctacttggaaggctgaagcagaagaatagcttgaatcggggaggcggaggtcgcagtaagccaagatcatgccgttgaactccaacgtgggcgagagtgagaatccatcccccccaacccccaaaaaaaggaagaagaaaaaataatcttaaaatttgtattgaaccacagaatacctagaacagccaaagccaccctgagcaaaaagaacaaaactgggggaataacattaactgacttcaaatctatactacgg

SEQ ID NO: 138124 - DNA, 224 bp, Homo sapiens
ccaaagtgctgggattacaggcgtgagccaccatgcccacccacatcattttttatcctccattgtgttgatatgatgaatcatattgattgatctgtgtatgtctaatcaaccttgcatcccggggataaatcccacttggtcaggatgaatgacctttttaatgtgttgttgaattcagtttgctagtattttgttcaggatgtttgcatccatattcatca

SEQ ID NO: 138125 - DNA, 199 bp, Homo sapiens
tctgaagaaaggtggggcactggggattaaaaagttaagcatttcccaggaggtattagcaatatgggtctggcagccccagttctgctatcaagagatgatgtattttatctatattagcagaaatgagtacattttccccaatagaaagtgcaagacactaaagaaaatttatgatgtaactctatacttgctttca

SEQ ID NO: 138126 - DNA, 511 bp, Homo sapiens
ggaagatgtatccttctggccacagtgcacaaaaggaaatggagattctggaaggataaaggccagtgagaaggcatgataaacatccatgagccaaggaacactggctgttggaccacaagtgccacccatggtgaggatgttggcacacagcttaccccagcccacatgctacaaggatggggagcaaggccaggcacagtggctcacacctgtaatcctagcatgttgggaggccaaggcaggaggactgctgagcccaggactttgagaccagcctgaacaacatagggaaacccattctctataaaaattttaaaaactagccaggcatggtggcacaactgtagtcgcaggtactcaggaggccgaggtgagagaattgcttgagcccaggagttcaaggctgcagtgagccacaatccctccggtgtactccagcctgggcaacagagtgaggtcctgtcttcaaaagaaaaaacaaacaacaacaacaacaacaacaaaaagg

SEQ ID NO: 138127 - DNA, 402 bp, Homo sapiens
tgtgacttcctggtaggctctctgacagtctgcatttgtgcttcttttgtcctcttggccttctgggtgggccactttctcactctgttaattttctttatgacatctgttatccctttttcctcccactccaccctttttctgatttattctgggcttttttgttcttttttttttggggggagggttctttttctctttcactgcccttccctttttagcccagacttgcagataatttaaatattactcgcctgcagaattgccatcacagaaatgctaccatcttttctttaacctgccagaccttcagctgcttcttaatgattttgctgaagttataagaatgggcagcatgcaaaattatgtctatagataactctagattctcctcttttcaca

SEQ ID NO: 138128 - DNA, 260 bp, Homo sapiens
ttcgggaacaaggaaccccagtcctgcccatgcatcctcagtgccaattctgccctggccttgagccagaagcttgaggcagagatcagagactaggacccttctctaggggacacagcaaaatgacaagtacagcgagcacacagctaaactatacagctcatccctgggggagggcactgcgggaggtagagaggggtcgccaagggcccaccttccccagtgcgggtgagcagcatctcctggaggtgcgcctggtc

SEQ ID NO: 138129 - DNA, 200 bp, Homo sapiens
ggaaagctgcacagggaatggaggaatccattcactttagatgccaatttgggtgatttagatcctctacagatctctttctcctgaactgtgtatttgtttttctttttctttttggccagaaattaggaggtggtaggatgagtgaagccatctgtatatctgccctaatctctccatcattttgcttgactagactt

SEQ ID NO: 138130 - DNA, 330 bp, Homo sapiens
ccaatgggtgaatagttaaaccatggttcctccataccatggaaattactcagcaataaaaaggaataaactgttgatgcaccaacaagctggatgagtctcatgagaattaccctgagtctcaaacggttatatgccatatgattcattatgtgacattcttttttttttttttttaagatggagtctcgctttgtcacccagtctggagtgcagtggtgtgatttcagctcactacaagctccgtctcccgggtccacaccattctcctgcctcagcctcccgagtagctgggactacaggcgcccgccaccacgcttggctaatttt

SEQ ID NO: 138131 - DNA, 236 bp, Homo sapiens
gtgtgagcgtgtgagcgtccgtgtgagtgtgaccacccatgtgagcatctgtgtgaccgtccgtgtgagcgtccgtgtgagcgtgtgagcgtccgtgtgagtgtgaccatccatgtgagcatctgtgtgaccatccgtgtagcatccatgtgtgtgagcgtccgtgtgagagtgtgaccacccatgtgagcatctgtgtgaccgtccgtgtgagcatgtgagcatccgtgtgtgtg

SEQ ID NO: 138132 - DNA, 534 bp, Homo sapiens
ctttccctgcaagcatgagtcactaacttcatggttaaatagcatattttccaagataaggaagaactgtctttgcttattgttccattctggatagacgtatatatttatttactgcctgtatgtggctcctttccacaaaataggcagttttcttcatattcctgctcaaagtgtttgtcatctcaggttcccacctgctgaaaccaccagcagcgggcagccccaggggaatgtctgggaagaaagtaccaaaatgaagccacccaaagagcccttcaggcctttcttttgcttgccttagtatttgtaatttcacctctaccagcaggctttaaaaagatgaaggaaataaaacaaccccattaaccccacgtgttcctggagctcttgtccattgattttccatgttaaattgcagtttggatcttttacctaaattttttcctgtgcatattcttcatgcattttctctgaatttgatgtttgccttcgtaagaaaacgtgtatacaatggaaagttctatgtaagtg

SEQ ID NO: 138133 - DNA, 474 bp, Homo sapiens
ctatttattttttttgagtttatagccattcaataagtactttcttatcttggtctctggttttatcctcacatccttcttttcggccttgaatcctttcttgctttgcaaggaacaattttcttcctactataaactacagcactaaggtatggaccttagaaattatatagtctaattctctgctgacacacaaatcccttcaacaacaaagaatcataagttcacattgaaaggtctctccaaatctcccataaatctacaatattcttgatgtttaaaatttaggataatagagaattcactaattcataagacaaagtaccaatgtaataattctataaaatgtcataatctgctttccttgtaacttctgcctattgactctcatttgggactgttagaagtattattattaggctgggtgtggtggctcacgcctgtaatcccagcactttgggaggctgaggtggg

SEQ ID NO: 138134 - DNA, 145 bp, Homo sapiens
gctgaaaccattatttttggtttcctttgttggctcattctctgcctcccatttgagaggcagtgtagtataattacaagagcatgtgccctggaattacttcagttttgaatcctggctccaacatttaataaataaaagttaa

SEQ ID NO: 138135 - DNA, 255 bp, Homo sapiens
  misc_feature (112)..(112): n is a, c, g, or t
actgcagtgggcactgttagcttttccctcaaaagcaatcatggaaggtgagctgaatcaatccatcttcatatccacttcctccaatctaaaggaatagctgaaggacgcnagctatggatgagcttaccagcaaaatacattacatgagaaatatgctaatgtaggctagaggggttgtgctctgttggctgcaaggcagagaaatgagacaattcactttggcttcggcagctttcccgaggccaccagcct

SEQ ID NO: 138136 - DNA, 330 bp, Homo sapiens
ggaggagagaagaggaggtggaggaggaggaggaggaggcttgggcttgcgccgttgaaggtacgcgtgagggcctgcgccggcgccggcttgacagggcctgaggggtagtgagggactggacgagggggttcctgtgggtgagcgcgtacgggctggctggcgcgcggggcggccgaaggtggtggttggtgggagcagccagcgacgagcccgtagacactcgtacgcgtgcgggcgggcgtgcgcgctacgcggacggagtcgggcggagcgggggacggtgggaaagaacgcaaggaggaaggagtggaaggttgaggggggcgc

SEQ ID NO: 138137 - DNA, 417 bp, Homo sapiens
  misc_feature (8)..(8): n is a, c, g, or t
tccgatancgctctagacggctccagctaaatgctatcctaccatgaaatatcagacttttccctcaaaccctcggttcccctttcaccaatcccaagcaaaataatggacaagtctgattctgtagctacagcagacacatggtctggaaatgggggctgttacctccatttcagccctgggtacctggagggtggggagggaggccgtggactggatcactgggctgctcctgtcctttactcggggtggagtttctatccggggtctgggttggccctgccttggttagtcctggagaactgcagcctcctcagtcttgctgcagatgtcaggagcatattttataaagattggattctcttgctttgatctccttgggagggaggattggtggccccaaatctgaggatactt

SEQ ID NO: 138138 - DNA, 159 bp, Homo sapiens
tgccagctcaagggcacttgctcaactcctccctgcagggtgcccaggagagggaaatggagcccctggggagggggtggaggaggtgcgcaaccctgaccaggccccgaggcagcttccacaggcctaaccatggagtttcccagaacctgtctgcag

SEQ ID NO: 138139 - DNA, 307 bp, Homo sapiens
agctgcagatggtcgaacggcgtaagcctgctgaagcgcaggctgctgcgcctaagaattttcactcatatacataaatacaaagacacacatacgcaggtaccactaacacaccaacacacagataaccactcacaaactcagagacacacaaacttacacacacaggtacacactcagacacactacacaaaaactcacactcatacacacgcacacaaagacacatgtacacacacacacaaacagcacacacaccagcagtctcagcagcaggtgaagctcagcctctctccccagtatccat

SEQ ID NO: 138140 - DNA, 478 bp, Homo sapiens
acggctgccctcccaggctgacctgataccatgcacctgcaggtctgactgagtactgttcatgtcagaactgggacagtgtgcccggcagagtccagaagcatctcctagtgcagcggtcgtggtcagtgcttgagcagagaaggcaagactgtggggacagagacaggatcctgctcaagacttcaggccccactggatttgtgaaaagacctgtgacttctctgtaaatgttcctgttttattcatctctaaagtgagaattgtaccagggttacttcttttgtgggaatcctctgaggattaaagaaatcatgcctatgaaacttcaaaggaaaaccttgaaggcctgtccaaaatgcagattaacaaattaccattggaattacccaggtcagaagctgggttttgggaatggggagggacaggcctgctgacagcattcagagtccactgtggagaacttcattggctcata

SEQ ID NO: 138141 - DNA, 396 bp, Homo sapiens
cagcggcgccctcggtacagtttgctctggtttaatgagttggggtgggcctcgtggcgagggctgcaacgcacagttggggacccttgactgacagcagagctcacacccaactgcagcttcccaacctgtgtggccagatggaaaatcacaatccggcggaatccgcagctttccagctaacgaacattcccaaattgtctttacagcgtctacctgtaaaacctttccccatgataaataaatgcaaactctgcttcctattagctgaggtgatgcttttaatacaaaatctacagcctgtgcctactaggggagcaacatgttaacttctgcaactggggaagttttcggggaattagaagtgagtttacttcatctagcgccacacttagt

SEQ ID NO: 138142 - DNA, 514 bp, Homo sapiens
tgggctcaagcgatcctcccgcctcagccttccgagtagctcagactacaggcaagagctaccatgcctggctaaagggaccaagtttttgtacggacattgaagaccttgcttctttccatcacaatggcctgcacgcttctacttacattcccacgttctggaatctggcttcccccagaattcccattcaaatccgattttgaatccccaatccaggaatcccagctgtctcctcaccccagcttcatcctcttattcccaggcccctccatccttcacagctctggatggctaaactgcatggcttgggcccagcccatcacctgggggccttgccattgcctctggggacacaggtccaacctgctgtgtgcttacagcccccatccaagccagggggaaaattaccaatagtgataaagtgcggtgatgtagtgcctggggagtccctgtctaaggagccggcttagtgttgggggacaagcgaccatccttccaaggaaatgagtta

SEQ ID NO: 138143 - DNA, 353 bp, Homo sapiens
gagccaccgcacccagcgtgtaagttttgtgtttttttttagtaaagacggggttttaccatgttggccaggctggtctccagcttctgacctcaagtgatccgcctgcctcagcctcccaaagtgctgggattataggcatgagccactgcacccggcctaattacgaaaattttaagtgcatacaagagagaataatataatggacctccatgtaagtattgcccagatttaactcttatcgaggtttttcatacttcccttagcattacatcccaaagtacagtcttatgcagttcctgtgctgtgcttagatatcccaacagtgaagctcactcaggttgttctgaaga

SEQ ID NO: 138144 - DNA, 495 bp, Homo sapiens
tgctttgttctcaccgtggggggatgctggacacagagtccccttgttcttgttctcggtgagacctggtcctgggccaccccggatgtttccctgggctcctgcctgctgtgatgtggggcatggagttgtaccccagtgggcgacatcccaggttgtggcacctgctgtctttctgcagagtgagccgcaacagctccacctgggtgcaggtttctcccctgttcacggttcagtgaaggatgctcatgctgtcactgattgcagcagcctcaggcagaagtttatggtatctccatcagcccaagctcccagtgtaacccttgggagagatttgctggaagaaagccgcatggtacctgctcattccggcctctcctggtgggaaggagggatgtggccccgggtgttctcaggagtgctggctgttcagttacgttgacttgcgaagctattacatgaaggtgtgaggttttaatggtcaagtgcagggtg

SEQ ID NO: 138145 - DNA, 495 bp, Homo sapiens
tgttcatccacgctggtatcagccatgccaggaacaaaggtaaaccaagttcactcatgtgccagcctgagaactcagtgaatacaagtgctcccaaatctgtcacatcccaaactgaaccagcctgactgcaaggcacaaatggattggcagagcagagtgccaaaaaggggctgagctctgtcactctaccaacttccaactagccacaagactgccttccagaaccagggctcagcataacacacccgcatcctacaagagtttacagcataccacctcctttattaaagagtaggaaataaattaaccaggcacagtggcatgcatgtgcagtcccagctacttgagaggctgaagtgggaggatcgcttgagccaggaagttcaaggctgcagagagccatgactgcaccactgcactccagcctgggcacagagcaagacctgtctcttattttcaaaaaacaacctgggcactttcttaaaaggactt

SEQ ID NO: 138146 - DNA, 261 bp, Homo sapiens
tttcttttctatgctgccaaatctaagagggctaagtaaaggggtttctatctgagaatgctgtctatcccaacatcaattccctcctttatctttaagtaaaacccttgctatttaactaagtagaatgctacatataataaagactacatttctctatatggccatgtgacttaagtctctaagtgaaagtggcatatgaaacgttcaagaaggatctttttggccaggtgcagtggttcacacctataaatcccagca

SEQ ID NO: 138147 - DNA, 343 bp, Homo sapiens
catgcctgctggtcaggcccagttccttcacccagccctgggcctgagcacgggtgctggaggccgcatatggaataggacagcccaggaagcaaacagtgtaagttataagtttctttttgctcttagaaacctcttgattaggcagcaaggtacactaaacctgcttctcagtattttgaacacatcttggccagtaacaagggcaaagtagctcctctaaatggcagacatttgcttccttggctctaggctcaatgggggactttcctctgttctgcggggcatcactttggcaaggtccacccatactcagtatcttcagtgtagctcaggacctagc

SEQ ID NO: 138148 - DNA, 191 bp, Homo sapiens
cgcctgttaggatgggttggttggttgacatgacataaaaagagaaggtagggggtttgaggtcaacatttttcaacttcacagtctgagttgagggctgggattgtctgagtctctaagggtgcaggcttggtttccaagaacagcgggaacctggtgtggctcccatcataatctacccacagtcgcca

SEQ ID NO: 138149 - DNA, 256 bp, Homo sapiens
taaagctctctttgaaagattctaacttgtttctgctaagctatgggggaaaggaggtttgaccaagccagcagccagtgtagctggggaagttgaggccagagtcacaagtggtaggagggattatggcagctctaaaaatggagacctgtgcacacctggtaggacaaggttgtcagtgaggcaaagaacaaataagagtcctaagggtcagtaactgttgtttccaccttttaaaaggaaaacctcttacaga

SEQ ID NO: 138150 - DNA, 1359 bp, Homo sapiens
  misc_feature (1088)..(1088): n is a, c, g, or t
  misc_feature (1090)..(1090): n is a, c, g, or t
  misc_feature (1096)..(1097): n is a, c, g, or t
  misc_feature (1150)..(1151): n is a, c, g, or t
  misc_feature (1212)..(1212): n is a, c, g, or t
  misc_feature (1216)..(1216): n is a, c, g, or t
  misc_feature (1230)..(1230): n is a, c, g, or t
  misc_feature (1239)..(1239): n is a, c, g, or t
ccgggctggtctcgaactcctgacctcaggtgatgcccccaccttggcctcccaaagtgctgggattgcaggcgtgagccaccatgcccggcctctggcctcctttttctaaaaagtagcccacttcagatgttgaaaaccctctctctctctcactatgttcccttctgagcagactcagaaaggttctgaaaaccaaccctttgccattaatgactgactagttgtactttcactgaaatcccaccaaaatcacctcaaactagtacctacagtttaagcctttaagtctatgattgtgaaacaaaaggtacgtggccttattaataaattttggcatctgtaaggtgggagataatcgtgagacaagggaaccttcaaagccatattttgtcacttctagtggtccttggatgggggtgattttgcccctacgagaacatttggcaatgtctggaggtatttttggtgtcacagctttatggggaaagcggggaggagggacagtgctactgtaggcttccagcaagcagaggctagggatgctgctcaacgtcctacaacacaggggacagaacctcacaacaaagaattgctgccccgacttgaaagccactgatcgaaagggtgaacttgactggaacattgaggtgccctgtgagtcagggcagttagtatctgggggatgctggctgagcctgccaagtgtctattgaaaagttgctggaggtgaaggatcatgtctttgggacctaaagagtgagatatttggactcagtttctgcctccaccgttcccctaactttatttggatcttcccacagccccaagacgttcagtacacattttatctcgtcctagatcaccttcttttttagtatgtagagattttgaggggaaaggtaaataggagactctttctcaacagaggtaggataagatttatcttaatcccaattaaacaatagtgaagacccaaaagaaaaaagttggaaacctaagcttttcacttaatagcaatgaagaatcaatttattgaacaaaaattaagtcttaaaggaggagaataggcagggcatggtggctcncncctgtnntcccagcactttgggaggctaaggcgaatggatcacttgaggacaggagttcnngaccagcctggccaacatagggaaaccccctctctactaaataaataaataaatacaaaanattngcagggtgtggtgncatcgcctntaatcccagctacttgggaggctgaggcgtgagaattgcttgaacctgggaggtggaggttgcagtgagctgagatcgtgccactgtactccagcctgggtgacagagcaagactctgtc

SEQ ID NO: 138151 - DNA, 449 bp, Homo sapiens
tttccatttctgcctcttttaagtgtaataagcataatcatccttgttggatactattattttgaaacccatgtttttggaaaaactttcaagattcttagatatctaatataagagaggaaagatactattacgaaagtaatatctgtcaaggggtaaggtttttttatcacatatatttgaaatcatgtccttattcatccccatgtgggtggtatgtgtgttcacatacaactcagagtaacacagtatttcatgaaataaaatccagaacaggctttaaaaaatattaagaatcccgaggagtaaagcaggtgaatttgtttaaatgcctgaatcctgaggactcttttatcaattctacacagcatccaaaacatgtcaatgctgtgggttcctctgttaatctgtttttgaatttcccaagtgaaaaacataccaaagaaaca

SEQ ID NO: 138152 - DNA, 481 bp, Homo sapiens
tttgctcaacattacattgaatgcatgaaattaaaatattccacgcccccaagttctgtatgacaccttgtgtgttttctcagatctatgtcagtcgaaaataaagccagcaagggggaaaaaataggcaaactgaatcaatggaaaactatgtagagcacttttcttttctccaagtcatgctttccttaaaatcagttgaaaaattgaatcaaggatggttcattattctgtacccatcctacgtctaagttggtacatatggcatatgggaaatttcaccatatgtgttcctatctccaatctattctgtcattgacgcctgctatgattttgttgtgagcacatacctcttaacataagaggacaggatgcagaactcacagcagaataagaggaaaggtaacctgacagccccagatcaagctcagtattccttccagaaaacctcagctcaccccacagagcatggcaataacag

SEQ ID NO: 138153 - DNA, 526 bp, Homo sapiens
ccaagaaaccttaaaggagccacaaaatttacaaacgataaaggactttaattaaactcatgtggatctcaaattgaaatgtgcatattttgggggtagttttcaagatggaaaaaatcctcatttcaaactttgaagtgccataactccaaaaagggcgcagattgtttctctaaaaactagggaagggaaagctgtctcattgccaacagttggctagtttttcagaagactacacacggcaataatgtgggctaattttacactgttagagttgatcttctattcaaggagttcattttaaggcttctcaccctccttctgactctcaagtgtatacgttcatgaacactttccagaatattcataatggatgagggaaaaggtcaacattataagccagaattatatttctctttttctgtcctagtacagaagaccctgtccaggactctggattctgatcttgagggggtcaagatggtgctccagtttcaggaacagcaagagcaaagatatggaggca

SEQ ID NO: 138154 - DNA, 291 bp, Homo sapiens
caaattttgaagtcttctttctatctatgatacttaagccttgggattggcttagaccaactggtagataataaacaaagggtgtaagaccaggcttgaactttgcaaaatttagacttcaagcataggatgaggagcaaaggacataaatggagtgggaggaaagacaagagattgtagtgtcacaaaagctaaaggagagattgatgttgtttgctgggaacagcaagcaattaggtattataagaggaaatatgtgaggtaggaagtgacatgagataataaaagaac

SEQ ID NO: 138155 - DNA, 388 bp, Homo sapiens
tttgatggacttattatcaattttggggaaataagacttgcatgtgaaaatacagaggagtgagagaccaggcatgattatgtgacaaatgtccagagagaggaaataacctgtagttgagagtgcttggaatttggctaggccttaccccggggaggtgaacccaggtcagcagttgagactgggggatggtttgctaaacaagggcacgggaagtcaagcttgctgcagggaataggttggaaagtatcagtcagggccagattgttgtgatcttggattcctttttaaggaatttggacttaaacggggagggagccagtgatattgattagacagtccacaggacagatggagaaggagaagatgaagtgtgaacctgttttct

SEQ ID NO: 138156 - DNA, 826 bp, Homo sapiens
cgcggtggctcacacctgtaattccagcactttgggaagccagggtgggtggatcacctaaggtcaggagttcgacaccagcctggccaatatggtgaaaccccttctctactaaaaatacaaaaattagccaggcatggtgggtgcctgtaatcccagctactcaggaggctgaggcaggagattcgcttgaacccagaaggcggaggttgcagtgagccaagatcgcaccactgcactccagcccgggaaacaagaatgaaacttcgtctcaaaaaaacaaacaaacaaaaagaccccataagattatttgatgttgacattctctaaatcgagcttagtgactagcagtcatgttctgagcatggggttgtttaagagaggacatctgtgtgcatgcaccagtgtgtgcctcgtttgtaaacaaggggactcttgtgaatgtgtctgtgttgagatgtgtctgcacatgcctctgtgagtgaatatcagtgtttgggtgaagcggaaggtggggggagaattctcttttgtcaaatacaggaatggggcaggggaccccctgaggaaagaggaggggaaacagctggacatcagaaggaatgagaagtctgattggtcgcaggcctggccaattccttgccctcccccgggcacactgtctaacccaagccccagttcagacagctccaccagagtccccacctttctggaacttgcaggctctcatccaggatccaaagcattgaagggtaaggtcaaggttgaggcctctggcatcgggcgcaatgaggcaagtgttggtggggcggggatgggaacggaa

SEQ ID NO: 138157 - DNA, 559 bp, Homo sapiens
cgcggtggctcacacctgtaattccagcactttgggaagccagggtgggtggatcacctaaggtcaggagttcgacaccagcctggccaatatggtgaaaccccttctctactaaaaatacaaaaattagccaggcatggtgggtgcctgtaatcccagctactcaggaggctgaggcaggagattcgcttgaacccagaaggcggaggttgcagtgagccaagatcgcaccactgcactccagcccgggaaacaagaatgaaacttcgtctcaaaaaaacaaacaaacaaaaagaccccataagattatttgatgttgacattctctaaatcgagcttagtgactagcagtcatgttctgagcatggggttgtttaagagaggacatctgtgtgcatgcaccagtgtgtgcctcgtttgtaaacaaggggactcttgtgaatgtgtctgtgttgagatgtgtctgcacatgcctctgtgagtgaatatcagtgtttgggtgagcgtgtaaaaacactcaagtggggcggtggagggagggggctgctaggagataccc

SEQ ID NO: 138158 - DNA, 483 bp, Homo sapiens
tatgcctggcatggcttactagagactacctattggaagtgcctactaatacaattttctgataatttagatgctgaaggacttccttgaaattttcttcggctggcttgggatggaatacttgcttttgaaatatgccctaaagagtgtgctatccctggggaaatccacttgtctcaggcaatattaatctgctctgcgaacagcttgttggaaatttgctgataatccattttttttttgtcattccatatctcagtgtgagagagtaagagaatttggtaaaagttcttactttttagcttgaccttctgaggtctgaggagcactcaccttcccagtctcatcttccatccctctctaacacaccctcaagttccctgaggaaacaacattatatcctggttccagtatgtattatagttggtgccttaggaaaattactttctttttcagagacccctgccccacccttcctcatct

SEQ ID NO: 138159 - DNA, 254 bp, Homo sapiens
gggaaaaaaaaacacaaaaccactcggacaaaattcttggctcttgaagagctatgaaagaaaatagattgtttcacactaaatagactttcctctcaaaatatttgaaacatccacactaattagttttatcaccctaggaaaatttgtcacctgtaaattaatgtctgaaaatcacctgatctactaaaaggtatcttgagaaattatggggtatctaagaatgtttcaagtaggcatatgattttatatta

SEQ ID NO: 138160 - DNA, 285 bp, Homo sapiens
taggagcccttacaaaacttctcttttgttatttatgtgtcacttatttcttctctgggacaacctattaccggagttgaaaaagtctgtacttaagataatttggatcagcaagcttattatcagtgatgtttttcttgcccaatttgacctatatctagaaatgctttgctcaactttctagaaattactgatactcatctttttccccagctttgttctaactcaaatttggataattttgtgtcattatctttctgttgttttaatacttagagagttggt

SEQ ID NO: 138161 - DNA, 429 bp, Homo sapiens
ctcatttccaataatttcctaattagttctgtccatctgctttaaccaaattaatgctggctctaaggaagcaaatgagcatgtgttgaggaggaggcaaaaatagttaatctgacacccacaatcgagagacttgaacttgtgggtattttgtgcttaaacacagagacatagaatctccatctacatggaataagagcagctgcatattctatggaaggcaatcttgttctttcaacctgctttaaataagtgaaatgtaaagtctgcaatattgtggcattgaaagttattgacaccacagggtattttgttggggaatctgttggacatatcagaggtacaggagcatgatcaggcagctgtaatagcaaagtgattgccatatgggcctccctcagcattctttacctgccctttatccatttt

SEQ ID NO: 138162 - DNA, 445 bp, Homo sapiens
gattcttcacccccccctcctatcatgcacaggtactgaacaagtaaaatggctgtagccaccatgtttttgggtaacttttctttaaaacctacccaccaacagcctctgctgaagaggttggttaggtaaccatgtttatactctgtgatggttctccaggacacagcttattggaccagggctggacacccgatctaacgtttgccaatccattgctggtgagaaaacaatcagattcaaacttcgaattctgaactcagagaaccagaggtcaaactcagttgtcgggagagatctcaactgaaaagtcatgcaagtctggtcctgagaaaccaacgccactcaaacaagctgctgtcatggtcggatgagaggagaaggcaggctggtctacagttagaagagcatagctgtgctttaaatctgcatgataggagggggg

SEQ ID NO: 138163 - DNA, 336 bp, Homo sapiens
cttggtcctagataaacctctgggtctcagttctattgtgtcgtccccctgcaaccccacctgccacctcacccccgctatgggaaggccctaagtcccagagtccatcctctcctccaacactcttttcttatgggatcttcataatgttgggaggggagcaaggtgggaaggagtgtgagtgcagggggccgaaggctctgtaaatgctctcagggaccttccctagggatagcaggttgagccttcctggacagctggtggtccaagctttccctctccactgccagaggcctcaccaggccagctgggcttaacagaagtggccccaggaca

SEQ ID NO: 138164 - DNA, 119 bp, Homo sapiens
ctgccttcgcttctaagaacagtttagttcccagtattggatctctggtccaagataaatggtagtctgaggaactaggctgaaggagggtgagagggacctggtaatgagctttctag

SEQ ID NO: 138165 - DNA, 847 bp, Homo sapiens
agtctctagaaattttgtgaatcggtttcttaaatatatttattaaagacagttttgaagtagcaatgagggaagtttgtttaccattcatcaggaagaaaaccagagctgtaactcttacttttagtattaaaatatggctgtgaaggaaaaaaataaatgccttaaagacaaataatggaatgaggagctatagaacaaagtgacataaggcaattttggttgaaaaatagaaatgcaattaatttagattccactaatttgttttaatccatctagagttgaggtttacctctatgaagaaaagaatactaaaatctattaagatatgaggtagagatcagactttttaagaacttttaatgtttttaccatttgcaaatggcatttataactttcgtatacatagtaaaattatgtatacaataattaaatcctcttagattctctgctttgtaatggcaattattatttgtacctctaagtaatgatctatttgtaaaaaattttctacagcgcctcttgaattagacatcaatttaatgcattctgagaaattagtaaatttttaacgtatttctagttgaaatattgggttctttcaggcaagtatatgtataccctaaactttctttggaagttctggatcctagcaaccataatataaaaactttgaatttcatttgtacatgacgaaatgagatagccacgataggtgttagaggacttttacccagtggaggaacatgttttactctgctgcattggtctttttttttttttttttttttcctttctttttgagacggggtctcactgcctgggcaacaagagtgaaactccatct

SEQ ID NO: 138166 - DNA, 399 bp, Homo sapiens
gttctgtcctctaattaactcaaaaggaaaagataagggcgggcaggagctatagagcattttgcttcaccatgtagtattataactttaactttcagcaatttaacaacataattgtcatgcacaggtgcatcccactggaaaagttcatcacaggaaaatgctgtagcagtccagcggggtcaatgatgaaaacaacacagcagggaggccaggcgtggtggctcacgcctgtaatcctggcactttgggaggctaaggtgggcagatcacttgaggccagaagtttgagaccagcctaggcaacacagtgagatgtcatctctataaaagatcacaaaattagccaggtgtggtgccacgtgcctgtagtcccacctacataggaggctgaggcag

SEQ ID NO: 138167 - DNA, 490 bp, Homo sapiens
ccggggcccttaaccctcatagatagatcattagcttgctaggtacctactgagttttaggcacttttaaggaataggcagatgtcccaaactcaagtttttacagggctgggaggggagcatggatgaggacaggcagccaggtaagagctgtgggactctggagagcacgtgccatgtctgaagcaacagcagatgttgtcaaggaaaaggtgggctcatggctgtctgagtggtctcgcaggaaatgccgcaaatctgtatttttatgcataatctcttatgttttgaatactgatgagtaattccaacttttaaaacaaggcaacatggcccaagtaagatgagactgtctcattgttgtgaccctagagtctccagttggtaatctcagacactgggtctttattgctactttcagcagcctgcaatctataagaaggagagtggtgtggtcagaaagtctatgcaagaggtgctcagaatatag

SEQ ID NO: 138168 - DNA, 361 bp, Homo sapiens
tttattcctctttaatgagctgccatgcctctcccttccttctaatctcttcctccccttgtttgctcaccctcttctgcctctgcctttgcctcctccaagggagagtcagcgtgtccaggtggcaggatgctactggtagaataaaatggtttaggaacaaaagaaacaagtgaagttggcagaaggagggaagctatcttcagactgaagaggttggactggcagatgtgggatttcctaggacccacctggcttttattggggaaagaaacttattaaagtgaactatcccacctctggtgaagaatcagaatgcagtgcacagtggccaacgggggatgggagaatggcttcccat

SEQ ID NO: 138169 - DNA, 337 bp, Homo sapiens
ctcttgcctctgcctcccaagtagctgggaccacaggcgcgtgccaccatgcctggctaattttttgtatttttagtagaggtggggtttcactgtgttagccaggatggtcttgatctcctgacctcatggtctgcccgcctcggcctcccaaagtgctgggattacaggcatgagccacctcgccggccaggacatacagatttttaaaaccatatagaattttaaaatttcttttacaaaattttgttccatatatatttagtacatataatagttttttttttatcattgccagctaagcaacagatagctaatatataagttaaaatgccag

SEQ ID NO: 138170 - DNA, 156 bp, Homo sapiens
cgggagcttaccctggtcaaggaccacacctattgcggaagtcaccttgaaatgtgccaatgtctggctgagatgaggttgggactctccggttttagagcgagtaagcccttttccctcttaaagaggcagtgtagtgctatgattacaagaagg

SEQ ID NO: 138171 - DNA, 148 bp, Homo sapiens
gttgtctttggaaccttgtctgcaaacagctcgaaggagatgcggcccaggggctcaccatccacggtgatgtcaaagaacacggggttgaccatggctgatagtacagggctcctggtggtggcagcaaagcctctttgcccaactt

SEQ ID NO: 138172 - DNA, 183 bp, Homo sapiens
ggggcttcaagtcctatggaaatcatagatggtcattttaaagcaagtggagggaatgggagatctgaggagcagcaaagctgttggttccttcgtgggctcaccagcaggcagctcggtgccagggctgcaggtgccaggagaagggtggggaagggaggccgggggctgtgtccctgcaac

SEQ ID NO: 138173 - DNA, 1234 bp, Homo sapiens
aaaaaatgagagaattagggaaacaccaaaagcaaagagagcagctctatgttcattcatgtctggagatgagccaatttgagcaccactgtaggccaactctaaatttattcagatcgttaacatgggtaacccagcaaatatttcccagcagtgacaatctacaccctttatctaaataaatattgagatgtgcttttttcctgtgttagttcaaagaatctcttcttgcctcccattgctgattttctgtattgatggactcatttctctcaagagattggacaagctaaaattctagagagttcaaaagtgtttgaaagtacattttaagtgttctcaccacaaaaaatgctagtgtgtgaggtgatacatatgttaattagttcaactgatccattccacaatgtatacatatttcaaactatcgagttgtacatgataaatatatacaatttttatttgtcaaataaagaacgtctataaatatttatagatttcaaaattgagaaagaagtatatatggagccacggttgttttgaccatttctccatgctttttgtttggggagggggacattttttggggggcagggactgtgttcagggaaagtacctgaccaacagaacttcaagtctcttccagagtgcgagactcagcttatctgatcaaggtgaacttgcccttcaatagacttgcccttgttactgcccagtgaggccaccaaggaccaagaacagttgagctctctcagggccttcccctttcaacaatttagttgaatgactcccttccatctatcagtcttactccaaatatatgaaattactatacattgaaatgcctgcaaactatatgcaaaaatgagtatgaggaaatcaaatgtaaatcatatgcaaatattattcaaccaagcttctataaaattgtacgtgtcaataacagtaaagaattttaattaattctgtcatttaaaattcatgcattccatattttgctttcagaacttatagtctatgccaattttgaaaaaactataagcacaaggaattaaatactattgagtatagaactgttgatttcaacatacactatagcactttgactaattacagatatatttgatagaaaagtcacatttctacaaggtaattttcaaaaagaaataaaacatttctgtaaacttaaatgtggattaagtggcagaatacagagatttgaatgtttacaaat

SEQ ID NO: 138174 - DNA, 421 bp, Homo sapiens
gccattccaggctcttctgtgcctgtgggactacattctctgtgccgggcttagagaacacgaagagggagccatctgccacactctggaggctgaagcctgcaccagtgctgctcgcctcactgtggtaggtggtggtgatggaaactgcagatcggccagagtggtagaaaagttgctgcagggtttttctggctttgcctgcccagctgctccatgcctggctagaggagaaggaggagccacatgtggtacactggaggctggagcctgcagatggcatggctctgcggctcaccttgctgcagttggtggtggtgacagagactgcagcttgactgtagtggtggttaccaggagctctgccactgcatgtccactagtgacgggttcgctccaccaccccagctgggtagccgct

SEQ ID NO: 138175 - DNA, 721 bp, Homo sapiens
gccattccaggctcttctgtgcctgtgggactacattctctgtgccgggcttagagaacacgaagagggagccatctgccacactctggaggctgaagcctgcaccagtgctgctcgcctcactgtggtaggtggtggtgatggaaactgcagatcggccagagtggtagaaaagttgctgcagggtttttctggctttgcctgcccagctgctccatgcctggctagaggagaaggaggagccacatgtggtacactggaggctggagcctgcagatggcatggctctgcggctcaccttgctgcagttggtggtggtgacagagactgcagcttgactgtagtgaatttggaaattatctgtctggaagctctgagtttatcttgggacctcaagaggagaggatcacccaactcacagcaatcaaactccaaatggtgctataaactgaaccacacatggacacgtcagtcttccgaggacccttagatcaaccccaggaggagccctagctgctgttccccattcgacgcccctttccagcaggaagtagccagaagacatcgtcgcccaaacctctaacagcagttagtgcggcatctccacaggggggaatgttgtaggagttattgataaattattttaggcagatagagaggaaaaggggtccttaggaagtttttgttttttaaagcacgtctggaaaagtttcttgtaaag

SEQ ID NO: 138176 - DNA, 315 bp, Homo sapiens
atggaagaacacttgaacagagagagcataaggaatttgttatgaaggaagagggctttcaaatgatgtcaccacacgatagaggttcttagaaagtgacacttgcttaaatttgaagttttaaagtaaaggaaagatcgcttctacattccccttattcttaatcttgacttacatttaaccaatatatttattttgtatttattcctggtgaactggaagaggaagccaaatgatatactgagcaggaagaaaatgagcaagttcttctcaattttctcttcccccaaatttggggaaaaccgtatatttgga

SEQ ID NO: 138177 - DNA, 636 bp, Homo sapiens
ttcctcaagggtgtaggcatattgataccaaaacatcaaagaaaaggaagacaggccacacatcaaacacagacattaaaatcttgacctcaaactaaattctgaaagttctgttatctgctgaatacttggagcttcccagtgaaaatgatacagtgtattctgcccagattgcaactttccatactaagcatttgaaatgattcttggccctaaatatcacttacttcagactgaatgtcactgtgtatcaaaaacactgagcaagtgagatttttattctttgaacgttccagtaggtcactaatggaatagattcagtaaaaccttgcagcctacggtataatttgaaacaacaaaaaaatcaaatcactttttggaaaatattaggtttgaacaaaaatagaagtttcgaaagggctgccacttacattcttacctctgttagttctttcccatcactcacagggagactgaaatccatgctgagtgcccacagacctgggcaggagctgttcctttgagagacaatgatgcaaatgagtcaagtgatgcctagtagaagtcagactgcaaggatcaccttgacctcaccctagtgcattagctaagcaaactcacaagctttaaataata

SEQ ID NO: 138178 - DNA, 162 bp, Homo sapiens
gttttctattagacgtaataattccaaacccacacatttagttatttgtcagaaggtagtaaagacttaactcatgcctataggtaaaaattattagaaaaagaaattaaaagagctatttatttttggttctgagtatgtaccagaaccatttttttttgt

SEQ ID NO: 138179 - DNA, 307 bp, Homo sapiens
gtgtgaatcaatttaatttgagtctcttcctttaaacctcaaccttgcatcaggaactctgagaaaaaacaaaccaaaacaaaaaaaacattgctgttactggatgggaggtaggggaaataggaaaaataatttgggggataaaatagtaatagctaggtacagatctgaagggaaagcacagcttaaatgaggcagcattagatgagaataggtacagaatagtaggagtgttccgtaattgtgaggacagaaaatgtttaatctatatgctaaacaataccttaaaattagtacaaccaagtca

SEQ ID NO: 138180 - DNA, 338 bp, Homo sapiens
cctgcctcagccttcctagtagctgggactacaggcgcccgccaccacgcctagctaatttttgtatttttagtagagacgggggtttcaccatattggccaggctggtctcgaactcctgacctcaggagatccacccgcctcggcctcccaaagtgctgggattataattgtgagccaccatgcctggcctccatgagaatcttgtctgacttgttcatggctggatccccagtgtctagaatagtgagtgcctggcacatctgcagagctcagtagaaaccagttgaatgaaagagtaggcacatgaaggaggcagaaagaatgattgacggtag

SEQ ID NO: 138181 - DNA, 118 bp, Homo sapiens
tgtatcataatcttatgtaacatggtgtaaatctataattatgtatgcatacaatatgtgcaaagtagtaatgttcatcaagttgtaaacaacggttatctctgaactaggattccaa

SEQ ID NO: 138182 - DNA, 694 bp, Homo sapiens
tgatgggcgctccaatactcattcttccagatgttctccagatcttacccaggcgctaaatcagacaagctgcccaactgagcaatgcaaaatacacactgaaatgataatgcctgacctggccattaaaggcgactaaaggcgtggtttaattacctggtggctcatttacatttccaatcctagattctattaggtttgtacgaaagtgattgtggtttttaccattactttcaataacatataccgacaaacagtattctctcatattttaagagaaacgagttgtggtttaacaacaaatcatccttgtgacatttgtctctggccgtgacgctgcctggggcctcagtgctccctcagccttcggtgccctccccagtgccagctgttgtcaggtggggctcactgtgactcagttctcgacatcttgggaactgggatgaacaaagccccaaaagccagtgagtggctgacccccagcctcccttgtaaccctcacccagtgtggagatgctagtggggctgaagcagcccttgcacctgggctccccttgacgacctggtacatgtgctggcctcaaattgggaacaagtctcctcacctggatcttctgagcctctttgcagggctcgactctgtccaccctgatctcttacactgcttcccaggatgacctactactcagactct

SEQ ID NO: 138183 - DNA, 115 bp, Homo sapiens
ctcctccagctctcatatttactgtccccgtcttctgtgctttacaaattctctaaccagttgtggccaaacctggtgctgaatagattcatactttttcagcttaacccaagcc

SEQ ID NO: 138184 - DNA, 403 bp, Homo sapiens
atgacacttagtttgagatacccacaactggcactcagagtgagttacgcaggcaataccaaacaagtggcaataaaacctttatagtccctcacaccattatgtagtttgtttatgtcacataaatcagggaaagatattaagggaaaattctagtgagtatttttagtaatattactctgtcaccatatgttcctttgccatttaaatgaaatttccttagttcactctaaatcagtacaattatatttattttcaaatgttacatgtctacaaataacatcattacattttttatcaatactatttttaattgacaaatcataattgcatacatttatggggtacaatgtgatgctttgatatatgtaaataaatcttttaaaaattttgtacacttgat

SEQ ID NO: 138185 - DNA, 686 bp, Homo sapiens
gactgcccaacaacgtgaacgtatatgatactactgaacagtatacttaaaatgattaaggtggcaaatgttgtatgtattttacaattaaaatgaaaaaagcaacaaacaaaatcctgaagcttttctcccatcaagatccttctttaagttgcagcaaatggagccagaatatggctgagacatatttctgcttcctaaaagtgttgcatggtggattccttccacgaggttttaggaactctagtccgacacatttaaggaaaggttaagcatatgggctaattgtgcctccattcatccatccatccatccatccatccatccatccatccatccatccatccaacaagccagtgttccagatgttagagatacattggtgacatatacatccttgcctcaaggagcttccagtcttgtgggagaatcagagagatggcccaatagagtaacgtgagagcacacacagcatgggtgcccaaataggccgagtgtggggaaactcccaagaggaagtagcatttaagccaggattggaaagaggagttagtgaggcaaagagatggggcagaaaagaacattctcaacagaggcaactgcatttgtgaagacccggaggccagataacatggcaagtatgagaaactaaaagaaaacaaagacagcgatagagcaggaagcag

SEQ ID NO: 138186 - DNA, 388 bp, Homo sapiens
gagagagagacagagagacagacagagagagacagagagagacagagagagagagaccaagaaaacactcttgagaatgtgactttatcagtctcttgggtccacacctcgtggccagctcctgtggattgcaggacagggcccctgaccctgaacccaggtcctcactgtaacctcaaaatttcttggcgctagctgagtctcaagctctggaaccagagaggggtagcctagagagtccaggaaggtccagttgaggctcagttccaactctgttagtcaatagtttgttttttgtttgtttttattttaattttttgagacagggtctcgccctattgcccaggctggagtgcagtggcatgatcatggctcactgcagcctaga

SEQ ID NO: 138187 - DNA, 392 bp, Homo sapiens
acagttcagacactgatacgtgactgtcaagttatcagagagactaaagaagaccagattgcagagctgaaaaagatatgtgaacaaagtacggaatctctaaataatgactgggaaaaaaagcttcacaatgctgtagcagaaatggaacaggaaaagtttgatcttcaaaagcaacacactgaaaacattcaagaattgcttgaggatacaaatgtgcgtctgaataaaatggagagtgaatacatggcgcaaacacagtccacaaaccacatgatcaaagaactggaggcccgtgtccagcagctgactggagaagcagagaacagtaatttacagaggcagaaattaattcaagaaaaagcagaacttgaaagatgttaccagataac

SEQ ID NO: 138188 - DNA, 102 bp, Homo sapiens
tggcgggtaggaagccacagatggggaagaggagcgcgctgagtcaaggagggactgttacagaagcacacggatgtgatcagaggaacaaagtatttacct

SEQ ID NO: 138189 - DNA, 221 bp, Homo sapiens
agtagctgcagcattgggaagaccctctctttaggctgtaatccgcccgctctgggggactagggaggaagaagtagaggaatggcttccgggcttcctctggtcaaagggccttgctctcattattacccttgtctggaatgttctctcttcctccatctttctcctctttcttaactccagcccaagggtcactttatgagggaaactctcccacattt

SEQ ID NO: 138190 - DNA, 371 bp, Homo sapiens
tttttttttttttttatagtagagatggagttcaccatcttggtcaggctggtcttgaactcctgacctcgtgatccacctgcctcaacctcccaaagtgctgggattacaggcatgagccaccgcacccgactttttatttgtattttttattgcattgttatttaggtgaagggttccctgaatatttttgagccatggttggctgaatctgcagatgcagaacccgtggatatagagcattgctttagaaagattgtctccctaatagaaagtgctaaaccacctacagctgtaccgccctaaacatgcctgatgtcatctgatcttggaaactaagtagggtcgtgcctggttagtacttggatggg

SEQ ID NO: 138191 - DNA, 407 bp, Homo sapiens
agaaagagtaaataggtgctaagtaaggcttgaaactacctaaataagcttgaagatctcttgagatgttggggcaactgacaagagggctgtgtgtaagtgaggtgtgaccagagctccaccctgagttacgtctcctgcctgtggtcacacagtcaaagggacccaaccttgtccagggctggctcctggacgctgcctagctgctctgttactcagaccactttatggggtggaggaagggtgagcagccagctctctgcatgttcaccttggcctagactcatcctctccagcccacagcagcacttcctggccaagctgaggctggggagtgggtttctgcctcttgatgcctgagatttctgggaagaagccactcctggttttccaattcctactgctgg

SEQ ID NO: 138192 - DNA, 348 bp, Homo sapiens
atgaaggaagtggagagaatatcagtaacttgctgttgggagcaatgctgctttcaaagcctgggctcctaactccaaatcctgtgttcctttctggaaggttttctccttgaattgtttctcaccccacccaagtgaccttcgacctcctgggaactcacttctggcttggtccaggttgtccagactccatcatccactcatttgaggagtgctcatcgatgcctatgatgagccacgctgtcctacccctgaccgtaaggatgtcatggttggcggaagaggaaaggaaagaagcatccaatggtggaaatgagaatgaagtggcaggtggctctctgatgtcag

SEQ ID NO: 138193 - DNA, 309 bp, Homo sapiens
gagatattccaggccatataaaggttagtgatggggcttagccttgggctgtgagctactgttagatggttaggctctacggtgccctcatcccacccacaggtctgagtggcttgaaattaaaaggacctaggccctccctagcagagctagaagactcctccccactatccttgccagggatagctccatagagctcaagaggaatgacgtgaagggcttatgtgtgccctcagagttacagaatggtgttttctcacaggaggagcccatattaattcctaactgtgcctgtggtttagggagcag

SEQ ID NO: 138194 - DNA, 189 bp, Homo sapiens
agcagcaacaaagggccaataaacccaggagttacacaatagaagctgaattgtgcagtataccaagaccctcgggtctctccagcactgcattcctatctgtgaacgtgttctcagaaagccaggattttcatgacgtcactgggctattgcattacactgataacgcatcattcaacactgtatgac

SEQ ID NO: 138195 - DNA, 561 bp, Homo sapiens
  misc_feature (3)..(3): n is a, c, g, or t
agntcgacggagactctccactgagaccacagattcagaatatgtttctcagtggagatgctctgtcaggacaattctttgctgtcgcagtgcagaccacttaacttccttagtgtaaaggccactcagtactagcagtgctcaccaggcactgtgacaattaaaaatactctgctcaattttgaatgctcccaattgagaatcataaatacaggtaatagttatgctggcacatgtctagattttagtgaacactgtaatgtttcagggtacatagtttaataaaactatttctacaaacagcgttttgtctatgttaggccctattgtaagggtgttttctttctctgtgtgtattcctaaacttcattttggtcattctcaaattagggaagatttttcattccatgtagccctgttttttctgtttgatattctctttagtccttttgacccacaagttttgtcaggtgtccagatttgcagttcactggaagaaaaatgggagagtaatcttccctctttaaaaataaaatagaaatctttgcatatgacttatat

SEQ ID NO: 138196 - DNA, 255 bp, Homo sapiens
cacttgttcagagtctcacagcccagccatgcagccagctgtcctggctttgggtccagccccagggcagcaggagggcagaggtgcaatttgaaggcagacagggcttgggcagtttctgaatcacgtgggggcagcagactcctggtcatcctcgtctgcctctgcagggcctctcctcaatggagctggctctggtctgggaaagcttggacaggctggtggatctgccctctgggcccttcctcctccaca

SEQ ID NO: 138197 - DNA, 578 bp, Homo sapiens
gtaagtgggtagcaccactgcatgttgggggtggggaagcatgagctggatggagcattcggtggtctaaccagtggccagcagtagtgttggggtttgctgccctcacctctgaagccacacaggctcctgcttcctgaggtcaccctctcctggagggctgcccccgcatgggagtgtggacaagtgtgcacgagggggaggcacacccaggccgagtggaacaccaccctaagggggtggtgacaggtggcactgggagtggctggagtcggggttcaccttactcagggtcagggcttcccattttgcaggactgagaggtggactctgaaggaatgcagtgcttagaatcttggtgcctctcctggggtggtgggaagagcagggagtctcgagtccgattttgccaaaaatcccaactttcctgctgagtagctcatgagacaggcatttcacctctctgaacttcaacttgggggtactcagatttccttcagaggctgtgaaagagtcccctgccacaagttactcctctgttcagaagtgacttgactgatcatctagcccaaccccat

SEQ ID NO: 138198 - DNA, 377 bp, Homo sapiens
tttatcaaaacatagaaaaggtgtcagctcctaatgaacaaaacaaatattaaatgaaggtgagaaaactctagttttttcacttaatttattagttctgttttgtagaatgtcgctcatattttttaatactaattagtaaattatggcaatatcataaacctattttttatgtgtttgaccttatcattaatattttggctgatttcttaatattttacctctgacctgaaattagtttagcattgatgtgaataatggcagttgccaagtaagttttgcctaataggactggggtttggtttttaattttgtaattctttacattgaaatttgctacctaattttaacagtatgtcatttacgattgatgcagg

SEQ ID NO: 138199 - DNA, 752 bp, Homo sapiens
acttttacttttccacagggacttttacttttccacagggacttttacttttccacagggacaagttggctctgccacaattgttaaacttcatggtgctgattacaagcacaacatgggctctaagaaggctcgttccataaaggcaatggaagactttcaagtggagatggggcatgagctgggctttgaaaaatgagtaaaaaagcgaaaggataggtaaaggcatttctggcaggggaatggccaaaggccccaggccagggaggcacaggtatgcctgacagttaatagggttgtagtggccatgcagaggctttgtgttgggaggaaagggatgcttagatggtaactagctgggtctcagccctagaaggcgggggggtcaatcctgtgctgtgtaatcagcatggagtcacttagtcctctgagctttgctttcgtcttctgtaaaatgtgcatggtaataatcctgttgtgaggattaaacgaaatgagcaagagaagcccttttgtaaaccacaagttcctacacactttagatgttcaaaaaacaagcaactgttaccacgacagaggccaaagcttggaaggggagggcttggagttagcacttcctcacgcctgctccaggtggctcatcacttgcggatccccttgggtgggcatgggatgtgggtggtgattgaaggatttgcaggcagagagataggagcctttggtggggcacagacaaggcacacagatactcc

SEQ ID NO: 138200 - DNA, 161 bp, Homo sapiens
agggtggaagagatttgggtgcttcccgggaggcgggaaaacgtgtggtttgggacaagggcaggagtcgccagactccagcgggcagggatagcattggcttccctattcagcccgaggatctggagtcgtgtcctgcctcccaagattccagctggcat

SEQ ID NO: 138201 - DNA, 284 bp, Homo sapiens
aatttgccactctcagttcctgcagactcatgtcctctgggatcctgctgggaggccagccctgcatttcctgccatgctgatgatactgcggcagctgctctctgcagtgcaaaaggtgggacagagattgctagacggataaatcataaagcattaccccaagctgcaatcagccaggcgcagcggggatgggcgcagcggcagcctcggcaaattattctcccattatctcttcaaacaactctctccagtggcatgcccctccccacactccctggagac

SEQ ID NO: 138202 - DNA, 303 bp, Homo sapiens
gttaacttttgggtagttatggcattctttaagaatgtgaagaatgattcagatcccttctgctagaaaaatacacgtttacagacataaaactttgtatatgatttcaaggtattcatggaataccccctccaagagcctacccatgagccccaaagttagtaactgcattagaccaaattttataattatttctgaaaaatacttatcagctttggttcttgcatttgtatttacatagtagataatagtacacttttcccaggcatagtgaagaaataaccttttggtagaaatactttt

SEQ ID NO: 138203 - DNA, 484 bp, Homo sapiens
ctaagaggtaggtactattattagcacacctatttcacagaggggaagtggagctttgattttgtatcttacccagctaggaaatgttaaatctattctttgaactgaggactatgtcagagctcaagaaagattctaattccattcctgttcaaaacagtggtctccaggtaaaatagatcttgattaacttaaaaatctccagaatattaaagttatattacagcacaaacttcataaacagtgactgaattttgctttcagccttctcttgaatatgcctaaataattccagaccttgaactttcctaaacctttaatcatttatggtgctctctgctgtacctacccattagaacaatttttaaaaacataacactgtgtaattattttcaaaagcccagagatactaatcaagtgatcctaatagtcttaaacactatcctcaaaccaaaagataaatggagattgggaaacttgcatt

SEQ ID NO: 138204 - DNA, 245 bp, Homo sapiens
aaatggatgatgagacattgatcagaatttgggtagcacgcttaggaaggaagaatttgggatacacctctgggccgtggttcaccatttgacaacagtagatccacataacgaagtcactagccctcagcctagctttcaaggctctgcctagttcatgtgttcattggttccttccttcctttctccctccgtctctcccccgcagtgctccccttcccgatggtaccctccacccaagcaga

SEQ ID NO: 138205 - DNA, 115 bp, Homo sapiens
tttcaacttcaatttaacaatataaaaatgtattaaatgaagaaatactgaaattatggaggcagtaaactaaatgacttgtactttattaaaatataatgttttgattaaacaa

SEQ ID NO: 138206 - DNA, 463 bp, Homo sapiens
tcttccaaaatggccgttaacatttttcattcttaccagcaatgtatgaggattccaatttctctgtgtcattgacagtgcttattattctccttgtttattatactcatcctagtgagtataaagtgtgtctcatctcattgtggtttgatttgcatttacctaaggactaatgatgttgaacatcctttcgtgtatgtctatttggagaaatgtctattcagatcatttatttttgtagtaacagcttcattgataaatttgattcaaataccacacaattcatccatttaaagtgtgcaattcaatagtttttggtacatttttgtacatttagtacattctgtatttagtacatacaaccaccatcagtaacaaatttcagaatattttcgtcacctcaaaaagaaatcccctgctctttaactgtaaccccatctaccctgcactgcctttcccctaa

SEQ ID NO: 138207 - DNA, 111 bp, Homo sapiens
agtcacggatctttacctccagctcagtgtcggcctcctccagggcacgcaccttgtccaggtaggaggccaggcggtcattgaggttctgcatggtggccttctcacctc

SEQ ID NO: 138208 - DNA, 195 bp, Homo sapiens
aggctctcccagtttaggggtagttttgtttttaagtgtgaattgttagcactggaaaccaagtttgtcttaagttcatagattgattttcaagaagaggacaaaaacatttcccttcccattttatttctgtgaggaaagcatttaccatatcatcagtcattgtgtaaccccaggttttccttcttcatggcg

SEQ ID NO: 138209 - DNA, 176 bp, Homo sapiens
cctactaaatattaatatttaaattaccatcattattctcttatgaagttttaaactctgtatttagtctccttttcattcctaatactgtttatatgtgcctttcctctatttttaaaatctatcttgctaaactcagattttgattttatctaaccttttgtaacttgcataaa

SEQ ID NO: 138210 - DNA, 185 bp, Homo sapiens
aaagattcaagcatagcactgtactgaaacacagccagtattcttttgcttattttccagttttggctagtttttatgaaaactggatatctatgtctatatccatgtatatatccatatatacccatatatagatccatatatatatgtatttgacaaagtcaccattgtcaacattgaaaatt

SEQ ID NO: 138211 - DNA, 542 bp, Homo sapiens
tgcagacaaaaaaaaaattttttttaattaatttataaacatcttaattttataaaagtagagataaaatacaaaattaaaaactttataaaacagaactctatgatgtatatcataacaaataattagtttttcccaaggtactcaaacccccttttcaagtaggtattgcctcacaaatcgttttattgtccaaagaaacgagagcccagacatggttcccatcgtgcagaacacatacttcctattgcaaactcaaaacttccatctaaatatctcatagtcactttcattcagtccctcaacaagtatttattgtgtcaattatgtactaagtattgttctaggtaataaaaatgtaataccaacatgtatgccctcatggagctcaacgtttaagggggataaggaagggagcagacaaagattacataagcaatcataataagtataatgagtactatgataaagaatgtacagtgtacagctgtccctcaggatatgcaggggattggttccaggacccccacaatcctgtactc

SEQ ID NO: 138212 - DNA, 187 bp, Homo sapiens
gggaggctgaggcaggagaatcacttgaacagctgtggtggaggttgcattgagctgagatcgcaccactgcactccagcctgggcaacagatcaagactccgtgtcaaaaaaaaaaaagacttatctcaaatgctgtcacttgcatgatgtctttccagacacttccttcacccaataagtatttt

SEQ ID NO: 138213 - DNA, 282 bp, Homo sapiens
gaggcagtggtggggtagctagaagctgagtggacctgcagcacaccgagcagatgggctttgcctctgccccttttgccccctaggctatctgctgtggcccaccctgccaaggcccgagtgtgagggtgttgatttccagcctttcaatttgtttaaattatttttgaaaatgtaaacatttcttttatataattaaaaaaatgtttaaggtcattaaaaagggaaggggaagaagagccagggaagaaactaaggcacagaggaccagatgagggactg

SEQ ID NO: 138214 - DNA, 365 bp, Homo sapiens
cagagcgtcagcaggcagctgcctgggagccatgcctgatagtactggaccctcagattggagcctgaaaatatccgggaagaaacgcatgtctctcagcatctccttcctccaatacctaacaaagacaagaataagcctgacacaggatacatcaactatttcttttattttcttttttaaagacatggggtctcagctgggtgtgatggctcacgcctgtactcctagcactttgggaggccgaagcaggtggatcacgaggtcgggagtttgagaccagcctggctaacatggtgaaaccccgtctctactaaaaatacaaaaattagtcaggcgtggtggcacgtacctgtaatcccagc

SEQ ID NO: 138215 - DNA, 748 bp, Homo sapiens
gcttcttgggctggcagaggtcgcccttctcctggacctcagggaggaatgaccccgttgctatggagaaaggtggaggggaaggctgagaggtggtgtctccagcctccttggacaagggaggagcttcgctgcttttttaagacggagtcttgctctgttgccaggctggagtgcaatggcgtgatctcggctcactgcaacctccacctcctggattcaagtgattctcctgcctcagcctcccaagtagctgggattacaggcacccgtaagccaccacaaccggctaatttttctatttttagtagagatggggtttcaccatgttagccaggatggtctccatctcctgacctcgtgatctgcccaccttggcctcccaaagtgttgggattacaggcaagagccaacacgcccggcctggagtttttagggtaaaacgtgcagctcttcacgtcttcagactttcttgccaagactcatgaccattgggggagagaagcattttgatgatatctatgctactgcttcagaacataggtgaccatgacagcttcacttcaagatggcatcagtcttgccacaccacaggctgtatggttcctacatacatgatcttcaggttatctgcggctactgtattggcatggtgaaagtagaatacagtggtgtgacgctacccacttcttctcaattcatgttcagtgacattattttgacaccttgtaattggccatggtgggag

SEQ ID NO: 138216 - DNA, 490 bp, Homo sapiens
aaacctttaacaaagtaccttgctatgtttgggctcttaaaaattcaagtgatttagaaaatttggaaaggaaccagaagacaactatcaaataagaaacttaataaaaacctagtagactcagtttatactgaaaagaataaccaaaaacaaatatacctatttttccactaaaaagacagaacaagtttaaattgcagaagtaataaaataggcacgagtgaggggcaacaatctgattttgaagtttattgaagtttttgagataacaaaacacataacttaaatctccactttgtgaagctgaggtgggaagagcccaggagttaagaccagactgggcaacatagtaagacccaatctctacaaaaaaattttaaaaattagctggacatggtggcacatgcctgtagtcccagttacttgggaggctgagacggggggatcgcttgagcccaggaggttgaagctgcagtgagtcatgatcaca

SEQ ID NO: 138217 - DNA, 1211 bp, Homo sapiens
gcgcagctgctccctggcgccctctcaaggagcccctgaggattcgcgcctcccggaagggagaaaagcccgcccgaggcgcggtgctgacggtggctgggctgccgggtgcgctgtggaaccgcctcctgctagagcagcgggctggcgacggtcctcgccggggcgggaagcggctcaggctgccctcgctggcctgcggcggcgcggctggaagcgcgggccactcgtgcgtgggtcactcaggactgcgcctcgcgcgactgtgtgtgcaggaaacaagcaggaaataccctaaaagagaatgaagcgccatgttgagggtcgcggacgtcgcgagtgctgtgggaatgtgggctgaggtggagagttatggtagcccgtgttacaggctcaggggtctgaaagaagcctaatcgtggaggcggcatctgaggagggtcttgaaggctgggcaggcatttgcccgacagagatggaggaagctagtcctgtctgatggaggaaacagggcggaggcgtggagggagccgtgcagcgctggtgtgaggagcagcgagcaggccaggcctgtaaagcagagtgagggaaccaggatagagaaggctgtacaggaagcatggtgatggcatctgcatggcgcctgtggaggccccagggagcttttactcatgatggaaggcacagagggagtaggcacatcacatggtccgaggaggagcaagagaaaatgggagtggggggtgtcaatgtgctgatattccaatcttgcagaaatcgactggatttagtggaattaaagtcaactggaagacgatctgtggggataattccatgattcaaagccttcagggaaaacgtgtttgctcagctgcagtgattgaaaaattgaaggcaatgagagtcatatgttatgcttggttatgtcctgctctgatgccagtttggagtaaaggctgaactttgctgttgaaagccactgtggaaagtggaaacattgactgtgcgttgctgaggggaggaatgtatttacttacccagaaatagacgcatccttgtctcagtgggctgggagatagtatcaatcctttctgttgcaacagatcccactgccttcttttttcaaaagagtaaatatttaaataggtaatacagaaaagttattgccatttttccttcatcagccatggctgggagtcaaaagagagagt

SEQ ID NO: 138218 - DNA, 1004 bp, Homo sapiens
gcgcagctgctccctggcgccctctcaaggagcccctgaggattcgcgcctcccggaagggagaaaagcccgcccgaggcgcggtgctgacggtggctgggctgccgggtgcgctgtggaaccgcctcctgctagagcagcgggctggcgacggtcctcgccggggcgggaagcggctcaggctgccctcgctggcctgcggcggcgcggctggaagcgcgggccactcgtgcgtgggtcactcaggactgcgcctcgcgcgactgtgtgtgcaggaaacaagcaggaaataccctaaaagagaatgaagcgccatgttgagggtcgcggacgtcgcgagtgctgtgggaatgtgggctgaggtggagagttatggtagcccgtgttacaggctcaggggtctgaaagaagcctaatcgtggaggcggcatctgaggagggtcttgaaggctgggcaggcatttgcccgacagagatggaggaagctagtcctgtctgatggaggaaacagggcggaggcgtggagggagccgtgcagcgctggtgtgaggagcagcgagcaggccaggcctgtaaagcagagtgagggaaccaggatagagaaggcaagtcggggtcctgtggtcgctgaagaatttgaatgaaatcagtaaacaggctgtacaggaagcatggtgatggcatctgcatggcgcctgtggaggccccagggagcttttactcatgatggaaggcacagagggagtaggcacatcacatggtccgaggaggagcaagagaaaatgggagtgggggtaagtaccacacacccttacacaaccagatcttgaaagaattcactatcacaaggacggcatcaggccatgagagatccatccccatgaccctaccaggccccacctccaacactgaggattacatttcatcatgagatttataggggccaccttccaaaccatttcatacaccacggaatactatgcagccataaaaataacaaaatc

SEQ ID NO: 138219 - DNA, 490 bp, Homo sapiens
cacctccttgactaaatttgttactaggtattttatatgttttgcagttattgtaaatgacattgctttcttgatttctctctcagctagtttgttattggtatagaagcattagattattttgtatattgattttgtatcctgcaattttacttttaagtttcaagatttttttgtggtgtagtctacgtttttctcaaatatgatgtcacttgcaagaaggataattttactttctctcttccaatatgatatttttcatttttttctcttgcctgatggctctggctaggacttctactactatgttgaatatgaatggtaaaagttggcatcttagtcatgtttcactttttagttttttctcattcagtataatgttagctgtgtgtttgtcatatatggtccttataatgctgagatatgtttgttctatgcctaatttgttgagagttttatcatgaagagttgtttaattttattaagtggg

SEQ ID NO: 138220 - DNA, 346 bp, Homo sapiens
tactaagtgagagggggagccttagaaaggaacttgaactcagcctgatattagaagtgcacaggcaggtgggctatggttattgtctatacccagtagcatgaaaagtaaaagctatgtaaaggtgatgtatctaatggcagtaataaattagctagacataatcatatctagggcattttcagacatctgacagaaaatcaacatgcaccataactgacacttagacctgaccaaggcatctcattaagaacatgtacccttggccgggtgcggtggctcacgcctgtaatcccagtactttgggaggccgaggtaggtggatcacctgaggttgggagtttga

SEQ ID NO: 138221 - DNA, 200 bp, Homo sapiens
tcaagtcagggcaggagagctagtagagacagactatggcgtaagtcataagcaggctgtccagttgtcccgaaggtggataatcaagtcaatcttggtggctagccaatacaaggcttgtcagtgggcctaacgcagtggctcatgcctgtaatcccagcactttcggaggctaaggcaagcggatcacctgaggtcag

SEQ ID NO: 138222 - DNA, 366 bp, Homo sapiens
aggctggcaaggtgaagagagattactattgatctaagacggtttctggtgagatggctatctccacagatcaagctcgggcaggcagggataggatggcatagaaaagtctagtaaggattgggcgtggtgactcacgcctgtaatcccagcagtttgggaggccgaggtgggtggatcacttgaggtcaggagtttgagaccaacctggccaacatggcaaaactctgtctctactaaaaatacaaaaatcagcctggtgtggtagcatgtgcctgtagtcccagctactcaggaggctaaggcaggagaatcactcgcatctgggaggcagaggatgcagtgatccaagatcatacgacagca

SEQ ID NO: 138223 - DNA, 310 bp, Homo sapiens
tggtaacatgtggcactgtatcccaaggatgatgccctgcatgtgacaacgtatataataacgactgcttctgctttaataacaaatatcaaatacagtgtgacaactccttgggtgcttctgaatacatgttataatttatttctagagtggatcctttcctatcatttttggagagaatttactcaaggtctaaaactttcatgtgatcacaatgtcttgaagattatgtaaaagtaaacaattattttaatcaactaaaaatatttatttgggccaggcacggtggctcacgcctataatcccagca

SEQ ID NO: 138224 - DNA, 190 bp, Homo sapiens
ggatcattgaggcctccccactgggggtgctggggccagtcctagccagggcagagagtgggtcagccgtctcagctccttgagtggttggtgctggtactggtctcatggttttagacctggcacccagtgggtatggggagccctgggcacctgtgggcctacttatggaagtcatcctcttccctta

SEQ ID NO: 138225 - DNA, 225 bp, Homo sapiens
cggtacctacttttccacagagagaagtcaggctaactccacgacctgaaggctgatcacttactttcaggacaggggctgagagaggactgtcacggggaaagattaaaaatgagaccaaagcaaccacgaccacaacaaaaagagagagcaataaagagagacttagaaatgaacacccacttgctttcagatgaaaagcttgagtcaaagtggtgttaagga

SEQ ID NO: 138226 - DNA, 260 bp, Homo sapiens
tggaagtaaagtcagggtgtgtgaaggaggagggatgatgaactgaggtgagtgctcccaaagagtccggtaaaacgaggactttgaattaggcattggacttcacagcatgaaggcctctcgtggcctctctggagcagtgctgccagggtgatgggccagaaagcctgagtatagtgggcttcagagagaaggtgaggagagtgactggggacaactggtagacaatgcttccaaggagttctgctgtcaaggggaac

SEQ ID NO: 138227 - DNA, 244 bp, Homo sapiens
ttctacttcttccctttgtggtccctcagatcattatcttaacctgtgtagaatagtgaagaagggacaagcccagcctttggaatcatctagacctggtttcaaatcctggccctgttaccttaatagctttgtgatttgggtgagtcacttaacctttcagagcctcagttttcccctctagaaacttacttttattggtatttgctgtatcatgtttatgtttatacagttaaaaaagccc

SEQ ID NO: 138228 - DNA, 228 bp, Homo sapiens
attggtgagagcactcagtgtgcaagcaagggtgcacggtgcactcagcccctttgatacctgaaacgatgtctgggcagttttgctaattgttgctgtgtgcttgcgtgatttagacgaaggctgctttaaaacccagccagactttgtgtttgctatgtaaccagtgcatttggtgtggcctcccaccctttgcgttagattagccaacttggctactttgggttg

SEQ ID NO: 138229 - DNA, 399 bp, Homo sapiens
taattttcgacaagggtaccaagactattcaatgggggaaaggacagtattaacaaatggtgctgggaaaactggatgttgaaattcaaatgagcgaagttggacccttacctaacaccatatacaaaaattaactgaaagtgaataagggacctaaatgtgagatgtgaaactgtaaaactcttagagaaagacagggcaaatcacaacatttgatggcaatgatttcttggatatgacaccaaaggcacagacaacaaaataatagacaaaaaaggcaagttgaactttataaaagtttttacaaatggctctgaaagacactatcaacagagtaaaaaggcaatacacagaatgttagaaaatatttgcaaatactatcataaaaagaatattcag

SEQ ID NO: 138230 - DNA, 754 bp, Homo sapiens
tcctcatcttaataaagagtccatgagtagaagcaacattctagttgcttccactagttgcattctagtaggggccttatgattctgagaacttttgagatatcagtccacattttttacattctttaatttatctgagccagagtggagctgcctttggagattacgtagaatgtactgatatccattgcattttcccatatgctgccttttttttttagcctaatccaattgcaccaagatttgttgcttgtgcattatgtgaaagccctatgctaattgctgcaggggttacaagagtgaatttgatagtttttgccctcaagcagtttatgatcttgtgggattaaagacatggcagttacaccaaagctataatatgcagacaaaaataagtataatttctgtttccatttttatatcttacttgggttaaatttatcttaggctttctaatcaaagccctgtgaaataaaggaggataagaagaggaaaagcaaaatccccaggctgactgtactcatcagttgctgtgaataaactggctccaaagtatgagatccagatgttggatttatatcacagctcagtgaatgacaaaaatcatagtactatgtcttttattgcttcactatttatatataacctatgatgaagcattaaccttctttggctaatatttcctgccccaaaagaccactagcaggcatacaactgtgcgcagctggaataagcatagcctgaaattcatgac

SEQ ID NO: 138231 - DNA, 828 bp, Homo sapiens
ataggccagagaaatatggctgttacgatgaaggcgtaacttctctggttcttgattatttacaccattagagaagaatgcaaatatgaatagctcagagtagtttaactttgaagtgagagtttatatgcacctttatatgtgggataactgatgtctttggaatagacttcaaatgaatgataaaaacacctgtaaagtgataggacctctactttttctcatgtccaatgttcagtttcttataaaccaggcatgaagagaaacaaaaagtaattaattctccagatcatgaagttgtcttcaacctaagcacagaggtataataattacatttctcagaagttccccctctgttttgagtctcaagggcaattgagatgtcagtgaggctgtgattaaatgtattggatattagaggattttaaatacaaacaagtattataggtgttaccactgaccccgaaggtaagatttactgtgaaaatttataatgcaaggaagaatgatcaagttggctgtcagaacaacaaaatattacaaaccaggatgtctaagagcagaagtccgtggttgccacctctcaagcctcttagcttaatccaatctaggatgcatttccactctgcaacaaacagtatttatttttgccttatttgcagataacagttttaatgcaggtactgcccatggattagctttgagcagtgtctttttgctttggtttttttatttgtttggtttgttttgagactgagtctcagtcctccagcctgggcaacatagcaagactcccaccccttaagaaaaaagaagagagaaaaaaaa

SEQ ID NO: 138232 - DNA, 479 bp, Homo sapiens
atgaaattccttttcttttttaaatttattttttctttatttttctttataaagtgaagagtaggtagcatgaattcctcttgccctttgctatttcagtctggcatcagtagcaattgttgctatgtccagttttcattcatggatttttctgggattgaagatgagttcaatgttgattatttaattgggcagtataagtaaattcattggctctccttccagtttagtgaatactaaatatcatccatgatattttatacttcttacacttctggaatctaacctgaaaatagaagttgtaagtcagggacggtggtatgtgcctctagtctcagctagttgggaggctgaggcttgagcccaggccttcaaggctgtagtgcacaatgactgtacttgtgaatagccactgcactccagcctgggcaacatagcaagactcccaccccttaagaaaaaagaagagagaaaaaaaa

SEQ ID NO: 138233 - DNA, 964 bp, Homo sapiens
ataggccagagaaatatggctgttacgatgaaggcgtaacttctctggttcttgattatttacaccattagagaagaatgcaaatatgaatagctcagagtagtttaactttgaagtgagagtttatatgcacctttatatgtgggataactgatgtctttggaatagacttcaaatgaatgataaaaacacctgtaaagtgataggacctctactttttctcatgtccaatgttcagtttcttataaaccaggcatgaagagaaacaaaaagtaattaattctccagatcatgaagttgtcttcaacctaagcacagaggtataataattacatttctcagaagttccccctctgttttgagtctcaagggcaattgagatgtcagtgaggctgtgattaaatgtattggatattagaggattttaaatacaaacaagtattataggtgttaccactgaccccgaaggtaagatttactgtgaaaatttataatgcaaggaagaatgatcaagttggctgtcagaacaacaaaatattacaaaccaggatgtctaagagcagaagtccgtggttgccacctctcaagcctcttagcttaatccaatctaggatgcatttccactctgcaacaaacagtatttatttttgccttatttgcagataacagttttaatgcaggtactgcccatggattagctttgagcagtgtctttttgctttggtttttttatttgtttggtttgttttgagactgagtctcagtcctccaggctggagtgcagtggtgtgactttggctcactgcaacctctgcctcccgggttcaagcgagtgctgaggcttgagcccaggccttcaaggctgtagtgcacaatgactgtacttgtgaatagccactgcactccagcctgggcaacatagcaagactcccaccccttaagaaaaaagaagagagaaaaaaaa

SEQ ID NO: 138234 - DNA, 328 bp, Homo sapiens
gaaaatgaagatgcaagtaatacaggtttggtggggaggtcaaatatgttagcagccctacctgttacttaatctctctgtaatctctgtcaatgcactcctccctccccttcctcatctctatcattgagaatagtatagggttaagaccttcagctctggagtcagctctcccagttacagctgcagaaccatcagcaagttacttacctttttaagtcactattacatcatctgtaaaattggatttatgcaacatatttagtgagtgcctgatatgtttaggtacttttctaggagctagggcttagcaatgaactaaataaag

SEQ ID NO: 138235 - DNA, 356 bp, Homo sapiens
ttgtgggacaaagcatcctgttttaactctgttcttttatagtgtatttctagtgcatagtcctgaggatgttttatttgcagatccctttaattcttcccttccttgtgtgttgagtaggtgatcatccctgttctaaacttttattactccaaggatagggtctgacttgttgcctttctaagataatctaaatgccttcttcatagcaagaggaaacagttacctccttcagctggttgtttgaacataactatgtgagtgtttgaaaccatagggtccttcaaattctacaataaccagaaattgagaacattttgtctttaacaactgaaccagttcatttattgtgacta

SEQ ID NO: 138236 - DNA, 271 bp, Homo sapiens
accaagaactcacaacatatattctgttcaactttgcattatgaaaagtatacagtgttcaagtgatgctttgcacttgtaacaatctatctacttatttgagacattggtattaaaaatgtggcagaccacactttagccaagattccatcttgttactgatcttttccatatgttttctgttagtgtctttgttcttaaaactcaggctttcactaaggaagagagagcaaatctgtgttacgtctaggtcgacctagactttacacag

SEQ ID NO: 138237 - DNA, 541 bp, Homo sapiens
ctgggctcaagcaatatgcccatctcagcctcccaaggtgctgggattacaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttcta

SEQ ID NO: 138238 - DNA, 1597 bp, Homo sapiens
ggcacgagggagagagagagagagagagagagagagagagagagagagagagagagagagagagagagagagagagagagagagagagagagagagagagagagagagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttcta

SEQ ID NO: 138239 - DNA, 592 bp, Homo sapiens
tcccccccgagatggaatcccatgataccattttatttaaatattggcctaattttattttgcttgcagacatttaaagtgtttttgtatctccttaccgtctttggaaaagagtttgagacccacaaatatgtcatggtaaatttaaaatcaggtagcagtttattgtcagagccaaatctggaataaccaatttagttgccatttaactgtgctagaccacacttttgtaacactgtatgcccaagaaagaaaaaaaaaatctacagatgattaatgcagttttccatcctttttaactttttccagttcagccttttctcttttctttcagcatggaggcgccattgtgtcggctttgagccagactgggtctctctttaagccccggaaagcctatctgccccaggagttgctgggaaaggtcaagtcaaaggaaaatttgtttctacttagattgttatcctgtttaaagaaaaatatttttattaatctatgtattttgacataatttcagacttagagaaaaatcatattcctgtatgcccttcccctggattcctaaaatattaacttgatcatcattgcttta

SEQ ID NO: 138240 - DNA, 738 bp, Homo sapiens
  misc_feature (686)..(686): n is a, c, g, or t
gagtagccagccaccatatgtggagtccatatgtggagtcctgtatcaggcaatgttgccagagaatgagaagtagagttacatagaagaaaaacaaataccttaccttcaaagtgcttaagtagagtctgtctgtctggtgctttgttccttaactaacatgtttcctgatcctttttcttccccaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttctaaaaaaaaanattactgggccgcgtttacaacgtcggactgggaaacctggcgtacccactt

SEQ ID NO: 138241 - DNA, 677 bp, Homo sapiens
gagtagccagccaccatatgtggagtccatatgtggagtcctgtatcaggcaatgttgccagagaatgagaagtagagttacatagaagaaaaacaaataccttaccttcaaagtgcttaagtagagtctgtctgtctggtgctttgttccttaactaacatgtttcctgatcctttttcttccccaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttcta

SEQ ID NO: 138242 - DNA, 487 bp, Homo sapiens
tccgagcacccgcccgccctccaaccgcgcctctagtagaccctcacggtgttctctcccggcccgttctctgccgcaccccgcagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggatggctataatggatttggtaatgatggaagccattttggaggtggtggcagctacaatgattttgggaagtaccacgatcagtcttcgaattttggacccctgcagggagggatcagtcgaggcagaagctctgctccctatcccgttggagtcccagatccttgctataaccacgaatccgagtatgactcgcccgtcc

SEQ ID NO: 138243 - DNA, 735 bp, Homo sapiens
gggttcctgccacattctccttattgaatttatttattcaatagacttcactggagagactcatgctgggacacccacagaaaaattcatactgtgcaagggctactccagcacctaagtaaatctttgccacacctgtcctagtatatgtacagaaattaactttcagcactatatttcatctactctgactgaaagcattccaactgttcatttacttgcccttgacctcacatttgagtatgaagaggggatatagaagaaaagctaaggctgctctatcactagataatagagttaatagtaatcggaggcctggtgcagtggctcacacctgtaatctacactttgggagggcaaggtgggaagaccacttgatgtcgggagtttgagaccaggctaggcaatatagtgagaccccatctctattgaaaaaagcaaaaaaaaaaaaatactatttagaatagcttattaaaggagtacagtgaagagtgtaagactaactgttcatttacttgcccttgacctcacatttgagtatgaagaggggatatagaagaaaagctaaggctgctctatcactagataatagagttaatagtaatcggaggcctggtgcagtggctcacacctgtaatctacactttgggagggcaaggtgggaagaccacttgatgtcgggagtttgagaccaggctaggcaatatagtgagaccccatctctatcgaaaaaag

SEQ ID NO: 138244 - DNA, 700 bp, Homo sapiens
  misc_feature (24)..(24): n is a, c, g, or t
aattcggcacgagggtcgcctagnctggagaactagtcctcgactcacgtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgctcaagacagggaatggaattggagggagcccagaatacaagctgctgctagcaaaggggtggggctaaatgagaagaaaatttaaaaagatgaaatttaatctgaaaaacagaaattcatgtgttgattaccttttgtgactagtacaattactttaagctcatgtttaaacaatattgatgttttcctccttgtatagcccaagaagattccagtaatttcagcatcaaataactgttttaaatgaacttaaaatttgccttggcaaaatatcatgaaaatagttaatatgctgcacaaaagcaaaatcatagtacactcctgagctaaatagaagcaatattttgattagatgcattggtttttattc

SEQ ID NO: 138245 - DNA, 1384 bp, Homo sapiens
  misc_feature (52)..(52): n is a, c, g, or t
tcttcacattcctttttctggtgcacgatattgatgatcaacacaccccccnagaattttttgtttcaaggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttcta

SEQ ID NO: 138246 - DNA, 1659 bp, Homo sapiens
ggcacgagggagagagagagagagagagagagagagagagagagagagagagagagagagagagagagagagagagagagagagagagagagagagagagagagagagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgctcaagacagggaatggaattggagggagcccagaatacaagctgctgctagcaaaggggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttcta

SEQ ID NO: 138247 - DNA, 1015 bp, Homo sapiens
tctcgaggatctcggtcgctcggacaacaggcatacatgtgaaagcagcctagggtagttgaaacgacgagtgaatgctctcaaaaacctgcaagttcaatgtgcacgcatagaacgccatattctattgaggaagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttcta

SEQ ID NO: 138248 - DNA, 2068 bp, Homo sapiens
  misc_feature (1613)..(1613): n is a, c, g, or t
  misc_feature (1622)..(1622): n is a, c, g, or t
  misc_feature (1676)..(1676): n is a, c, g, or t
  misc_feature (1699)..(1699): n is a, c, g, or t
  misc_feature (1705)..(1705): n is a, c, g, or t
  misc_feature (1812)..(1812): n is a, c, g, or t
  misc_feature (2035)..(2035): n is a, c, g, or t
ggcacgagggagagagagagagagagagagagagagagagagagagagagagagagagagagagagagagagagagagagagagagagagagagagagagagagagagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttctaaaaagagagggaaggngaaaaaggnagaagggaaggaggaaagaagaaaagggaaggaggaggaaaggagggggggggnagggggggggcgggggagccccnaaaaanaattggggcctctttttgccccaaggggggggagtctggggggggtctttctttttggggggggggagaaaaagagcccccgggtcagggggtcctcggcgtggggngttgggggggggggggggggggttttttctcttgggggggggggttgggtgtttcccaaaggggggggagacccgaggaaaaattgtgggcaggggggctaaaggggccaaccgggaggggggccttgtggggtttttctaaagggcgcccccctggagaaagataaaaaaatgcgttgaagggggggggggaccccgcgcggtttttaaaacccgggggtcncccgggagggctttggggggttgggggggaggg

SEQ ID NO: 138249 - DNA, 1633 bp, Homo sapiens
  misc_feature (1601)..(1601): n is a, c, g, or t
  misc_feature (1611)..(1611): n is a, c, g, or t
ggcacgagggagagagagagagagagagagagagagagagagagagagagagagagagagagagagagagagagagagagagagagagagagagagagagagagagagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttctactcnaaaaaataantcctattaaactcgaagggggg

SEQ ID NO: 138250 - DNA, 1600 bp, Homo sapiens
ggcacgagggagagagagagagagagagagagagagagagagagagagagagagagagagagagagagagagagagagagagagagagagagagagagagagagagagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagatattttattttctaggaaaagagccataattatcttgtcgacc

SEQ ID NO: 138251 - DNA, 1543 bp, Homo sapiens
ggcacgagggagagagagagagagagagagagagagagagagagagagagagagagagagagagagagagagagagagagagagagagagagagagagagagagagagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacatcacatttaagataattatggctcttttcctaaaaaataaaatatctttcta

SEQ ID NO: 138252 - DNA, 1627 bp, Homo sapiens
ggcacgagggagagagagagagagagagagagagagagagagagagagagagagagagagagagagagagagagagagagagagagagagagagagagagagagagagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggatggctataatggatttggtaatgatggaagccattttggaggtggtggcagctacaatgattttgggaagtaccacgatcagtcttcgaattttggacccctgcagggagggatcagtcgaggcagaagctctgctccctatcccgttggagtcccagatccttgctataaccacgaatccgagtatgactcgcccgtcc

SEQ ID NO: 138253 - DNA, 1745 bp, Homo sapiens
ggcacgagggagagagagagagagagagagagagagagagagagagagagagagagagagagagagagagagagagagagagagagagagagagagagagagagagagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtcagaagagatcaattctacagaaatttccagtggttctgttgaggctttatggaattcagcatgtcaaaattcacagctggctgggcacagtggctcatgcctgtaatcccagcactttggaagcccaaggcgggcagactgcttgagttcaggagtttgcaaccagcctgggcaacatggtgaaaacctgtctctactaaaaatacaaaaattagccgggcacggtggcatgcgcctgtaatccaagctacttgggaggctgaggcaggagaattgcttcaacttgggaggcggatgttgcagtgagccaaaattgcaccactgcactccagcctgggcagcagagcaagactccgtctcaaaataaataaataaataaataaataaataaataaataaatgtatactgtactg

SEQ ID NO: 138254 - DNA, 1269 bp, Homo sapiens
ggcacgagggagagagagagagagagagagagagagagagagagagagagagagagagagagagagagagagagagagagagagagagagagagagagagagagagagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagatagctctttctggatatcaagtgttacacaaggaacagctat

SEQ ID NO: 138255 - DNA, 1479 bp, Homo sapiens
ggcacgagggagagagagagagagagagagagagagagagagagagagagagagagagagagagagagagagagagagagagagagagagagagagagagagagagagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttcta

SEQ ID NO: 138256 - DNA, 1276 bp, Homo sapiens
ggcacgagggagagagagagagagagagagagagagagagagagagagagagagagagagagagagagagagagagagagagagagagagagagagagagagagagagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggtcaagtcaaaggaaaatttgtttctacttagattgttatcctgtttaaagaaaaatatttttattaatctatgtattttgacataatttcagacttagagaaaaatcatattcctgtatgcccttcccctggattcctaaaatattaacttgatcatcattgcttta

SEQ ID NO: 138257 - DNA, 1406 bp, Homo sapiens
ggcacgagggagagagagagagagagagagagagagagagagagagagagagagagagagagagagagagagagagagagagagagagagagagagagagagagagagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattgggtaagtgcatatgatacctcacacatttcagaaagaaatgtattatcattttaaacatgttctactatttcattgctaatactttacagtctctaattttatggacagccatttaggtatacctaaatggctgtgtatggttatgggttctaatttctctacaaaatcaaccagccatgatggagtaaagaaagttagaaagagtaaaatatggtcatataattttttggaaacacttccaagtacaaaaagcagcatgctaatttcacagtgcaaagaaagctcataataacaatagacttttaaaattacaaataaaatctgttacatcaaggatatttttaaggctacccgtgtgcattgtcactatgtagacaatgaagaggaa

SEQ ID NO: 138258 - DNA, 1382 bp, Homo sapiens
ggcacgagggagagagagagagagagagagagagagagagagagagagagagagagagagagagagagagagagagagagagagagagagagagagagagagagagagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccaggtgactagactcccagaagttgagtgctaggtagtccttacatggattctttgtgccctgagtaccaatagactatggagaactgatactggagttggaataactgtatcatttttaatttctttcatacgttttgctcacagtggactcataacttgaaactcatttatccatgtgaaataaataggcaacagtaagttgttcccattttgtgggtagcaaagtgaaatccagttgattcattgacttttcaaggtacagcctccaatccctcgcaagcacatttccaactacatgattttctccagacaatatctttttagggaaccagaaatgtattggaaaaattcttctttaccctggtgattcttagataccctgtctagaccaggggccttcaactctggatataaagcagagtcacctaagagcttgttaaaaatgcagatgccagagtctcattctggacattttcatcagaatcccttatgtatgtttattcaaggctccaagcagaaatggattagaaagcattcactttggcctcccaaagtgctgggattacaggcatgagccattgcacccggcctcagctttactttcctaacagggatctgatagctaaaggaaaagcctttgccagtcacgatggctcaaacctata

SEQ ID NO: 138259 - DNA, 695 bp, Homo sapiens
ggcacgagggagagagagagagagagagagagagagagagagagagagagagagagagagagagagagagagagagagagagagagagagagagagagagagagagagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgggtaagaacttcctgttgtttcttctgtctgttaggtttagttatcctgttactgtggtagccttgcagctttaattttcttttcttttcttttcttttttttttttt

SEQ ID NO: 138260 - DNA, 329 bp, Homo sapiens
gcattgctgctcacctagataaccaggttccagttgagagtccgagagctatttcccgcaccaatgagaatgacccggtgagttactaatatgtatatggggtttctcagggcttatgatttgtgttcctgtcctcattttgcataggaaaactgaaactgaaagaagcttagtagatttgcatttactcagatagtgcacctgagatagcactctggaacccagattctccctgtccctgtctgatactgtggtaacatacactggccagctcggtctgtatcagttcccatgtaatctctactagtgaattcacctagttccacgga

SEQ ID NO: 138261 - DNA, 320 bp, Homo sapiens
ctggtggcgcgcgcctatagtcccagctactcaggaggctgaggcaggagaatcgcttgaacccaggaggtggaggttgcagtgagcccaaatcgcgccactgcactccagcctgggcgacagagcgagactctgtcaaaaaaaaaaaaaaattgttgtcaattgtttcgggagaacatctaggaaaggcacgtgatgatctcttctctctttctgtccgatatgcagattgcccccgaggaattagcacttgttcacaacttgaggaaaatgatgaaaaatgattgggtaagtgcatatgatacctcacacatttcaga

SEQ ID NO: 138262 - DNA, 747 bp, Homo sapiens
cagaagttgagtgctaggtagtccttacatggattctttgtgccctgagtaccaatagactatggagaactgatactggagttggaataactgtatcatttttaatttctttcatacgttttgctcacagtggactcataacttgaaactcatttatccatgtgaaataaataggcaacagtaagttgttcccattttgtgggtagcaaagtgaaatccagttgattcattgacttttcaaggtacagcctccaatccctcgcaagcacatttccaactacatgattttctccagacaatatctttttagggaaccagaaatgtattggaaaaattcttctttaccctggtgattcttagataccctgtctagaccaggggccttcaactctggatataaagcagagtcacctaagagcttgttaaaaatgcagatgccagagtctcattctggacattttcatcagaatcccttatgtatgtttattcaaggctccaagcagaaatggattagaaagcattcactttggtcaggcacaggggctcacacctgtaatgtcagcactttgggaggccaaggcaggcagatcacctgaggtcaggagttcaagatgagcctggccaacatggtgaaatcccatctctactaaaaatacaaatattagccgggtgtggtggtgcacgcctgtaggcccatctattcaggaggctgaggcaggggaatctcttgaacctgggaatcagagg

SEQ ID NO: 138263 - DNA, 2095 bp, Homo sapiens
ggcacgagggagagagagagagagagagagagagagagagagagagagagagagagagagagagagagagagagagagagagagagagagagagagagagagagagagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttctaaagtgttgtgttagattaataatatggaaggagtctttagattggccaaattgcatttctctgatattcctcttgttgcaggtcagaagagatcaattctacagaaatttccagtggttctgttgaggctttatggaattcagcatgtcaaaattcacagctggctgggcacagtggctcatgcctgtaatcccagcactttggaagcccaaggcgggcagactgcttgagttcaggagtttgcaaccagcctgggcaacatggtgaaaacctgtctctactaaaaatacaaaaattagccgggcacggtggcatgcgcctgtaatccaagctacttgggaggctgaggcaggagaattgcttcaacttgggaggcggatgttgcagtgagccaaaattgcaccactgcactccagcctgggcagcagagcaagactccgtctcaaaataaataaataaataaataaataaataaataaataaatgtatactgtactg

SEQ ID NO: 138264 - DNA, 1545 bp, Homo sapiens
ggcacgagggagagagagagagagagagagagagagagagagagagagagagagagagagagagagagagagagagagagagagagagagagagagagagagagagagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttcta

SEQ ID NO: 138265 - DNA, 1516 bp, Homo sapiens
ggcacgagggagagagagagagagagagagagagagagagagagagagagagagagagagagagagagagagagagagagagagagagagagagagagagagagagagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttcta

SEQ ID NO: 138266 - DNA, 1869 bp, Homo sapiens
ggcacgagggagagagagagagagagagagagagagagagagagagagagagagagagagagagagagagagagagagagagagagagagagagagagagagagagagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttctaaaaaaaaaaaacaaaaaaaaaacaagacgttttgcgcccgactcgaggcccttggaagaagagttttgaaaaaacaatcgttagggcgcagaaggccccgagtagggcaagcgacacgggtcgcaacgcgtgtgcccagagaaacaccggcaagcaagggcgcgagatccacaaataaaaagcgccggggaaaggaggtctgacaaaatccagaggggtacggagcatagggatcaccgaggggtcagcgagcacaatcagtgccgcacggg

SEQ ID NO: 138267 - DNA, 2125 bp, Homo sapiens
ggcacgagggagagagagagagagagagagagagagagagagagagagagagagagagagagagagagagagagagagagagagagagagagagagagagagagagagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattgggtaagtgcatatgatacctcacacatttcagaaagaaatgtattatcattttaaacatgttctactatttcattgctaatactttacagtctctaattttatggacagtaagttattatgtcttatttaattcctgtatctgtaccaagttagaaataaagtctgaattaaaatctatatatatgtggtttataatctttccaaagtaagtttattcaaaaccattttatttaaatattggcctaattttattttgcttgcagacatttaaagtgtttttgtatctccttaccgtctttggaaaagagtttgagacccacaaatatgtcatggtaaatttaaaatcaggtagcagtttattgtcagagccaaatctggaataaccaatttagttgccatttaactgtgctagaccacacttttgtaacactgtatgcccaagaaagaaaaaaaaaatctacagatgattaatgcagttttccatcctttttaactttttccagttcagccttttctcttttctttcagcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttcta

SEQ ID NO: 138268 - DNA, 1712 bp, Homo sapiens
ggcacgagggagagagagagagagagagagagagagagagagagagagagagagagagagagagagagagagagagagagagagagagagagagagagagagagagagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttaaaatgggtttcactgtgaatgcgtgacaataagatattcccttgttcctaaaactttatatcagtttattggatgtggtttttcacatttaagataattatggctcttttcctaaaaaataaaatatctttctaccaaaaaaaaaaaaaaaaaaaaaaaagttgggggctcggccagaaaattttaaacatggggggggggggccagaagtaggaatggccaggggtcaagaaccgggtgaaggggggttccacaaaaaagcggggacggggttgaaacaggggtgggcctggtaa

SEQ ID NO: 138269 - DNA, 1784 bp, Homo sapiens
ggcacgagggagagagagagagagagagagagagagagagagagagagagagagagagagagagagagagagagagagagagagagagagagagagagagagagagagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtcagaagagatcaattctacagaaatttccagtggttctgttgaggctttatggaattcagcatgtcaaaattcacagctggctgggcacagtggctcatgcctgtaatcccagcactttggaagcccaaggcgggcagactgcttgagttcaggagtttgcaaccagcctgggcaacatggtgaaaacctgtctctactaaaaatacaaaaattagccgggcacggtggcatgcgcctgtaatccaagctacttgggaggctgaggcaggagaattgcttcaacttgggaggcggatgttgcagtgagccaaaattgcaccactgcactccagcctgggcagcagagcaagactccgtctcaaaataaataaataaataaataaataaataaataaataaatgtatactgtactg

SEQ ID NO: 138270 - DNA, 1256 bp, Homo sapiens
ggcacgagggagagagagagagagagagagagagagagagagagagagagagagagagagagagagagagagagagagagagagagagagagagagagagagagagagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaaggctcctaccagttatcgggatcctctcagg

SEQ ID NO: 138271 - DNA, 1571 bp, Homo sapiens
ggcacgagggagagagagagagagagagagagagagagagagagagagagagagagagagagagagagagagagagagagagagagagagagagagagagagagagagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttctaaaaaaaatcggcctcgtggccacagcggtgagct

SEQ ID NO: 138272 - DNA, 1804 bp, Homo sapiens
ggcacgagggagagagagagagagagagagagagagagagagagagagagagagagagagagagagagagagagagagagagagagagagagagagagagagagagagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattgggtaagtgcatatgatacctcacacatttcagaaagaaatgtattatcattttaaacatgttctactatttcattgctaatactttacagtctctaattttatggacagtaagttattatgtcttatttaattcctgtatctgtaccaagttagaaataaagtctgaattaaaatctatatatatgtggtttataatctttccaaagtaagtttattcaaaaccattttatttaaatattggcctaattttattttgcttgcagacatttaaagtgtttttgtatctccttaccgtctttggaaaagagtttgagacccacaaatatgtcatggtaaatttaaaatcaggtagcagtttattgtcagagccaaatctggaataaccaatttagttgccatttaactgtgctagaccacacttttgtaacactgtatgcccaagaaagaaaaaaaaaatctacagatgattaatgcagttttccatcctttttaactttttccagttcagccttttctcttttctttcagcatggaggcgccattgtgtcggctttgagccagactgggtctctctttaagccccggaaagcctatctgccccaggagttgctgggaaaggtcaagtcaaaggaaaatttgtttctacttagattgttatcctgtttaaagaaaaatatttttattaatctatgtattttgacataatttcagacttagagaaaaatcatattcctgtatgcccttcccctggattcctaaaatattaacttgatcatcattgcttta

SEQ ID NO: 138273 - DNA, 1067 bp, Homo sapiens
ggcacgagggagagagagagagagagagagagagagagagagagagagagagagagagagagagagagagagagagagagagagagagagagagagagagagagagagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaaggatgaggtggaacgtgtgatcaccattatgcagaatccacgccagtacaagatcccagactggttcttgaacagacagaaggatgtaaaggatggaaaatacagccaggtcctagccaatggtctggacaacaagctccctgaaaacctctagccaccttagaaaaaatccggccccataaagggctgcgtcacttctggggccttcgtgtccgaagccaacacaccaagaccactggccgccgtggccgcacccggggtgtgtccaaaaagaaataagtctggtggccctgtctgt

SEQ ID NO: 138274 - DNA, 759 bp, Homo sapiens
ggcacgagggagagagagagagagagagagagagagagagagagagagagagagagagagagagagagagagagagagagagagagagagagagagagagagagagagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgctcaagacagggaatggaattggagggagcccagaatacaagctgctgctagcaaaggggtggggctaaatgagaagaaaatttaaaaagatgaaatttaatctgaaaaacagaaattcatgtgttgattaccttttgtgactagtacaattactttaagctcatgtttaaacaatattgatgttttcctccttgtatagcccaagaagattccagtaatttcagcatcaaataactgttttaaatgaacttaaaatttgccttggcaaaatatcatgaaaatagttaatatgctgcacaaaagcaaaatcatagtacactcctgagctaaatagaagcaatattttgattagatgcattggtttttattc

SEQ ID NO: 138275 - DNA, 350 bp, Homo sapiens
gccagagccagcccagggctgggaggggagacagggcaggacacggccatggaggcagctgcccatggtctctggagtgcatgagggctgtgcctcttcggtggctgctgctccttctgaagagtggcctgcggtcggcagcggggcctctggggagagctcctgatttcactttcatgctctgccgccactgagaggagttaggaaaataccacgggctgcgtgatttaatcgccctgctatttgttaattagtctgtgtgaagtgccaatccgcagtgtgcgtgggcgtgggggcaggactgcggtttgcagggaagccagccgcttggagcagaggcagttggagtt

SEQ ID NO: 138276 - DNA, 439 bp, Homo sapiens
ttatttttgacatagtaaaggtttctaaaaacagacaaaatattctcactcttgtgaaagatcagatgagtgtacagaagctacagcagacgccagcaaggcagaagcagcggacaggcagacacagcagacgccagagacttaacacttgactggagctcagcgtggacagggagactgcccaccccgccctcaggtgaggagtcacagggcccacagtcaccactgacaacccggatgcccacatgggagcagccataggctggcttttattaagctgcccttttataagtttcctcaaacacttttcactgacccgaagcacttcattaggaaatatttcaaactaagtcatttttcaattatacaatttttttttcacttagtaaatatgctgagggtttcagcttttttatttttattttttagagactgagtc

SEQ ID NO: 138277 - DNA, 407 bp, Homo sapiens
ccagtactctagcatcggggaatcgtccccaggaagccttgtgagaagccaaaagggagctcgaggcgggagggaggagctgagaggtcccataattaagcgtcgggcttaggacgggtcgatatgtcacaaggaatgcacccgaaggctcttcctataggcttcgtttgctgaccaatcactgcattctcaatggcaacttgttgcttggattctcatcagaagcaaataattgtctttgagggggaatgggaaccaagctcttccccacccactccaaagctactaccagagttctacaaatagacatctgctcatttcaagaacactacccatctggtcttcacggagtccacgagtggctcctgtatagtccagcatgtcccgttgggtttaactcaggagga

SEQ ID NO: 138278 - DNA, 462 bp, Homo sapiens
agcccaaaggaggaggggagcagacgtggggtaagtctggtgaggctatgaattaatagctaacctcacaggtgtcccttctgtgccaggcattgttctgagatgtttacgtgcataatttcacttaatcttcatgaggaccttgtgacataagtagtgttattatccccattttatagagaagcaaacagaacataagaggctaactggccacggtcagatggctagaaaagctggactcaattcccggcagtcccactcaagggcctggccactggggcaagatcaggctgagcctgggtgcagggtctggtagatgatcacatagctatcaaggccaaaggtcgctgagaggtgatggcggaagaaggctgagaaggcatcagagttgatgactgcagccatcaattgccctaggaggtgccatttcaggcaaaggtggggtggacgccgatttgtaag

SEQ ID NO: 138279 - DNA, 421 bp, Homo sapiens
ccacttaacctctctgggctcttatctccgcatctgaaacaaggaggctgatccctaggctaacaattagcagggtcattgtgaggacacattaagataacgacttgtaaactgcttttcagctgagaaagtatcacacagctgggacggctcatcacttccctggcctccaactccctccaactcagcaggaacccgctaatggacaccaggagcctctcagcacctctggctgttcaaacaaacacctctcccctcactgcccctcccctgggctgccctttggatacagaggcaaagctcccagtcttccctctagcgctggggcagaccagtctggacacttgagtcacagccttcctgccttccctcaacagggcattcattttagctgagcccctgctgcgtgtttcatgggcac

SEQ ID NO: 138280 - DNA, 392 bp, Homo sapiens
  misc_feature (282)..(282): n is a, c, g, or t
  misc_feature (293)..(293): n is a, c, g, or t
  misc_feature (311)..(311): n is a, c, g, or t
  misc_feature (324)..(324): n is a, c, g, or t
  misc_feature (333)..(333): n is a, c, g, or t
  misc_feature (346)..(346): n is a, c, g, or t
  misc_feature (352)..(352): n is a, c, g, or t
  misc_feature (356)..(356): n is a, c, g, or t
  misc_feature (371)..(371): n is a, c, g, or t
  misc_feature (376)..(376): n is a, c, g, or t
agagcttccctttttccaccctgctctctgtccccagggaggataccttgtatagaatggttctctggtctccctcgctccctggcttccagctgggaccagtcaatggggcacagcagaggaaaaccaagggagagaggagaaatgcgccctagatttgtgccccgccccaaagttccttcctgtgggatgtctcttgatagcactctctccagagtgcacagctcctgtctggacagccctcttcacagactgcctttcttctaggttctggtacctccnttccactcctngcctttcaagccaaaggnccggtcacagcanttgctactnagcccagttactngccctnatgnctcttcttcctgtanccccnagagtttaatggacta

SEQ ID NO: 138281 - DNA, 378 bp, Homo sapiens
aggatgttggagtcagaggagactggggacaccagccatccaaggggatttaggactctgacagccaagggctggtcaactcctctgtgaagatctgaaagtctggtgctaccgtgacgcccacttgcaattcttgctgacatggactggagctggcattctcaggccctctaaataacctcaggagggccggatctctgatgctgcttcgccatctctgtactactcaaagccgtaagattattcactctggttctcagagaggaaggggcaggaactgaagccaggggctggtgagtgggagggtgaacctgtgcttccagagccagggagggacagcaggggctggtgggctggcacttgggggattttacagcc

SEQ ID NO: 138282 - DNA, 258 bp, Homo sapiens
ctgaggtgggaggatcacctgagtctaggaggtcgaggctgcagtgagccatgatcacagcactgtactctagcccgggcaatcaaacaataagctgggtatggtgggacacacttgtagtcctagctactccagaggcactccagcctggccaacagagtgacactctgtctcaatcaatcaatcaatattaaaaaattagctgggtgtggtgggacacacctgtaggcctagttactctggaggctgagatgagaa

SEQ ID NO: 138283 - DNA, 604 bp, Homo sapiens
tagaaattaggaagagtgtcccacttctgacactgtgttccctcttggaacctgaccgtcaatgctagaagaacccttggaaaacatgctggcccagccctctagttttacaaataagggagtgcacagccctgagaggttacatggcctgcccaagatcacgcagtcaatggcagagtaaagagcatagcctaggcctccccactcctctagtaatgctctttcatcttctccaacctggctctaagccttgtccatcctgagccccatatctagcccaacctagtccctgaaaacaagaagtggcccttagaaatctctctccagtcccactatcagaggccaactgctgtcttccagtctccttcagcctgtgctcctctccctccctgactgacaggcagaaggtactgtgcctctggatatccccacagtgccctgagctgcatctcttgccgactgctttaatacatcacagtgacattgtgtgtgtctctgccaccagactattgctccttgatgctctgggtcacctgcatctagcatggcatatatctagtgctcaataaatgtgtattgtacagatgacaagggcaaaaaaaaa

SEQ ID NO: 138284 - DNA, 801 bp, Homo sapiens
tagaaattaggaagagtgtcccacttctgacactgtgttccctcttggaacctgaccgtcaatgctagaagaacccttggaaaacatgctggcccagccctctagttttacaaataagggagtgcacagccctgagaggttacatggcctgcccaagatcacgcagtcaatggcagagtaaagagcatagcctaggcctccccactcctctagtaatgctctttcatcttctccaacctggctctaagccttgtccatcctgagccccatatctagcccaacctagtccctgaaaacaagaagtggcccttagaaatctctctccagtcccactatcagaggccaactgctgtcttccagtctccttcagcctgtgctcctctccctccctgactgacaggcagaaggtactgtgcctctggatatccccacagtgccctgagctgcatctcttgccgactgctttaatacatcacagtgacattgtgtgtgtctctgccaccagactattgctccttgatgctctgggtcacctgcatctagcatggcatatatctagtgctcaataaatgtgtattgtacggaattgactgaacttctctcactggcagccccctctatccaaatcacccacctcttttttaaggtgggtgatgatcttgtgtggtactgaggtgacctctccatgactggtccaaagggcaggcagggttcctgatactgagagaaaagtataccaaccaggaccttagctgcctatccatacgtagttgcaacacattcctgcctatctcctgcttc

SEQ ID NO: 138285 - DNA, 128 bp, Homo sapiens
taggaaaacagggttaaaggacaggggcaaattgaccagagctttctatgatccaactcaggacctccttggagcctgactgtgggctcacactaccattcctcaggggggtgctgtccaatagcata

SEQ ID NO: 138286 - DNA, 533 bp, Homo sapiens
ccgttctatggtcatagctgattcttgaggataaaattcctctcatcgaacctgtaactatgctcacagctttgttcacccaccctcagggggtgaggtcttgcccatgacaggccctgtgtggatagggactctgggcactaagggtgagcgctgagcccttgctgcgtttcctgagccgagtcactgtgtaaccgtgggtgtgcaccaggaccagcgagtgaagggccaaggtgcagacagctttaggagctgcacatctcttggaaatgtggctgtgaccctggctaacgacgaccgtcaccactgatgaaaaggaggagtcctgatgactcttggttggaatctcaggtcccatctgggactttgctgagggggtcccagtaacaacaacgtggcaaaaattgtttggtcagtaggttcctctaagccatgaaccccacacacagctgtgagcacacacacacacatgtgcacgcacacgcatgaacacacacacacagtgcccctgtgtgtgctgcagcatgggccct

SEQ ID NO: 138287 - DNA, 197 bp, Homo sapiens
ggctttcattgtaaagatactgcatcaaaatccaccttaaattctgccctaggaagtgaggaatggttctatctactgcggggccttccctaaagcccagggtggaagagacactgactctgcagacctgggtggggtagcaagcagcacggtcatgtggcgtggaacagacacgtggtaactctggggcacagctg

SEQ ID NO: 138288 - DNA, 403 bp, Homo sapiens
actcctggtctcaagcgattctcccacctcagcctctcaaagtgctggaattacagacttgagctactatgcccagccaccattttggtttttgacaactagatcatttagtattttcagacatggatctgaatgtggctttgggacatttccaaaaatccagtttgctctagaagcccagagaatactctagagactgtagaacaagttttgaaatttgtttgcaaattatcagcctcccaaagtgctgggattacaggcgtgagccaccgtgcccagcccacattttatacatctttattatgttaaatctttttagtttttttattataattttattgacaccaaaataggtaatgtgtctttattacaacatatttcagtaaatggtagtaaaatgttc

SEQ ID NO: 138289 - DNA, 331 bp, Homo sapiens
caacatcacagcacagtgatggttatctttgtagagaaatcttgaacacattttaaatttccgtgggataatgagaaaccatggttaaagtttatttacgttacagaaataaaaagctttcaatgcatcgtcacaaattgttctccactcttaccagcgattaagagtgcctgtttatccaagaccgttggccatattgaatgttaagaattcttttttacatttgataagcaagacatggtctcttcttgtttgaatttgcatattttaaaagtcctttgtgatggcataagaatgatgcagtggactttggcgatgcagggggaaaggt

SEQ ID NO: 138290 - DNA, 1186 bp, Homo sapiens
cacacacacacacacacaccggcgtactggaacctctctcgcgatcccgcacccagcttgaattcagcaagaatcgaaaacaggtgtgcccccgtgtccaacaaccgtcgtatctacagcgatccttagagaacaattaaggccagttgacagtaaagaacaatcagtgtgtatttgaagtccatgctgagagagcatcaatcttctggcagctgcaagactgacctatcaaccgaggcatttcttcattccctgccattgtctcctcctcttgagatcgccatcaggcacagtcacttttctacaaacaggcaataggactcccgctgccaccctgcccagattttagtcctctactgctgataaagtgagcaaagatacgtggcacttcctgaacccaaatactcttctgagctgattctaaatccacacagaatcaacctacctcctattacctccttccaagctctgtgtcccattctctcatttcagtctcagctccagacatcagtgaattcaatgtgatacatcaggggacatcacaggacttccctacttgaaaatcaagcaatcgtgtccctgaaacactctgtctttattcatgctcagttaccgtaaagtagatgcaactctaagaacctatggatttttttattgccactaatagatcatgatttacagcaaaattttaaaaggtccaattttactcacaaaagaagaagaaaacattcagcaagaagcatttcttttgctttatctttcccagttaaatatgactttaaaaaagacaaaattttaaaaggtccaattttactcacataggaaacaagaagaaaacattcagcaagaagcatttcttttgctttatctttcccagttaaatatgactttgaaaaagaagagcacacctcattagccgtaattgtctgattaatacaaagaaatggactcatatcacggggttctactacccctatggtagtgtttactatccttatttcactcaataattacagttactttaaccagaatgcctgccttgtttggcattttgggagaggaagcatatgactgtaaaccctcttcaaactttcagacttacgtttgcttcttctaagtccatcgactttatacataaatgacttctttttaaaaataaataaataaataaataaataaatgattt

SEQ ID NO: 138291 - DNA, 182 bp, Homo sapiens
agataacctcagggacaggttaacctttcataattatcagaaagctatctataagaagcattttgctgtattcctctatagactacttttgtggaatcatgatttaaccttaggttggcttcaccgtgaattaaatatttaaaaatattttatatgtaaaagatccatatgcagatctttgc

SEQ ID NO: 138292 - DNA, 413 bp, Homo sapiens
cactcttgacctatgaccttgtttccttttcactgagaaacagagaaaaaattagatgagaatgtgtacaagctctcaccacaagatcttcctacctcctctaactgcacctatatactattactatcaaagatccctctgtgtccctaacaaaggctatttcctctccttttgcactaaattccatatactcatgcctatggggagacattgttccagtaattatctcctttcctctgcttgggtcagcctctaggatggacccccatgatccccacctcctggtatccgcgccatgatgcaatctgcttacagcctaaatcaggatgaaccatatgactcatagaacactgcagaaggcatgatgtgtgacttcagatgtgaagtcatagaggacaaggacacagccacct

SEQ ID NO: 138293 - DNA, 269 bp, Homo sapiens
tctcctgaatgtgctcagaaccaaacaaattattcccaatgcagtgcggtcagcgcagagtacagtgactattaatatttctactgaggaagcacacggctacattcattcttttttagccaccacttcctactgttggttcacattaagcctttagtcacatgaactgctgccaagctcagttgttccccatcctgtaattgcgcaattgccttttgaatctaaaagcagaaatgtacacttattccttgctcaacttcatcatgttg

SEQ ID NO: 138294 - DNA, 522 bp, Homo sapiens
gctgaggacactaaggcctcctggtagcaaaatccaaccaccacttcctggtccttgatctcccacggcctctcaccagcatcctccttggcttaccacattccctcctgcctcgttctctactcgggggcacacctctggccatgagctcctccaattatctggctaggctcttgctctaactcacaagtactgatgtatgatcttttgccctcttcatcaaagctgcttggcttgctacctacaggctgagaactcccaaacgtgtatctttctcctgagcatcagacccacacgtcctgagcacaccacacacgtcagtcatctgagctctttaccttcctggaaactgctcctcctgagcctggggaatgatgctgttgcccatccaggctcctgggtcagaaactcacctgagggttaccctgctgtccccactgccagttagtcaagtccaagccattccacatttttttttttgagacagggtcttgctctgttggccaggctggagtgcagtgg

SEQ ID NO: 138295 - DNA, 268 bp, Homo sapiens
agcaggaggaattatttgtggagggtctttttgttatttgtggaaagattcctgttgccaccggaaaaccaggtatgaaagtatcaattaggtaagaaaccagtgttaatttcaaggaaccatctaagaaaaacaaatgcctgattttaagatgatttggtattttattatagaagccttgggatggtaacagaggcaaaggtatacagaattgccttattttagcagtgggttcactttgtgagttaaatctatgagtcccactgga

SEQ ID NO: 138296 - DNA, 115 bp, Homo sapiens
tagaggcaacagggagtgagattggagccacattgctaggacttttgatggattctattaaggagtgagggaaaaggaggaatccaggatggctgctgagtttctggcttgtgca

SEQ ID NO: 138297 - DNA, 420 bp, Homo sapiens
gatcctcctgcatcagcctctcaaagtgctgggatttaagatgtgagccatcatgcccagcctcaagccttttaataaacatatcttagtgccttagaggaacctgaaatctatcgaattgataaagatggcaatgagctgactcatctgaactgatcgtgcagaatctcttaagaaaataagtgcctaatcttaacgttgtccgtgtacaggggctcacagaattgtgccttcatcttttctttctacagtgctatacgcaaaaaattaaaacacaagtaccagtgacatcatgttatgtaacctccataattaaaatctagaggttagggttagaaccctcacttgaatctgcagttagtattaaaaactaactaaatacaatctatgattaaaatactaattgcagatccaagtaag

SEQ ID NO: 138298 - DNA, 603 bp, Homo sapiens
tctgttggttctcctcggcctggcatcccttaatcctacttacctctcctttcttccttctccatttcaaccatgggactccagggaggttaccaatcacattattccctccctttggctacgtggccataaactgggcccatcaatttatttctccataaaacttgaaactccaatgaaagcctcttgaagtctcatagatgtgccctgagagcaggcccagggtcacctgctggtaaggacctggagcttcccagtttcctgtccttccaaaggtcatgatctctatctcttccctcagttctggaactactcaagaatcctttttccaataaaccccttcttcccttagtcagagtcagtttctattgtgtgttagtcagagaactaatataatcccaattctctttttttctgccaccatcaatgagcaaaatgggaaatttttaaattatttaattgcattatacttattcatattttatttattacattttgtaaataagattttcgtggccgggtgccatggctcatgcctgtaatcccagcactttgggaggctgaggtgggcggatcatctgaggtcaggagttcgagatcagc

SEQ ID NO: 138299 - DNA, 290 bp, Homo sapiens
gttctatggagcattaagattcttctctcccctgcattgctattcctcccaagtataaccctttctgacacacccatcctctgagctggcattttattccttcagtgtcatgcaattctccaggtcacaaaggctcagtaaatgttgagtgagcttcccctgatcagtctatctgattttctcatgtatctgaggctatgcctattagagccatcctattagaagcaccagaattatctttttgtggctgtagttggcaactcttggccactatgcatagaaaatatctg

SEQ ID NO: 138300 - DNA, 519 bp, Homo sapiens
agcatttccaggataaaccccacctactcatagtttgttgttctttttctacattactgtattttattttctaatattttgttgaggatctttgtttctatgtacataaagggattttggtgtgtagttttctttttttggtaatgtctttatctggtttgacattcgagtaattccgtcctcataaaatgaattgggagtattttctgctcttctgttttctggaagaaattgtagaatttgttatttctttaaatgtttggtagaattcacctgtttagttatttgggcttggatatttctttttcataatttttttttaaactatagactttatgtaatagttatagcaatatacaggttactgtttaatcttgagtgagtttcagtagttattaagtgtttactaaaaaggtgtatttaaaagaccaggctgtgctatagaataactttatgaccttgggaaaggtactttagccttaacctctctgtccttaatttgttaatctgaaaaatcaa

SEQ ID NO: 138301 - DNA, 244 bp, Homo sapiens
tctgcagtgtcctgttggtcatacaggttagcttattcggtgcaggaatgcaagggcacaaataccaggaggcaaggttcactgggcgctgttttggagcttgattgccacagagaaatagggaagagagtggtagacaaacacagacacacagacctttatgaacaggagaggggagaagactgggtagttgagtcaagtccagggtgagggtgatcatgttctccagaagtgcgcctgggtg

SEQ ID NO: 138302 - DNA, 236 bp, Homo sapiens
actgggcagtactctggccaaactatggagagagtttttctgactggtgctctgagaagagggcttcataaacccaccccactgaggccagggctttttacctgtagtccagaggatctgtggacccccagaagttagataaaatcctatgtaaatgtgcatttgtttttccccatccggggattggttttcattagatgtgacaggagatggtaattccaaatagttaaaaccat

SEQ ID NO: 138303 - DNA, 321 bp, Homo sapiens
acagagcgagactccatctccaaacaaaacaaaaacaaaaacaacaacaaaaaacaagttgagtgaagaaggggtggttttctacacttggagtaaactgagtgctgaaaaaataagcagttgcaggaaacaaggcaatgaatgggggttgaagggcgctgggagcaggggtttggaaccctgagctgacagcagtgatggtggctggcagcactgacttaaactggatggcagggactgactcaggaatctttgacaaacctacttctctgtcaggaatctagaggaaagtggcccactggggtagggacaatactggag

SEQ ID NO: 138304 - DNA, 581 bp, Homo sapiens
ggtaccgcagggacgaagcattccagtagcacttactgcagttgaccactcagtacaaattccttaatacatggacgaacagccatcatgaacactagattgtgtttcctggttcgtggaatgcagcttttccttagcaatttgatgttgtctctaggaatataaactctcaattctcctaaatataagcacttctgcaaacacagctccccagaattaattccagaattgtgcactttcaaagcaacagctgaatagtaaaccaagattcttagagatttaaagtgacatgacatcatgagcatgtttattattttggcacaggtaacagctaaaaaatgaaatgagattccataaaaggataccaataaaaggggggaaagagaacgaaaaaatccacaaaaatagctctaaaactctatagtcttttgttatatgcttactcatactttttctcccctgacctcctcttttgaaccttaaattcccttttgtgtcttttaaattctacctactcttccaggcccaattcaatcttactacttatggagaacttaagcacaaataaaatgtcatttagg

SEQ ID NO: 138305 - DNA, 649 bp, Homo sapiens
ctaaattgctgggattacagacgtgagccaccatacccggcctggtgtctttttttaagaacatcagtcactggatttgggcccaccctaatcctaatagtatgacttcatcttaatttaaccaattatatctgtagagaccctgtttccaaataaggtcacattcacagattccaggtggacaagaagtttaggcggacactattcaactcagtacagacccaggaacaaagtccacccactgggctgtgttgagtggcagtcactagtttatcctccctcaacaagatgagctccaggttgacctctgcatccccagtgctcagtcaggacccagcagagcatctgaagggatctggtcaatatgtgtggaactgaactgtttctgaaaagctctgacgtatgttttggaaaatcaaatcttgttttaatccagacaccaatctttttgtaaggcaaacaagtagcataaatgtttaaaagtcaatttgcatgtttatatactgtcattccttaaagttgaagcatgcctttctttattcatcggtggaatcctttctcattttggcaaagaaaatgcccaagtgcctggcacaaacaagcactgagtaaatacttcttgaatgaataaaactagattctaaaaatc

SEQ ID NO: 138306 - DNA, 432 bp, Homo sapiens
atctagacgtacacagtaaacatttataaaaaattttttccaccaaatacaattatgcccaacattatctttaaagtataaaaatatgtgtctggatgtatattgtaatacatgctcttgttcactctttaaaaagttaacaagattataaatctagcataaagtgaaatttgattatacttattacaataattacataataatgcaataatatgcaatttttttggaaaaaatgtttcaagaacatgtatgaaaaggctattatagtgctatgcgcataaaaagctatgatttataatcatatatatctggaaatagttgtcttttgtttgtttgtttatcttgttgaatgaaagaatcagtagtattagggaaacttttgtccattatccatgaagcttatctttgttgctaaaacacatgaagaaacaa

SEQ ID NO: 138307 - DNA, 261 bp, Homo sapiens
catttaccttctgaagtctttaatgaaagctctgtcatcattcctgttttattgatgaggaaactatgctgtcagagttgagtatttataagtagagctgctgaaaattgtgatttctatttttatattgttaaaaaatgtttagaatgtttaattacttagtaatatagaatatgagctttaattttatttccatataatatccaatcatttaaaaaattctgccaatgaaaataaattaattgagccctttatttattt

SEQ ID NO: 138308 - DNA, 308 bp, Homo sapiens
tgcataattctttggtgctgaagactgtactgtgcattgtaggacatttagcagcagcaggccagggactgaagtgaggccaggaagatgctagggcacagaatttaaggaatgactcactctcagggtcctgcaagtgtaggcttggcatgtgcgtgattctgaatgtgccctcctaaaatccctcatcctagtccagatactgtttagcagcatccttggcctctacctattagatgccagtggcaacctctcatcatccccctctgcaatttttgacaattgcctccagacattgccagatgtcc

SEQ ID NO: 138309 - DNA, 346 bp, Homo sapiens
ctagcttgagagtaactaagcccagttgtaattatactgctggaaagagaaattaattaaacatccctgtgataaagacccagcagcaaacctagaataaacacataattggtgaagaagaggggcttgaaataaaggagaagagaaaggaaaggcgaatgtttagcccatctgttcagatagtaatgaacgaggtaatcttttcaagagtacatggagtgcattacagtggaaatcagactacctggcgggcaaagtcagccaagtttctaattctcttcttcaaatcaaattgtgatttgctaatgtgaaacacatgtctcaagttcaaataactctggaattc

SEQ ID NO: 138310 - DNA, 150 bp, Homo sapiens
ggacctctctcacctgctgtctggcctacaaattatttttgagatttgtccctggaatgtgacagtgttcacggtttctctagacctacccaggtataaaaaccccttgatccctgccatctaagatggatgctacccctgctccgtaag

SEQ ID NO: 138311 - DNA, 443 bp, Homo sapiens
ggagcacatggtgctgcctcccacttctaaatgtatcacatccttccttcttgcctcctccattcattcatgattcatccacttggcagacattggttccatgtgtccactgggctggacactgtgtttgtaaaagtggcaggggcgaggggccagaagtgaagggcgaataaaaaggagcaaggatgcatctgagactgaagtagaggatgggagaatctggagtgcagttttagacctttggggtttgaggtagctgcaggagctctaggcagataatgatgtaggtctggagccaaggagaaaaactgagactttgcaaacacaggtttgtgacccaaagcaggtcacaaattgctggccagagtcccaggactaaatgtaatcacacaggtgaggcatctgggggaaaagaaaagcagcaggggagtgagggagtgagg

SEQ ID NO: 138312 - DNA, 190 bp, Homo sapiens
gacctcgtgatccgcccgcctcggcctcccaaagtgctgggattacaggcgtgagccaccgtgcccagccgccaataacactttttaaactcctgtgcatcatctgtgtaatgctatctttcttgcagcataacagacgtatttttattgatcgtaatatataatatcaactcttttttttttttttttt

SEQ ID NO: 138313 - DNA, 477 bp, Homo sapiens
acacatagattaccctcagagtttagcacatatgggctgtagaactgaaacacattgtcctaagtcattgttgattccacagaatttcagccaacaacagaaacactcttaataaaaacaaattatcaacttctagacaatcaaaatcaccaagacatagtgaaaagacatggcatattattgcttggtgaaatcctggttggtgatttttgaaagccctgataccataatgtaacccttctctcttggttctttctttctttatgtgctcaggtaatgagcacatctaggcaattgcacacacacacacacacacacacacacacacacacacacacactcctcaggaatcacatgacttcaaagaacttttctttataaaagattgaagattcctgagttataggttgctggtgtaaaagtcataatataacatctgattgttgacactatgcagtggggggaacagtacatttt

SEQ ID NO: 138314 - DNA, 350 bp, Homo sapiens
ctcactgttgcttgtgcttgccaaaagcagacataaagcattggctgccctacctgtaacttctgctaaaaacagaacacaaaattatcatgggagccttcaacagctagaacaccatctaaacaaagtaaaaagtgattggattctttatggctccctcaaagatttttcaactccctgtagtccagttccaaaaaaaggaatgatggttttcttggagagccaacagttccctttgtaagtttctggaatttttgtacatgatattttgagttcttctacaataaaatttaatggtccatttgagaaagtgtactcatattaaatgtagtgtctattattgggtagtc

SEQ ID NO: 138315 - DNA, 701 bp, Homo sapiens
tgagataggggcccctattattaaccccgtttcacagatggggtaactgaggcctcaagtagacagggtcagtcggtgacagagccagtcatcgaatcaggatgggctcacttcaaatcctgtgctctcaaaccttttccagccccatcaccagtcccagcccaaagtctcttgtgtggccttgtcacattgcttcacctcagcgggcctaaggtagggacaataaaggcccattgggactgggggaaggggtgataagataaaaaataggagagcactgtcaaggcagaagggacagggctggccaaggaaagggggataggaggggaccggaggctgcagccatacaggacacagtttgtcccttggtttcaccagtgtcactttctcgtctctgctgctcagactcctgggctgggctggggctggctgcagggagccccccttgcagtagcgtttctcaggctggccctttaccaaggaccacagtgtccatgctgtcttggatccctaggctggcacagaaacaggggacccaggtggccctgagcactcctcagagcaaaggtgctctggaagcagactggacagagtgggcatggaatggggccaggagggtctgttaggaaggttcagccaccctgtgaagctggcacagataacagcactgctctgttgtccctcggagcctctgagtaacc

SEQ ID NO: 138316 - DNA, 719 bp, Homo sapiens
attgaagaaaaatttcagtgctactatcataactggtgtattactattgttaacaattgctacagcctatttgtgtgaatttttaggatttcaactttgactggattctaaaaagaaaaaaactaggttgaacaatgtatcagatgtacttattgcctcaggtagtccacagaatgaatttataaatgctttagcatatctgtccactacataaaaatcatgtctacatttctgttttgtgttattttggattttcataatctatataaatatcaataaaataatatgtgatattagctttgctctgcttttattttacattggtagcaatggtaaatattattttgtgaaacgtttgaggggtatgtgtatgtatgtgtgtgtgtgtttgtcctgggttgaatgtaaaattatttctgactggggactagggtaaaagaaaattttgaagccaggcgtgagtcactgcacccagccaggattctaacaatttcaaaggatttttatatgtaattgtcaacatgcaaattattatgttaaattcaagtgttaagtctacatattaatgtagcccatttatttactcttagactctctccctagaaatgtatcgttagtgttcattcatctgcttgttctttcttttaatgactttttttgagcatctattttgtgctgagtgctgtgcttgtgcttgagatattacagtgaacaacact

SEQ ID NO: 138317 - DNA, 420 bp, Homo sapiens
cctgtggtagagagggggaactgttgacttcatgtgaaatccttggatccagctggacctaagactactctttggaacttcatgttttatgaaacaataagtttcttcctttagttgagagagtttgagttagctttttgtcagttctatttagtgttattattaatgcagcttccaacctttctgatccaaggttcactactgcaatatccccataattggtctcttgccccccatacccacccttctatcttttctcttctctagagtcaggtaatttttcataaatataactatttatgtcatccttctgcccaaaactctaaatggctttctgttgctttttgatgaaaaccaaggttccaacatagtatatactctctataactgggctttgttcactttttcaggcttaacctt

SEQ ID NO: 138318 - DNA, 390 bp, Homo sapiens
atgtgtttccttggcttcctgttcagttttccttaggcctcagctgctgctattgctgctggctgctctccacattctcctaaattccagatgggtgtgaggaggtaagggcgggaagaaatagtggattgtggattgaggtgcgatttcccaccactggaggggacagattcataagctggcattgaagaggttcctgccctttgcacagtgtgtttggtcaccccagtgctcaggctgaaccctgagaagaaagaggaacttgactgtctgaaggctcttgggtggtgtttaagacccctggccactgtgtcctggctgaatgcatacatgcagatggaatctctttctttctttttttttttgagacggagtctcgctctgtctcca

SEQ ID NO: 138319 - DNA, 441 bp, Homo sapiens
gaaatcagttctttccttcatccttctaagagattcactcataggttcactaagcacctgctggcatcaggtgccatgctagggacaggaatgtctgcgacatgattcctaccttcaagaagcttgtagactattgaaacaaacaaacattgatacaatgtgtaacagcatatgaagcacaagttctatcacttttaatcctcattacaactcgccatttcctccacttttcagatgtggaaactctttgaccacaaccttcaattcttgctcaaccattcccactatgcctcagcccctcgctcaggactgccagtcctctgcctcctctgcttggtttgcaggcatcagctccttccattttcacttccctttctgtccatcttacatcctatagtccactgtttttgtcacttttgttgatactataaagtcccttgc

SEQ ID NO: 138320 - DNA, 1214 bp, Homo sapiens
gtgaggagtaattctatcttctcaatcctagagacagtggcttcaagaccactgaaacattttgtatttgtccttgggtaagggataatcattagactgtgtatgactcacggtagaggaatttcaaggcaaaagctgactaacaacagagcctgatgtaacaaagtagagagtcacatcctggaagtcaccacactggcttctgataaacggtcagatatacatgaatcctgtggaccatgtgtggagccagtttaaatcctactcaagagaactgcctggatgcatagtggggctcttcatgtggaaaagaacactggaaaacaaaaggataatgagagagtggtggctatagaaatagaatacatcacctcacttcaggaagttgccactgcctttggaaagcgcccccagggaagcctctgatggagccatacaaatgctcatgagataattcttaacatcagccaggcctagacagcatgaagccactaataacccttcctcttcattctgccccattcctagaaatatcagtgtagcaaaaggagagaagccaactaccccctctttcacagaggcgagctggctggctctgttgaccctagctgtggggtagagagattcttacctatgatgaaaattgatgtgttaatatatttcggaccaagagtatgttttgctacttaaagtggttgcaaagactattacctaaaggtgatccacatctgaggaaaacctctcccactgaaataaattgtgcagagacaggggaaaacaaattaaactttaattttcattacatttcttcagttggtacttgttaagcattccagttatggtcacctttgtattctctgaggcacttaattggcactcatgatattgagattattccttccagattgtagtatgtaaccttctggttaatatcctctctataataaaacaaaagacagttttagggacttaaatttcaataaatctggttgaggccaaggaaccagaaataaattgaaaactcaatttatttcaaggaaacttgaaataaattgaaataaagttagttggaaactaactttaagataatctagttccaggccaggcacgtggcttaccctgtaatcccatcactttggcaggctgaggcaagcggatctcttgagcttaggagttagagaccagcctgggtaacacagcagaaccctgtctct

SEQ ID NO: 138321 - DNA, 205 bp, Homo sapiens
cacccggcctcattttgctgatttctcttgagctcaggtaatatttcaccaaaaggctggcatatatttagccaaaaaagggatattgtttgaaataagaatattgtgaataaagttattctgtcaatagaataacattattacttcatacaagtcttacctgtagttgtacatcaaatgctactttttattaaaaatagtattt

SEQ ID NO: 138322 - DNA, 384 bp, Homo sapiens
tttctggcttctggcctctagaactgtgaaagattaaatttctgttgcttgaagccccccagtttgtgttactttgttacagcagctctaggaaattaacacacccaaccccaattacttcttaaagaatttaaaaaggttcttaaaatgacaattttattttgagatagggtctcgccctgtcacccaggctggagtacagtggtgccaccatggttcactgtagcctccacctcccagactcaagtgatcctcttgcctcagcaccctaagtagttggattacaagtgcatgccaccgtacctggctaatttctgtattttttgcagagacaaggtttcaccactttgcccagtctggtcctggacttgagtgatctgcctg

SEQ ID NO: 138323 - DNA, 500 bp, Homo sapiens
taatagctgtctgtttccagcaagctgtttttttccagcgctgagttcacaaaggggctttgttcttttttccttgactgaacagaccaatttaaaaaataaaacagaataaacacctagcgacactgaactctcacccttgctgtggatatatttaggatttttttcttttttttacttctttctcttcctttccattaccttctgggagttaaacctcttgttagcttccatttttattgatacaaagagtagttccaaacctctctgctgccttgacctgtcacccccaaggcctctaattttatatttctaattgcttgtaatacatgtcttgtgattccctaaaagtttacatcttgatagttctctctcatcttagtcattaaggccacttcctaaaatggcctcccagcactgaaacgtgcatgtttctctcaacagtttttttatttcatttgttccaacttatatccattcattctgtttagtgtttatga

SEQ ID NO: 138324 - DNA, 264 bp, Homo sapiens
ttatttccttgaaggtagtctttatttaggagactaaagtttattaaaaaaaagaaaaaaattaaaaacaatgaaaacctaagatctaaaccttgctccaccacaacattgtgggataaacttcatttatgttataccaaactatattaaaaagagtattctatataaagtcatatatacactgtaatgtataacctacaaaagatattcaacaaaaactacttgactgattgctttaaagaaggaaaaaaatatatatatatt

SEQ ID NO: 138325 - DNA, 255 bp, Homo sapiens
gccatgaggggaacagattagtacaggaagtgatacaacaggaacagggcccaggagagactgtgttctggctagaaaattccagaagccaggctgggcgtggtggctcacgcctgtaaccccagcactttgggaggccgaggtgggcaggtcatttgaggtcaggaattcgagaccagcctgaccaacatggtgaaacctcgtctctactaaaatacaaaaattagccgggcatggtggtaggcgcctgtaatc

SEQ ID NO: 138326 - DNA, 325 bp, Homo sapiens
ttaatttttattagggggaggggacagcacacttctacttaatgaagagaaacatttttacagtccagaggtcttttatgtttttgcacctattatgcttgaattcataggggataggttccagcagcccagactcctttccattggttctcacaaagtacacttctctgggtggagcagcctggcacttgagttgaacccaggtacctctctttttggcttcctttttctgatcattttccctcatgcgtttcaggaagctatcttggctcttagagtgcttaatgtactcaatccgcacattaattctcttggcaagaatctt

SEQ ID NO: 138327 - DNA, 458 bp, Homo sapiens
cgacttttccacaggaagtatgtgaaagttcaaatataggacaggtgccgtggctcacgcctgtaatcccaaagctttaggagactgaggcaggagggttactcgaggtcagaagtttgagatcagcctacgcaacatagtgagagctcatctctacaaaaaaataaaattttaattagccaggtatggtggtgcatgcctatagtttcagccactggggaggctgaggtgggaggattgcttgagctgaggagttcaagtccagcctgggtaacagtgagaccctgtctcaaaaatataaaagttaaaaaataaataaataagagagttttttgtttttttagtttttaaataggtcctatagcttttgaggatttgagatttctactaggttaaaatttattttaaaatatacgtgacaagatttcgaaagtacaaaaagataactcagtggaaga

SEQ ID NO: 138328 - DNA, 313 bp, Homo sapiens
ctttttcatagttgaagaaatgtattggaagaaggaacagagaaaccatttctttttcatagttgaagaaatgtattggaagaaggaacagagaaaccatttacaaaagaaaagaaaaaccatttacacagattatctctaatggataaagggaactttatcatacacacacacatacatacatatatgagcatgtatattctaataagcaaactgcagatgacaaattctaagtgcagaattatttaatacctcaaatcttccagtcctatcatcttctcatgtaactgccatgttctgcctatgcgttcat

SEQ ID NO: 138329 - DNA, 535 bp, Homo sapiens
  misc_feature (21)..(21): n is a, c, g, or t
tagggtttttgttttgtttgnttttgtttttttgagacaaggtctggctctatcgtgcagtggcatgatctcggctcaccacaacctccgcctcccgggttcaagtgattctcctgcctcagcctcccgagtagctgggactatagccatgggccaccatgcccagctaatttttgtatttttagtagagacggggtttcaccatgttggccaggatggtctcgatctcctgacctcatgatccgcctgcctcggcctcccaaagtgctgggattacaggtgtgagccaccgcgccttgcctggggctgttttataaggacactaatcccattcatgaaggctctgcccttatggcataatcacttcccacaagacaccaactcctagtaccatcactttggaggttaggacttcaacatatgacttttgaggggacgcagattcagaccatagcaatgaagaataggtttgtgacaaagtctttccaagccacagaaggctcttattgctgtaataataaactaaagggagaca

SEQ ID NO: 138330 - DNA, 259 bp, Homo sapiens
gccggcccagatttctatgggtgtatgtttgtgtacaagtcagtgtagagtctgggatctctggtaattatatattgttttttaagttgaatgaatataattatatctcaagggccaactctggacagtgtggagcatgtgatgtggaataaagcttatgactaatcccgttctaccctactggtgtccttatagagaaagtaggatctaggcgcttctaacttgggttaacttgggttaagttcatagaaaatatctg

SEQ ID NO: 138331 - DNA, 225 bp, Homo sapiens
atatgactctcctctcctacctgggccatgcccacagatgaaaaagtgacttatccctgggcccagcacacagggaatcttatttatttctcctagtctctttctacaggggacattgcgaagtatctcttagcccatcaattaattgatgcaaatctcttctcttacctgggatttgcccaaaggggatgttgtaacatatctcatggtccagcaagtaggaga

SEQ ID NO: 138332 - DNA, 389 bp, Homo sapiens
tgaaatggctttgcatttgcgcatctttgtggttgtgatctccaggggtgtttgggggccgatggaagggggcatcaaagtcctgtggtgtagtgatgtttcaggaagctatttcagcactgcagacctgagagctggctggttacatgacgcctggctcccagatgctgcccgggaactggagtttccttcctgcctttccttttcccagggcaaggaacagacctagtgctacaagccccccagttccatgtcaggcattagatttcattctcatacgccaccccacaaggcaggcatcatcagcatgttttataaatgggcacgcaggctcagacagatggtgaagacgcttgccgggcaacacagctaaggaggagcatgaatcc

SEQ ID NO: 138333 - DNA, 387 bp, Homo sapiens
gtttagtccaggctgggtgacagcgagcccttgtcacttaaagccaacctaagagaagagcttatccttttggaaaaacaatagaagacaattctgaaaaccaaattctgaacataggctagtatagcaagcaagcagggatagcatagagccatttgctcaacttccagaaagagttactctgttcatctctaaaaaatcttgaaaagggccgggtgcggtggtggctcacgcctgtaatcccaacactttgggaggccgaggcaggtggatcacctgaggtcaggagttcgagaccagcttgaccgacaaggtgaaactccgtctctactaaaaatacaatcaaccgggcgtggtggcaggcgcctatagtcccagctacttggg

SEQ ID NO: 138334 - DNA, 286 bp, Homo sapiens
ctgatagcctcgggcctggtagtatcaggaggacaaggaagccatttaaactgaaggtctacctagcaagggtatatgagcctgaatatgaacaacaggaggttattcatgcaagagaagagggaaaccctgacacaggttttggatcccaagtaggctgaagaaagcctcctctgcgtagaagggcagcttgagcctgagagaggtgagaaggatttcagcataggaagacagttcagcagggagtactacagcataggcagagtgaagatggtatctgcatggg

SEQ ID NO: 138335 - DNA, 330 bp, Homo sapiens
acgcccggttaatttttgtttttgtagagacagtgtcttcccatgttgcccaagctggtctcaaactcctgggctcaagcaatccggccgctacagcctcccaaattgctgaaattacagacgttgagtcacctcacccaacagtatcatctttttcttacacggaaagctcaagataggtctttttgttttttgtttttgagacggagtctcattctgttgcccaggctggattgcagcggcgtgatctcggctcacttgcaacctccgcctcccaagatcaagctattctcctgcctcagcctcctgagtagctgggattacacgcat

SEQ ID NO: 138336 - DNA, 571 bp, Homo sapiens
tgtgataccacctcttgggggcactattcaaactatatcccatgtgctacctggagagcccatgtagcctttccagcaaacaccttaacattgtgttaagacttgcctggccgtcgtacatggtaatgtttctatttctttattttcccagtactgtatgtctgtctttcccataagtgaggtccctccctaccttcatctctgaacttccctaaggcctggcaaatccaggacagtcaagtagattgggatctggatcctcaaaatccaggaccaaattattggaaataatccaattgttcattgacaagggattgtttaaatgaactatggtacctcctcaaagtgtattatcatattgttttttaaaattgtggaattaagaattccaggacatattgtgatattataaaacacaataatagaaccaaaaaaaaaaaggaacattataatttgtatgtggtgtagattagttgtctattcctgcataacaaaccatgtcagaacttcatggcctaaaatgataagcctccccgctcccttctgttagtctaatccgcccacctcagtc

SEQ ID NO: 138337 - DNA, 409 bp, Homo sapiens
atttattctgtagaatgcccgcattatggattgggcttattgaatcatgtaacctgttcctggtattttctgtaaactggtggttagatctggagccttgattaggctcagggtcagttctctgggcaagaagcattcctgggtactgctgtgtgctttgtattgtgtcacattgagaggtacagaacaactggctttcttctctttgagatgctcagatggatcactgcgttcaggcaggcagatggatcactgcgttcaggcaggcagatggatcactgcattcaggcaggggcagcctggtctatctgttaggaagtttcctgtcgttgctgattattgtctagagccaggatttcatcagtggatgcacaaagaggatttttctaattctcttagtctttctgca

SEQ ID NO: 138338 - DNA, 600 bp, Homo sapiens
tccatcaatcagtcgagtgaactgctgtgtgatgaattatcttgataggtgatttctatcacctttccattcttaattaacctatcaagatagtctataaagtttatccccaaatatctcccaaatccatccagttttctgatgagtaaatcaagcaatggaattagcttgttctgaatggttactacaactgctcactctatatagttataaatggaccatctttatctaaatactttctgttaaggattctgccacttcatatacctgtcacagaaccctttagagggaaagaaggattctaaaaaagaaggttctgtaaacctaaattttctcaaaaagaggacactttagcttatccagtaaacttggtttatgacaattcaattctttcctgaagggatttttaccattttaatttttatctcttaaaatatgcctagatttagactgtatacagcccaaactcttcagcttccctaattttacttcttctaggactgctatttatactttggctaatataactttctcttgttaatgataggaatctaggaaattcccagtaattatgcaaaaaatgtataactaaagtatttg

SEQ ID NO: 138339 - DNA, 207 bp, Homo sapiens
tttccctgtttcctagtaatgcataactctatctctccataaggcagggtgggccaggcattcagaaagttggggaagctaggcagaatgtgaaataagtgaagggaattgaagggtgctggaaaacctcccatcaaaatttcctcccccatgttattccaccattaggtaattagctccctggttcttaaaggattacatcacttt

SEQ ID NO: 138340 - DNA, 497 bp, Homo sapiens
tgtttatcgatgccacctaatatatcaataattcctggaaatcttgatgctttttaaggaacactaggaagttattgatatatttaggtggtgtgtgagctgagaacactattttggaggaaattttatagtgccatatatatgttataaacatatgtgaccataatcacatttgtaggaaaaataacctattaaatgatgtgtgactggctattataaattttccactaaaatagttaattaattgttcgctgatttttttctgttagtgcttggtacagtatatattcttctgatgcttattgtagtataaggtacatttcttgaaaaaaacaaattgaaattactctgcctattctgttcgcaaattaggaaaagataacaattcttttagtagtggaatattttggtccagttcttgagatgccagtgaaggtcaagaatgtagcttcagaaccagtggaatctgagcttacttggtggatttcttatggaga

SEQ ID NO: 138341 - DNA, 292 bp, Homo sapiens
ttgttttcttatcatgtaggcattagtattgaaaggttaaggccttcatcctcactatgctgctgtggtttctattggttgttggagaaaccccaggctgataatactacttttatgttgattactcattgtaacaactgtggggatggtactttcaatgaataccagttgttaaatagcatcttttgctcattgtggaatggcaggaaccttttggacttcttggtttgaaatcctttgatttggaagatcacttttttacaatctgttatcaacttaattgcctcactcc

SEQ ID NO: 138342 - DNA, 286 bp, Homo sapiens
gccaggcaggggcagaggggcatgagccaggaagctcaggtgtttcctcttcagaccaaaacacagtcttggagagtggtgggcatgggtgggcgctgtttcagcctgtctgtccatttccccttggagtgctagcatcttgatttttttcttttttttttttcccttttttgagatggagtctcgctctgtcgcccaggctggagtgcagtggcgtgatcttggctaactgcaagctctgcctcctgggttcacgccattctcctgcctcagcctccagagtagc

SEQ ID NO: 138343 - DNA, 134 bp, Homo sapiens
aaagaggggactcagagatcctttgtgccattcatgggggctgagctgccaccccagggtggtagaagtgggaagctgagtccaggtgatgaatacagcagcaaatgtttattcctcactcgcctactatacaa

SEQ ID NO: 138344 - DNA, 418 bp, Homo sapiens
tctttcacagtgcacggcagggcctcagcagatatgtgtggaaggaatagttgtctgagacacaaggccagagggtcctgatatgagagtaagaactgctgaactaccctcagctccaccttggatcagcactgcagaaaggccgggatggacacctcctgtccccctaccccaggcacctgtcacctcctcacagagtcacaaaaaggcaggacactgaacttggaggcgtccgtagagtcgatcccactccttcactttcggtaagagaaaaatgaggcctagacagggaacatacaccttaggacacagggcacagacgcagacaacaccagattcccttgattgtaggagatggaggagaagaccctgtcccatccaagctccacctggcacccagcgaggcagttgggcaaga

SEQ ID NO: 138345 - DNA, 262 bp, Homo sapiens
gaccttataatgagtaaggagaagaagtgtagtgctggacattttacaaggatgcctgttatataactaattatctaatattgcgtcgatagcctagtatatgcatctggagcccagggaagagatccagcctggagatataaatttggataaccagaaagctagaattaagttggtaaaatgctaagctcttggcagagttgcattcctccaagcactttatttaactttggaactctgttacctagctgaataatctcaa

SEQ ID NO: 138346 - DNA, 142 bp, Homo sapiens
ttttatttatttttttactgagtgttagggtaatttgttaatggggtatatttggtgacataaaaccttctgtcgattcatggcagtctggaacggagtggaagcgtcccactcctggggaacccccacacacatttggctg

SEQ ID NO: 138347 - DNA, 409 bp, Homo sapiens
ctttttctctagctcctggtccttcctgatacacatagtagatgctcaataaatgtatgctgactgaatgaatgaatatgcaattttcactatagtccatctgaaattaggctcccttggccatccagaccttctagggcttcccacatgcctcccactgtttatttgtgagcattcaaagtccagaggctcttgtcaccattgccctcaacacaagagagttagaaaggtaagacaaggctcaaggtcacaggcatggcttttagaggcaaagaagaaaggttaagagcagaggttctcaaatttcagcaggaactccagtcacctgtgaagactgttaaaaatgtagattccagccaggtgcagtggctcacacctgtaatcccagcactttgggaagctgaggcgg

SEQ ID NO: 138348 - DNA, 161 bp, Homo sapiens
gaaagagaaactgtggataaagggggacaactgtatagctgaggtggctggttttggagccagcagctgctgtgacagcttcctgatgaaggcagacacagcagctcctctgatggtttgccatatggttttgggagtcatttgtggaagtttggtctagg

SEQ ID NO: 138349 - DNA, 343 bp, Homo sapiens
gatttaaggtgctctagaggatctttactggggcttaaccctgaagaagatgcttgtttattttcacttttcaccatgatttaagtttcctgaggcctccccagtcatgctgaactgtgagttaattaaacctctttcctttataaattacctagtcttgggcagttctttatagcagtatgaaaatggactaataacacacgtaagggccatgtgcctatggatcaccagggttttacatttcagagtaagatatgggcaggaggaagagattgtcgaggcatcctgggctaagcacaaagagctgagctaggaaacacccatccataaaagtggacggagg

SEQ ID NO: 138350 - DNA, 359 bp, Homo sapiens
gctgggattacaggcgtgagccactgtgcccggcccctagggaaagaaaattgaccagtggttgcgagggattggaagagagtttgactactgagggcatgagggaatttttttgggtgttctgtgtatcttttatatctgttctatatcttgattgtggtggtggttacatagttatgtgttttttcaaactcaggagagtatatataaattacacctctccaattaaagttctagcatatattaccatattaaaaattattttggaaatatctcagaaaatgttttattttgtttttattttcatgttgtagagacagggtctcactttgtctcccaggctggagtgcagtggtgtg

SEQ ID NO: 138351 - DNA, 366 bp, Homo sapiens
tgggtaatgtgctcagccctctggtctaaagatgaattatctccagcctggagaagatcatcactgacatgttccagcatgatgtatatggcattcatcctcggaaacattaggagagcaggcgcgtttctttctccatcctgtaatgtatcgatagcggatgccagatgtatgtgtaaactcccagacccaggatgaatggatttttccccctgagaaatatctgtatcctgtaaatagaatgttataaacatttgtgggacagaaaaagtctctggccttttcacattgccacactctcgggtgatggatctgatctgctgaagagcaccaagctttttccctttgtgttggacacgtcttgtg

SEQ ID NO: 138352 - DNA, 431 bp, Homo sapiens
gccgtgcccatctcttgggtctcagcttggccctttcctccgggtgttccccctgtcctgccctggtgcctgtctgccacactcagtcaacgcggtccctcttcggttacagggcttgttaacactccattgaaaccggcagacttgactgtcccacccccacccctggagtctgcgcctccagggctgaaatcacatctcaattcttaatgagatgtctgcttccttcactgaagggactttactaagtgtttcattgcaagttttctttaaatagccaggctctcagagccatttcaaatagggttttatgttcctaaattcagttagttctcaacatttgagaccaattcttgcagcaaggtggagaataactctcatctgtgaaagaaaagcggttcaataaagcttgataagccttttgtatccgg

SEQ ID NO: 138353 - DNA, 347 bp, Homo sapiens
aagcgctccttccaaaggctgcctgctcatctgaaaccctcaccccattttagaggcttagattcagctggggaggacccacagcccgagaaggaaaacaaaccaacagattatgcttctaggtggccacagcaggccaagccaagggcagggtggccaaaggtcaagcagcagtcagactgagccaacacgagcctcctgtgacaaagccagagccagagcagggcaattttctaactataaacggaaactcaagaagctccaaaccgcacaaacacacgtgggaagatgagggtaaggcacagaagctacggggtgcacgcacacagaggaaggggcttcatgac

SEQ ID NO: 138354 - DNA, 396 bp, Homo sapiens
agtgcacacaaagggacattcggttctgtctgagtcttcaaaatgtctaccttccatgggaagagtgaaacggatgagaaattctaaaaataccaatagccaaaatgaaagctagaccagaaataaatgtgtgaaaatgcatttccgcatgtcagaggcctgccagatggaacttcgcagaggtaagtgatgaggacgtgctgctgtctcctcaggccgggagtcagtagcccccagcaggtccctggagaaggtgggggccatcagcagcacaggcaggcccatctatcagagcctcgtccttggtctccagcctccctggatctcacccacagctgagtgtcaggactcacaagtctgcgtctccagcccggactcaccctggagccccggacc

SEQ ID NO: 138355 - DNA, 246 bp, Homo sapiens
gccaccaatacagtagtctttaccaaaaataaaaaacaaaatcctcgagtgctaacagcaacaaatccagggcagaaatactgccactgaggttgaagttgggggtaagagggtattgtacgtgaccttgggcacaggtggcctagcatgaaacaaaactacaacccactcatggaactagcaggaggggtgggattttcctacagtgataaattccttgtggactagggagaaacctagagtgaa

SEQ ID NO: 138356 - DNA, 275 bp, Homo sapiens
tatccacattactttgcccacaaggagactaagactcagtgaggttatgtgactttgtcccaagtctggaatttatttctcccacttaggaggtaagggctttttgcatttaatcaaagaaaatatgctggtttaattagctgagtatccttggataagtcatgtaacccccaaacctcaatttcctcatctctttaaagtgtgaataataccacacctaataacattgttgctataaaaattaaagaaaatactatatgtgattactgatcaag

SEQ ID NO: 138357 - DNA, 449 bp, Homo sapiens
tgaggcaacctctgtccctgcaggacaagagaaacctgcagtttggaaaggaagtatagctctgaagtctgaagacttccaattggatgaatgttgaggaatactgagaaatcaaaaccaaaactcggaacttagaggagctatataaatttagaggtgttagtggactttagtgtgtaggcagaatgttttaagcttggcagctgcatggtctttgaatagctgcagtctaggaaagaggcattaagcctcagagcacatggtagtctaaccatagggagggactgcagtttatggtggcctggtctacaggtgagtgagtgaaactgcgtttgcaaaattacgacagtaagagaaattctaacatagctgactccatgttgcttctaacctctgaggtgtccctggtcattcctgggcataggccgagctaactttgggaagaattt

SEQ ID NO: 138358 - DNA, 387 bp, Homo sapiens
gatgttgacgcattggcttttgcacctcggtctaattggatgcaccagtcctcttggtacccagatgtggtgccctaggaacatcttcccgggatgcaccagtgtgccgtggtacccaggtgtggcactccagaaggctgtgccctcacactgcctgcagaatgggtgtttatagtagtaacagagggaggctgctttctgcaggtgtcacagcatcacccattactggaaaagtttacatacagataaatttgtttctgcctcacagtgagaaagaagcctcttctcttctggggctatcaccttccagtgctaggtcctcttcattggagacccctccctgtcacagcacaatgtgggtaataaaatggtttgtgacctgcggga

SEQ ID NO: 138359 - DNA, 227 bp, Homo sapiens
ttcttgccctccgacagacggcctccccccatcggtactcccccatcccggacagctcgtaacgccccagccgctcggcctggcactcctaggcaatgggggtcagagcagaggggcccatctgcagccccagggcgcacttcgcgccacgtggcttctgcaggtggaagtccagcccgcgctgcagccccgcctgggcagtcaggacagcaatctcagcacccacc

SEQ ID NO: 138360 - DNA, 264 bp, Homo sapiens
tgaaatctgacagattttttttttcctctgaaaaatatttcagtcactctagtcccagaaccaccaccagcagaacttagaagccatttatagcctcttacagttgttctgagaagagctgttttagaaaaatccccccatttccccagaaattagctctctcccatccttagccacctggaaaatattcagatcgttacaaagtcagaaagggcccggagctgacagcacaaagtcaatttgacagtttatttctttgtagca

SEQ ID NO: 138361 - DNA, 132 bp, Homo sapiens
ccagcatagagaccaagccgtgttctagaattcaggccacatctgaagccaagcccagctctagaactcaggtcagccctgagaccaagcccagctctagaacccagataagctctgaaaccaatcccagca

SEQ ID NO: 138362 - DNA, 430 bp, Homo sapiens
aggtgaaactagacagtgcactaaggcacttagcaaaacgcgctgccttgagaacccttattacgccttccttccttccacctcaccccctggccagacactctgggggtggagaggggcgctgacccaggccccagacgcccctcccgtccgccctccctagcaggcaggagtcccggctttcccgttccttaaattggataattggagacagaggcgggtgctcgagacggagaaatccccaagtgggcgaaaggcaaggggcctgtcctagtttccctgcactgggggcccccaccctcgccagcgctccctccggtgcgccctgggcgcgcagtctgtgcgctcgggagcccccagcgccggctgtcgaccccctccagagcccggcggtgccagcctccctctgttgcccgccaggcgcggtgtc

SEQ ID NO: 138363 - DNA, 170 bp, Homo sapiens
ggctgtcagctcctctccatcacttcttcccaccttgtggtctcagagggaaaatgaacccaggctatagactgggctggctctgatagatcaggacccacccctccatttgaggtctgcagggctgtcttgactcctctggaaatggacatgactctagaggaaggtgc

SEQ ID NO: 138364 - DNA, 345 bp, Homo sapiens
gctgattggtccataggtggtcataggcaggcctggaaaaagcaccgtctgattggccaaaaggcatcagtgaagttctcactccaggttgcggactccacctggaacggacagctgagcccccaggcttcaggccatccctggcttaaaggtagggtttcactagagacccaccccttcctgcctaggaacctgtctgcctcccactgccatcaacatgccatccatggcacgcaggctatctgcactgaggggcacccacatgcccacgctcagctgccctcaatgcccccagcctccctcccacactcatcactgcccgaagtccagaaagggctgaggcag

SEQ ID NO: 138365 - DNA, 419 bp, Homo sapiens
cacacttcccgtttcacgtgtgcagtcagtggaggtttgcgtgtacgtggatctgtttagccatccccacggctgattctgaagcattttcatcacgtcaaaagaaaccctgccccttttagcagctgcaccctcccccctgcccttggtagccacaggtccctttctggctctggatttgccgtcttgagtcatttcttggcctgcgcggtgtgcctgctgggcctggcttctccctaagccttgggtattcagggctcatctccacatgctgcctgggccagcgcttccttcctagttagggctgaacattccatggtccagacacactacatagtgttatctgctcatcagttcatgggtgttggggtccttctccctttggctgttaggaatcctgccgctaggaacattcatgc

SEQ ID NO: 138366 - DNA, 312 bp, Homo sapiens
aatgagcataattgtgggaggaaaaataagattatccacttaatgagcttaactctgcgcttggcagataataagctcccataagacctttgttgttatattttttcttcttatctctgttgcagcacttttctattatttaaaactttttctatcaagcagtattgtctgttattctttcatatagttttgttcacttatagcatactacgtcaattttcataaacaagattgtatctatatggatacatgtaatagaacatgaatatgtatcaaacactataaaatttaaatttatatataaggatgctt

SEQ ID NO: 138367 - DNA, 546 bp, Homo sapiens
aagtaatctctcaacacaagggcaatatggacagacctttctgtaaggaaggtacgccacagaggacattcatgattagagctttttaggtccaactaaagtctcattgctcacaatcatttgaatttattggttttatagctttgtttcatttaacttgtaaatgttcgggtgttatcggtgtataaaagatacaacacacacataaaaaaattaaaaagacaaaaaacaagaaagagacaagatgaggagtttatacctaattttatctttgcatatatgtgacatactaaaaaggttttaagttaacaatggaggatcctgagtatcttatttgggtataagaaatactgctcagccaggcgtggtggctcacgcctgtaatcccagcagtttgggaggcagacgcaggcagatcacctgaggtcaggagtttgagaccagcctgaccaatatgatgaaaccccatctctactaaaaatacaaaaattagctgggtgtggtggcatgtgcctgtaatcccagctactcgggaggctaagacag

SEQ ID NO: 138368 - DNA, 178 bp, Homo sapiens
agaagaatgaatatataaggaaatccaaaaacatttttaaaagtatgcaaaagaaatggaaccgccagattctgagatgtattgtaatgctacaataagatatagtataatatacaaacatatcaaagacaatagaaggcccccaacagtcctaaacaatatagaggaaataattatt

SEQ ID NO: 138369 - DNA, 219 bp, Homo sapiens
ttgggatttggggggatgttttttggaatcgttatcaaatgttattttagccatttcaggtatattaaaccttctcatgaaaactgcagttactgtctgagcatggtcagtatccatgatttcactcctatgcagatggggccagcactgcgtggccagtcttcctaacgaggcccatagcgagaaatttggctgtccgcaaagctacaccctcaggtt

SEQ ID NO: 138370 - DNA, 253 bp, Homo sapiens
atgattccaaccgatgcctgtcagtttagcagatgagattggaacagctgtatcttcaatacacatcattgtcttaaatagatgctcagaatgaattacaattaaattacagagctgtcaaaaagggttataattatagcatttattcaccatatttacaaggccagacatacacaaaaggaacagaaggctgaagaaaaagaacaaaaaacccactccacattacttacctcagcaggaaatctggttgggg

SEQ ID NO: 138371 - DNA, 488 bp, Homo sapiens
tcatgaactccattgcttcccagtgcattctccctagtttagcaaggatgcctttttctccacaagaaccttttagtgtgtggaaccgcaaactgaacacagtgcttaagaaaggatcaagtggactagggtggatctatctcctcccccattcagtaccttgtatcttcattaaggccacctaacaatatcctgttttgctatgtttgatgctttcattgtcctgctgacatatattcaatttgtaatcaactgaaatccataagccacctatctccccagtctcattgtgtactttttgttgtgtctgtacaaaacttcatgaaaccccattgaatgttatgttgtagcctcagtctgattcctgtttaatggtttccctgaagccctcattcagtcacatactctgccatctctgttgctggcaaatgtgatgggtgtgactaatgcccacatcaaagccaccaatacaatattttcaggggagg

SEQ ID NO: 138372 - DNA, 512 bp, Homo sapiens
actgataagtgccccactggggatgatgcttccctaacacgcgagagttctcccatcaagtttagggagcatggaggaggaaggtgtaaggagggggaagcaggaaaggctttctgaaggaagtgatgtttaagaacacagtgttccccagagatgagaggaaacagggcaaggttgcagaagtgcaacaagtacagtaaggtcaaagtaaagagtgtaaacagacgctgcaatggcaagccagagtaggtcacccaggcctcccagttaataaaaggattaaggagtatatagtatccatggggccatcaaagactcttatgcaggagagtgctgtgttcaagcttgcatggtagaacaatcccacaggtttcagagtagagaatgagccagtaaaaagggtcaggaaggccagatggccaaggcttgggctgaggtggtggcagtggggatggtgactggtaggctgctgtgagaacagaatcaacaggtcttgatcattgttgagaagt

SEQ ID NO: 138373 - DNA, 137 bp, Homo sapiens
cttttggatacctgtgaatgagggcatgcttctttctcatgcagggacctcagcccattgattgcatttatttggttgcctttgtttttgtttttgtttttgagacagtctcgctctgttggccaggctgaagcgca

SEQ ID NO: 138374 - DNA, 425 bp, Homo sapiens
gaaggacaaagcaagtcgtcttcctgaggctggaaaaaaaaagggttgagaaatcttccaagatgagacaaattccctgtgaattcagcccgaatgaggagcagtaactaccagccagataataaggaacaggaagcattctcatgagagaaaacaggaaacttcaattgagaggcttaaaatagcaggggaccttgggtaacaaaaactagttccttagagctggcggaaacctgagagttaggagacactcaaataggaggcagaaagcatgagcagtcagctcagttttgtagtaagcttatctgaactcatgtatgatctccacctcttacagtctgggtgacattgggcaagttaatgttttcatctataaaataagaacaataattactactaagtcactgtaggaactagagatatct

SEQ ID NO: 138375 - DNA, 373 bp, Homo sapiens
aggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcc

SEQ ID NO: 138376 - DNA, 287 bp, Homo sapiens
atccttctgaatattttattctctgtatcttctgcccatttactcaagtgttttatttaaggttttgtttagagataatcagaatttctttcattctgttatccctcaggtacttgaacacagttagcctggctcatcgtacctagatccctaatttgtcaattctgtgggaaaaacatcttgagttactgcaacttttctttatatgacaagttgccaccccatgaatgatacatattgctgcagttgttattgaaacgtagttcctgtaatgcaggatcacagga

SEQ ID NO: 138377 - DNA, 509 bp, Homo sapiens
atctccaacattggggatgacctttcaacatgagatttggaaaggacaaacatccaaaccatatcattttcccctggcccctgaaatctcatgtccttctcatattgcaaaattcagtcatcccttttcaatagtttttcaaagtcttgacgtgttctaatgccaactcaagtgtcccaagtccaaaatctcatctgaagatgagatcctttgacctatgagcctttgtgatcaaaaacaaattatttatttcccagatacaataatggtagaggcattttgtggacattctcattgcaagagggagaagttggccaaaagaaaggggcaaacggccctatgcaaatttgaaacccagcagggcagtcatcgaatcttaaagctctaaaataatctactttgactccatgtcctgcatccagggcacactggtgcaagggctgggctcccaaagccttaggcagctctgcttctgtggctttgcaggttgcagccctcatggctgctct

SEQ ID NO: 138378 - DNA, 207 bp, Homo sapiens
ttccaaattgggtgacgctagaatttctctgaggcaagtccctggtgagtgccaggtaacggaggcgcctcatttttgtgccgaggctcaaggtttcctggctcccaagttttcccagggctgactcggtctcctggggaacggtggcagaaaggatgagaccagagacagtgagtgagccccactgcatagtcaggggaaaggaga

SEQ ID NO: 138379 - DNA, 186 bp, Homo sapiens
gggatttgcttatttctccacaaaagccagtcagactttaattgctactgcctgggacccctacgaggcccaggaaataggccctttattgcttgaacaaagaaaagaggagaggtctctggctggctgcaatcttccccttctaggatgaatgaatctttagagatggagggacttaaagagatg

SEQ ID NO: 138380 - DNA, 368 bp, Homo sapiens
tctggtgatggctccgttaaagtaacctcataactcctacaagtgagaagagaggatgcttggtttcttgacatttaatttgtaccaaaagttctccagggggaactcacaggaaacaggacaagccaatttagcataaaaccctaaaccctttgttagctgaaaattcaaggagtatctctaattaaagcccatctaagagtccttacttatcaagggtggcaaaggaggtcatttcagggaaaagcttccttaaaaaaaaaaaaaaagggggggggtatctattccatcctgctggattttgaaattctatagccagagattagtttaagatcatttatttgggacatgaagttactgtggacctg

SEQ ID NO: 138381 - DNA, 135 bp, Homo sapiens
ctttgaggtctttttcattcttcacctcttttagtcttttttcctttcttctttcttggcgttgcagctgccatattatggcagtggaaatgtttgaatgaataaggaggggatggacatctgagtttccctgtt

SEQ ID NO: 138382 - DNA, 353 bp, Homo sapiens
  misc_feature (81)..(81): n is a, c, g, or t
  misc_feature (140)..(140): n is a, c, g, or t
gtttggctgtcgtgactgcggaaaagctggcggaggaagtgacagtctcaacaggactccagccagagggcgcaagtcaangggagagttaagtaagcagaaaaagtgataagaaataagctaggtgccaatatcaccangggtgttcaaccaaccaatgagacagagcgcttgacatcaagatggcttttccagtccatctataatcaaaaacagccagggaaaggtggggcgggcacgctggctcatgcctgtaatcccagcactttgggaagctgagacaggtggatcacttgaggtcaggagttcaagatcagcctggccaacatggtgaaaccccatctctactaaaa

SEQ ID NO: 138383 - DNA, 516 bp, Homo sapiens
ctctgatgctgactcttgcctctcttttcgcttacatcctagcccttccaatctagccaagcagaattctttttttctttctttcttttgagacagagtcttgctctgtcgcccagactggagtacagtggcgcgatctcggcgcactgcaacctccgcctcccgggttcaagcaattctcctgcctgagcctcccgagtagctgggattacaggcatgcaccaccacacccagctaatttttttatgatcagtagagacggggttttaccacgttggccaggctggtcttgagctcctagtctcaggtgatctgcctgcctcggcctcccaaagtgctgggattacaggcatgagccactgcacccagcctagccaagccgaattccaagtgattcccaacacccacaagctccctcaactggacctttgcacatgccagttgctctaccaggagcaccctcccaccccaccacctccaaacatattcacctggccagagcctcgcattccttag

SEQ ID NO: 138384 - DNA, 528 bp, Homo sapiens
ggtcttgaactcctgacctcaagcaatccacttgcctcggcctcccaaagtgctgggattacaggcaagcccagcctcatagaaacttgttataggttttagtaactggtagaattagctaccttcttgcttttttttttgtagggttttcctatttattcttgtttgtttattcttcccattaaactttctaatcaatttgtctacctccagaaagtaactttaagcttttattgctatttaaactttataagtttatgtaggaaaaactagaatctttatgatactgaattttcccatctaagaacaaggagctacttgggaggctgaagtgggaggatggtctgagccccagaggtacagactgcagtgagctatcatcacaccactatatctagcctgggtgacagagtgagaccctgtctcaaaaaaagaatggtttctagtttgagatagaagtttcattttggcctgcagtaaagggatactcactttaatgtggtattatagagccgctaaatctcggat

SEQ ID NO: 138385 - DNA, 166 bp, Homo sapiens
tatcacgcatgtgatacaggaatgcccatctgaccactgaagatcgcatctattggccaatgcaaagagaagttggcatgatagggttttccatcagggaggtaagtgaggtggggcagggtctggcgctcaggggtctgtggcattgccatgcgtggattgccag

SEQ ID NO: 138386 - DNA, 161 bp, Homo sapiens
ctcgtgaagttagtatgtgacattctggagagtttaacagcatctgtagaggacacaacttcccactccatgtctgccgggctctttcctgtgttttccacccgttttctctccactctgcattctggggactttctttcacctgtcttcctggtcactaa

SEQ ID NO: 138387 - DNA, 345 bp, Homo sapiens
ggagaggctgggagagactgggaaagactgggaaagatggcataggccttgagccaggagtgtgagttcatgaagataggctgggggagtgagagatgcgtggggcaagagggaaggcagcagttcaggggtagcccatggagctgtatctggagcagccacgtgggtcacttctacccacagtggaggtggactcttgtagccagagctgtggacaacctctcagaaccagaagacccttgctgccctgtatgccaaggtctccctccggcctgggtctcagggatgccagctgcaaactgggagggccattgtacagacactaggtggctgaggtaccagtta

SEQ ID NO: 138388 - DNA, 603 bp, Homo sapiens
gtgtcacagtcgacggagactctcacatgtgccgggggtacacatgtgagagggaccagacacgagggggtccccgtcctggcctagggcatggcttctggccaactggggaggaggtgctcagagatgactttgcagaagaggggtttgctccacttggaaagaagggaggagaaggatatgaatgagggagtctcaagtacccttagagcagatacaaaccaaatctgaacatgtgtgaatgctccggaaaaaaacatcaaatgtaagcaaacccctgcagcatgctgcaagaggttaacaaccagctctctggaggaagaagtcctgatgggtcgtgtttgccagtttccctggtgtaaatattcccatggtggctgatttcaagctgtcgttgtgatgtcactcagtgcagagctgaaaggagatgtgcatgaccagcagttaggaaatggttgcctctggctccaacacattaagcccagttatgagtaaatgtgcgtggacatgcacagaacatgtgaaatggctcaacatgcagtattagcagagggtgtgaggagagtcccgtcgaacgggtacgagccataggtggtcaaaaaa

SEQ ID NO: 138389 - DNA, 320 bp, Homo sapiens
caaaggcaggaacttttgtcatttttgttcttcaagatgtccccaatgcctacagcagtaagtgcactgctgggcacacagtaggtattcaataaacattcaatgaatgaatgaatgaatgaatgaatgaatgcattgccaaaccttgcatggctgccttttgttcctgccctagctgctgcctccccagccggcctggctgctcccgagagcagagatgtgccttttcctgtgagccctgccacacagttgaacattgggtagagcccatgggccaggggcagaggcaggaacacactcagggcagcgtgctgcctcct

SEQ ID NO: 138390 - DNA, 585 bp, Homo sapiens
gagttccctggcaagtttgttccttcataaggaccatactttttgctgttgttgacggcttcagcagttaatggagttctttattcttacatttccaatcaccggatataattcagcctcctgaagccccagttttcattctttttcatgttgtaacatatcccttaaggtttctttatttccaagtaaaaatcctggattttttccatggtcctttggtaacactttgatatcctccaagctcagtcatatttggtcacaaatgcgatgctctcccaatcatgactagtggcttgaggtagagccctccttggcaaggtccagatcgctacaggtagacactaaagttttaagacatctccatatctgtgagctgaaagctccctgctgtttccactggagctcgattgtgtttttattgtgttcaggctggtagagggtataacagcattggcagaggagctggctttgagaggatgaggcgtggtgcttatggtggaggctatggaggctatgatgattaccatggctataatgatggctatggatttgggtcagatagatgtggaagagacctcaattact

SEQ ID NO: 138391 - DNA, 264 bp, Homo sapiens
gtctggagattctacacattttccacagaaaataatattcagccagggagtgtatctcttgagaattctctcagtttaaactaacagataattcaactaaaagtagtagcttaagcaaaggacagttacctgggccaaaggctctgtatgcacaagtctgtttgtgcccagtaaagactgcttacaactaacaaaacctccaacttttctcacataataaatctggggctagttcttccaggctggtgtagcctctcagtggta

SEQ ID NO: 138392 - DNA, 247 bp, Homo sapiens
tgttctaaatgtgagaagttattgggtgcttttaagtggaggagagcattgtttggcttacattgtaataggataactctggctgttctctagaatagggagtagagaaaaagtaggaagatgagttagaaggctatcattgggatgtgtaagagatgaaggagagtttagaccagggtgataatgagtgtgttgggaaatagacgaagatagaacagtggattggatgtgatgttggagaaactgg

SEQ ID NO: 138393 - DNA, 311 bp, Homo sapiens
gtaaaagctgcctagaagttggctaggggaagagtgaggtagggaagcgtgagaaaagcatggtgatgccttttctctggcatactgtgccatgtcaaagtggtggaaattaggccagaggaacaggaaggggcgggatcatgaagagccttggagcttgctgcccacctgcactccagcagtgaaagtctgtgtctggtccctgcagaggacaaaaacatgtaatagtgtgctcagctaaagctgctgaggttccctggggttctcagattttcctctagctctgattttcaaccccaagctttgtaaaa

SEQ ID NO: 138394 - DNA, 369 bp, Homo sapiens
tcctccaccaagctgatgtgttccttagcactgatggcaattctcttcagtctggggacaggtatcatctcctttggtttatcagtggacggagcacgggctgcagggttcaacaaagcatccatgtcctcaaagaaggcgcagggttctagcatgtggccatttctcacctttcgatagcttttctggagacttttgaacttggttcgacactgttctggggttctaaggaagccacattctcgcaaccattcagccacagcaccatacacttggctatttcggggacaggcctgaagtgtttcataaaagcgagactctttgagaattgccaggaaagtctttgtttcctcatagctccaatgcaca

SEQ ID NO: 138395 - DNA, 177 bp, Homo sapiens
caaagtgctgggattacaggcatgagccactgtgcctgacgcagccccattttctaccacatcaagtttaaaatcccctgcttggctttaaaagccctgtcatctgccactattccatccacactcccagaccctagttctcctccccacccggaatatgccagcctccttctcagt

SEQ ID NO: 138396 - DNA, 339 bp, Homo sapiens
cgggtgtggtgaagcagtcgctccaacagaaaaatgcagccgaggaaacggctgagaaaggagaaaggagctctgtaaacctgtgtcctatagaagttcctacccgtgaattccctggctgcgttctcaggccaccacttttaaatgctgaaaaggagcatgtttttcttttgggtcacttaaaaaacattttcatggctgggcacggtggctcatgcctgtaatcccagcactttgggaggccaagatgggtggatcacctgaggtcagcagtttgagaccagcgtggccaacatggtgaaatcccgtctctactaaaaatacaaaaaattagccggg

SEQ ID NO: 138397 - DNA, 278 bp, Homo sapiens
gggtgtgtaatggactacgtcacagatgaggaaactccggcacacagagatgaagtgacttgtccggctagtaagaggcaaggtcaggacctcaactgagatctgactccacagtgtgtgctcttattccttggacagcaacactagaacaagatcgggtttggcacctattagccaacagcatcaataagaacaaaaacaagcctcgggggagactgctggccctgccccagggcaggtgctgacgcaggcttggaatgaaggccctttgtgaggtg

SEQ ID NO: 138398 - DNA, 399 bp, Homo sapiens
ttgcccaggctggtctcgaactcctggcctcaagcgatccacctgcctcggcctcccaaagtgctgggattacaggcaagagccaccatgcccagcctgcactgtcattttctgtagctaacttcccccaacactcccacctccacatagcccttaagttaaaggagaacaaggaagccctgtgttcattaccgtgtctctaggggcctagcacagaactttgaacccataaagtgttgagtgaccactcccctgtaatctctactttcttagcatccattagccaacagcctaagcaaaaccaaagtgaatatcagagtagatacaaaaataaaataagctgatctggatattatcctgatgcagatgggtaatggccactaataagatttggggggt

SEQ ID NO: 138399 - DNA, 379 bp, Homo sapiens
gcatttctaagggaaatgaattgttggcagtagattcagatagcaatgatctttctaaaggatagagtaacttcatattggaaataacctctgagcctgcttgaaatttttaatttctggggtttagtgaaagtatttcctttacatattcaaagcaatgccaagtggttttatttatagcactcatttttatagctatagaaggtgcagtggtatgagctaaatccagaaggcaggatggatgtgtgagaggatgaaaagcaactagaacctgagtatagtccagcttggaagcaggaaaatcgatggttgagaaatgaggcaaggatctcttgagcccaggagtttgagaccagcctgagcaacataaactccatta

SEQ ID NO: 138400 - DNA, 474 bp, Homo sapiens
gcatttctaagggaaatgaattgttggcagtagattcagatagcaatgatctttctaaaggatagagtaacttcatattggaaataacctctgagcctgcttgaaatttttaatttctggggtttagtgaaagtatttcctttacatattcaaagcaatgccaagtggttttatttatagcactcatttttatagctatagaaggtgcagtggtatgagctaaatccagaaggcaggatggatgtgtgagaggatgaaaagcaactagaacctgagtatagtccagcttggaagcaggaaaatcgatggttgagaaatgaggcaaggaatgtagtggctcaagagatcctccctccttggcctcccaaagtgttgggataacaaggataacaggagtgagccgccatgcctggctgagccagtaatttttactctcttaaaaactaggttattcctaatgattctgcctttgag

SEQ ID NO: 138401 - DNA, 534 bp, Homo sapiens
aaaaggtaggggagctgataaccctagaagctcattttgtgtctatttctcgatgccacttgggaaattctcaagttgtcatagatcatatttccctttaagacgcctacaaaagaagttaggaacatcaagcagaaggctgggagacccccttcttccagtaggattcctggtgctcaatgcacatggggttgaaactgtgcttggccaagcaaatcagaaagaagctgggctttccttcttggcacagatgagattcttcttgtgagaaatggtggaatcttcagccatgccaagatacagggaccgagtccttaggctcagattaacaacctgcgcaagtttacaaggcttcgtctttatttcttatcgttatttgaagttgttccaaaataatgtcttttacaaagaaatactgtaaatatgacacatgaaaaggtcatttgttttgtagaatgataaaattcctgttctattattttgtatagaactgaggggcactatgaataagagtgataaagatatgtaggaagg

SEQ ID NO: 138402 - DNA, 188 bp, Homo sapiens
agatctcactagaaagctgatatttgagcaaaggcttaaattgctgaaggagcaagccatgcggccattttggagaagggagctccatcctgcagcgggactgtgcttgccatgttcaggggacaagtgggccagtgtggctgcggggagagagtgagaaaaaaagtggtctcagatgaggtcagaga

SEQ ID NO: 138403 - DNA, 829 bp, Homo sapiens
cagaaaggtcaggggcctggccaggatcccccagctcacactggagcccagcccaatgatcttctcatgacattgggccactctacttaggagtactcttttcttctattatttgccatccctaaactgggaagacctaagaagaggtttgagtgctccatggggtttagtgaaaggtctttgcctccggtgccaacggtgtgagacccatgagataatctgacctggacccccaagggagaatggccaccaagatccctcaagtcaggggagcaggctggactgggagagacccttggtaaagagactggggctgtgagcccgtcatcatgtggcgtccgggctgggtctggcgtggaggacaagtctgatctttttccttgctttaagggcgcagggagtctaaagcccaatggacatgctcagaggagcccccataccacccaggggtcggtggctggtctggggcagggaagatcgcttcactcgtacccagtgcctcatggtgagaggtctgagaggagagggagggccccagcatcctcctcatctacactgagacctcctccccttgctcctggcagagcatcagttcagagctcccacgtagaggcctctcccctgccagggatgagcccatctcagcacatgccaaaatagctgtctgggagcctgggcccgcaccgcccacaccccagcatctcgcgggttaacagcttgcctgtctctccgcccccttccccagcttgctgacattttacagagagaggcgggggcggttgtgaaagggggcaagctggttcttgctccccaacccacacggacaccc

SEQ ID NO: 138404 - DNA, 3418 bp, Homo sapiens
cgagcgctcccaccgagctgcctgccatggggctggggctgctgctcccgctgctgctgctctggactcgggggactcaggggtccgagctggaccccaaagggcagcacgtctgtgtggccagcagcccctctgctgagctgcagtgctgcgcaggctggaggcagaaggatcaagaatgcaccatccccatctgtgaggggccggacgcctgccagaaagacgaggtgtgtgtgaagccgggcctctgtcgatgcaagcctggattctttggggcccactgcagctcccgctgcccgggccagtactggggccccgactgccgtgagagctgcccctgccacccgcacggccagtgcgagccagccacgggcgcgtgccagtgccaggccgaccgctggggagcccgctgcgagttcccgtgcgcctgcggcccccacgggcgctgcgaccccgcgaccggcgtgtgccactgcgaacccggctggtggtcgtccacgtgccgccgcccgtgccagtgcaacaccgcggcggcgcgctgcgagcaggccacgggcgcctgcgtgtgcaagccgggctggtgggggcgccgctgcagcttccgctgcaactgccacggctccccgtgcgagcaggactccggccgctgcgcctgccggccgggctggtggggtcccgaatgccagcagcagtgcgagtgtgtgcggggccgctgcagcgccgcctccggcgagtgcacctgcccgcccggcttccgcggagcgcgctgcgagctgccctgcccggcaggcagccacggggtgcagtgcgcacacagctgtggccgctgcaaacacaatgagccgtgctctccagacacaggcagctgtgagtcctgcgagccgggctggaacgggacccagtgccagcagccctgcctgcctggcacctttggcgagagctgcgaacagcagtgccctcactgccgacatggggaggcctgtgagccagatactggccactgtcagcgctgtgaccctggctggctggggcccaggtgtgaagacccctgccccactggtacctttggggaagactgtggctctacctgccccacctgtgttcaggggtcctgtgatactgtgacaggggactgtgtctgcagtgccggctactgggggcccagctgcaacgcctcctgcccagccggtttccatggaaacaactgctcagttccttgtgaatgcccagagggactctgccaccctgtctctgggtcctgccagccaggctctggcagtcgggacactgccctcatcgtgggcagccttgtgcctctgctgctgctcttcctgggtcttgcctgctgtgcctgctgctgctgggccccccgatcagacctcaaggacaggccagcgagagatggagctaccgtgtccaggatgaagctgcaggtctgggggacactgaccagcttgggctccacgctgccctgccgttccctcagctcccacaagctaccctgggtgacagtctcacatcacgacccggaggtccccttcaaccacagcttcatcgagccgccctctgccggctgggccactgatgactccttctcatccgatcctgagtctggagaggcagatgaggttcctgcctactgtgtgccaccccaagaagggatggtccctgtggcccaggcagggtcgtcagaggccagcctggctgcaggtgctttcccgccccctgaggacgcctccacgccattcgccatcccgcgcacctccagcctagctcgggccaagcggccatcggtctccttcgcggaaggtaccaagtttgcaccacagagtcgccgaagctcaggggagctctccagcccgctccgaaagcccaagaggctctcccggggggcgcagtcgggtcctgagggccgggaagccgaagagtccacaggcccagacgaagcagaagcccccgagtcctttccggcggctgccagtcccggggattcagccactggccaccggcggcccccacttggtagccggacagtggctgagcacgtggaagccattgagggcagcgtccaggagagctcgggccctgtgaccacgatctacatgctggcagggaagccccgcggatccgaaggccctgtccgctctgtcttccgccattttggtagcttccagaaaggccaggcggaagccaaggtcaagagggccatccctaagcctccgcgccaggccctgaatcggaaaaagggcagccctggccttgcctctggctctgtcggccagagccccaactcagccccaaaagctgggcttcctggggccacagggcctatggcagtcagaccagaggaagcggtccgggggctgggggctggcaccgagagttcaaggagagcccaggagccagtctctggctgtggctccccagaacaggatccccagaagcaggctgaagaggaaaggcaggaggaacctgagtatgagaatgttgtacccatctccaggccaccagaaccctgatgaccttgaatttggggagtggggagagtggatggactagactgtgctgtgtgctggaaaatgatcccggggccaggacagacaaaccagagcctctgcgcctccacagggaaaaggcaaggcttccaggccagttggcccaggcccctggcagtgctcccggaggggcccaggaaggcctgggcagagaccctgtaggatggggtcaggaagggttgcctgcagggacttttgctctgctgtcctggaccctgtgtgcctcataagggctattctttctttcacgtgcaaaacatttttctgaaatagcaaacaacctacatgtttgctgataaaagattggctaaacaaaatttttttttttttttgagacagaatctccctctgtcccccaggctggagtgcagtggtgcgatctcggctcactgcaagctctgcctcccgggttcacgcccttctcctgcctcagcctcccgagtagctgggactacaggtgccctccaccacgcttggctaatttttttgtatatttaatagagacagggtttcaccatgttagccaggatggtctcgatctcctgacctcgtgatccacctgcctcggcctcccaaagtgctgggatgacaggcatgagccaccacgcctggtctatgaactttttaaaaaggatgtatgtgtataaaaacagattcaagggaaaggcactaaatggttttttcctctggaagatgagattgtaggtgatatttattttcttctgaaacttttgtatagtttgcaaattttctacagtgaacattcttttttacttttgttactagattgaatttgataaagtataataaaaagcaatgatctttgttaaaaaaataaaaagtactaacattacagacatgta

SEQ ID NO: 138405 - DNA, 376 bp, Homo sapiens
gggcggggcggagcggagacaggtggccgcggcggggcgccgggaggaggggtcagggcttcgcggtgctcctctcaaaaaacatacaaagtgctgggatgacaggcatgagccaccacgcctggtctatgaactttttaaaaaggatgtatgtgtataaaaacagattcaagggaaaggcactaaatggttttttcctctggaagatgagattgtaggtgatatttattttcttctgaaacttttgtatagtttgcaaattttctacagtgaacattcttttttacttttgttactagattgaatttgataaagtataataaaaagcaatgatctttgttaaaaaaataaaaagtactaacattacagacatgta

SEQ ID NO: 138406 - DNA, 939 bp, Homo sapiens
  misc_feature (930)..(930): n is a, c, g, or t
cgagcgctcccaccgagctgcctgccatggggctggggctgctgctcccgctgctgctgctctggactcgggggactcaggggtccgagctggaccccaaagggcagcacgtctgtgtggccagcagcccctctgctgagctgcagtgctgcgcaggctggaggcagaaggatcaagaatgcaccatccccatctgtgaggggccggacgcctgccagaaagacgaggtgtgtgtgaagccgggcctctgtcgatgcaagcctggattctttggggcccactgcagctcccgctgcccgggccagtactggggccccgactgccgtgagagctgcccctgccacccgcacggccagtgcgagccagccacgggcgcgtgccagtgccaggccgaccgctggggagcccgctgcgagttcccgtgcgcctgcggcccccacgggcgctgcgaccccgcgaccggcgtgtgccactgcgaacccggctggtggtcgtccacgtgccgccgcccgtgccagtgcaacaccgcggcggcgcgctgcgagcaggccacgggcgcctgcgtgtgcaagccgggctggtgggggcgccgctgcagcttccgctgcaactgccacggctccccgtgcgagcaggactccggccgctgcgcctgccggccgggctggtggggtcccgaatgccagcagcagtgcgagtgtgtgcggggccgctgcagcgccgcctccggcgagtgcacctgcccgcccggcttccgcggagcgcgctgcgagctgccctgcccggcaggcagccacggggtgcagtgcgcacacaggtgagcgggcggggcggggacaggtgggctggcggggcgggggcggacacaagtgagcaggcggggcggggcggagacaggggggcggggcggagacagggggcggggcgaanacaggtggg

SEQ ID NO: 138407 - DNA, 355 bp, Homo sapiens
tgtcgaatgagtctgaggaaagatgtagaaaacctcattagtggtgcagaaaacataaattctggctcctttctggcatccgctcttgccattggatgcttaggtcaatttgcacccactgtcttactgccttagtgccttagtggaaaagagggacaataacacaggtctttgtaaacccagaaatagagctgttgtgttcttcagtcctggatagcaatagaagtttggatgaaagtcagctggcaggaattcagctggctctaaagtcatgtgttatcagtagtgctgacagacacatggggttggggggcaggtggtgaaggaagaacttgaggtggtagcaacaaatagg

SEQ ID NO: 138408 - DNA, 611 bp, Homo sapiens
agacagatacgaatcgagccggtaccctcgcgaacgtgtatcactgcacaccatgatgaattattacagaatcaacatacttgtctatattccacctaactatagatattgaacattgcaagcactcagtatgctgcctcatgcctcctcataagcattacttccttcaacgttagccagtatcctgacttttctcacaatagattaatttttggctgtttcaaaactatgtataaatgtaactgcatggtttcattcttttgagcttggcttcttttgattgatattctgcctgtgagattcctccatattgttgacagtggtagcactttcttttccattgttgtatagggctccatcgtgtaaattttatccatacacttgatttattcatccatccttttttaatggacattcgggttgttttcagtttttgactaccatgaataacgctactatgaacatgccttttggtgactatatgtaggcatttctgttgagtctgtgcctaggagtggaactgatgagtcataaggtttgcaactgttcagcttcagtaaattctgtctaatagttgtcaaaagtgcttgaaccaacttatatcctactag

SEQ ID NO: 138409 - DNA, 434 bp, Homo sapiens
ggtctgctgctacgatttgggagcagaataagctgcttcatttgctcacattcaagtagctgtggtgactccttatatggtgttaccacccctttctctctcttgattttcttctcacctaatcatttgaaagatgatcagacacctctgaaatactgtaaaaacaaggctaaatgtagaaatatcagtgcaggttaacaagtgaggcagtgatgacaaatgctcctgtaacccagcattttagaaagaaggaaaccaccatggttttgtagcacactttatggaggagagaaaaataaaattccaagtgtacatgaaacagattgcagtgactcagtggagaattgttgcttcaaaaaatcatattacactttctccccttttataggtttttaaggtaggagggataattttctgatctttagtaggatacc

SEQ ID NO: 138410 - DNA, 398 bp, Homo sapiens
ctcaattaacactcagaaccaaaagtggggatactcctagatattgacccaagagaaatgaaaaatgtatgctcacacaaaaattgcagcatgatactcaggagcctgaggcacaagaatcactagaaccagggggcggaggaggctgcagtaagcctactacactccagcctgcgtaacagagtgagactgtgccctccgctccccccacaaacaaaacaaaacaaaataaaaaaaaaccctcaagcatgatggcagcattattctcttttttttttctttttgagatggagtctcgctctgtcgcccaggctggagtgcagtggcgccatctcggctcactgccagctccgcctcccgggtttacgccattctcctgcctcagcctcctgcgtagc

SEQ ID NO: 138411 - DNA, 350 bp, Homo sapiens
cacactcctgctaaatcccggcactttgggaggcggaggcaggtcgattatgtgaggctcacgagtttgagaacactctggccgaacatggcggaaccccgatcttctactaaaaattcaaaattatctgggtgtggtggtgggttacctgtaatctcatgctactcaggaggctgaggcatgagaatcgcttgaacctgggtggcggaggttgcggtgagtcaagatcgcaccattttaccctagcctgggcgacagagtgagactccatctcaaaaaactaaaatattttacttttaaaatgggagtttggaaattccaagttaatccttttgttttagaaagcttcg

SEQ ID NO: 138412 - DNA, 320 bp, Homo sapiens
agccggggacaaaatcttcacagagaaggtgtgttttggaaacagacttccaggacagaaaaaattttgacaaaatttcaggactgcattcaggacagaggatctagcacagaccaaggcagagacaggaaacattttgctgggttaggatgtcctggaagtatctagcagtggttctccattttggttgccattagagtgacttaggagctttgaaaaatacagaggcccaggcccaccccagaccaatcaattcacagtctccgaggaagaggtctatgtatttgtgacatttgaaaaaattcccagaagcgatttta

SEQ ID NO: 138413 - DNA, 380 bp, Homo sapiens
aagttatgtcgggacagcaagttaaagccgggccgtgagcggtgtcctcccacaacccacagggcaatgacgcttcatggcccctggcagcagggctgctgggacagcaggcagtgagaagagggtgtggacagcgtgcgtgcactgagaaaccacaccccactagctgggactctccccagagtttacagcctgcagtgattccagtttcctcccttccactacttccgagccaaaacccaccctgaaagcttccccaagagtcgacgccccgggccatgataatcagcccaggcactagtttagctggtgaaggacgtcactgagccaccatgacgtcctgtccccagcctgctactgtctagaatgccccgagaccc

SEQ ID NO: 138414 - DNA, 403 bp, Homo sapiens
atcacacttgcttatcctaatttatacaatcattatcaattttatgttttcaatggggaaatgggagatgttggtcaagggtacaagattttagttaggaagagtaagtttagtgatcacagtggtgatcatatctgataatactgtgttgcatatttcaaaatggctaaaagaatagattttaaatgtttttaccacaaaaacctaaagtataggtgaggtgatagatatattaatcagcatgatttaattatttcacatgtatgcatatattaaaacttataccccatttatatatacaattacttgtcaattaacagtaaataaatacataaatatataatatatactatcatagtgttcttcaaataggtctttgcatctttcttgtgaatttttttct

SEQ ID NO: 138415 - DNA, 254 bp, Homo sapiens
cctctaactatcagcttaaaaacagtatttagggaaattgtttgtgcctccgtttgtttcttacattccagggttatcatcgttggaggcaacatgcctcagagtgtgaccagaaaggctcacaagggcacctgcctcaggcagcatgtggcatctcctatgaattatgcatcatcggcatatggacagtggaggccgcctaaaaacaactagccgcttatcattgccacagttgtacattaccttcccgcggc

SEQ ID NO: 138416 - DNA, 344 bp, Homo sapiens
cctagtgagaccctgtctctacaaaaaaaaaacacaaaagccagcctggcatggtggcatgcacctgtagtcctagctactggggaggctgaggtaggaggattgcttgagcccaggagttcaaggttaccgtgagctatgatcgcaccactgtacttcagtctggcaacagagcagaatcctgtctccaaaaaaacaaaacaaaaaaccaaaaaaacctaagatatttgcatccattaatcaaactatttttatctcccttctctgctcccttcccagcctctggtagccaccaatctactctctatctccatgagatccaggttttaagctcccacatgtga

SEQ ID NO: 138417 - DNA, 478 bp, Homo sapiens
tatcagaacagaggccacagcgcaccttggttaaatgtacagtctctgggaccagactgcctggactcacaactctggctccgccatttacaggtgagtcacataacctctcggtgcccccacttccttgcctgcaaagtatcatttaccacaactactcattggattggtgtgagggttcaatgagaaaaatctatgagaagtgctaagaatagtacccgccatcaattaaattctatttgtgcctataaaaataacatttgttgtatgtaatgaaattgtgtttacttgtgtgtctccaccatcaggctaagacatcctcaagtctaaggaccttggtgttttcatcccagagccccacaccttgcaagtgtccagagcatagtcattggatgatgctgtttcccacttaccctctggtttgacatggctgcaggattggcatatggaaactgactgggttgagaagagactcaaa

SEQ ID NO: 138418 - DNA, 425 bp, Homo sapiens
ctaactgttgaaaataaaactcgtcgaaactactgtgctttcaaaaataaaaagcccatctagcagggactgggctatgagagctggtataaagggaaaattctggaatcaggggaacttccattacaaaataagaaagaccaatgccatagggaagtcacaacattttggaagcaggataaaaaggaatgaaaaagagctagatttcttttccatcagaaaagagaagatgggacaggcacagtggctcatgcctgtaaccccggcactttgggcggctgaggtgggaggatcacttgaggtcaggagtttaagatcagcctggccaacatggtgaatccccaactctactaaaaaaattttaaaaattagccaggcatggtggtgcaggcctatagtcccagctacttgggaggctgaggcag

SEQ ID NO: 138419 - DNA, 194 bp, Homo sapiens
cgtcgctctgtaggatcccagtgttagccaaaaattatgcaagacgcggtgtagaggaaagttcacagtgttaaatgtctacatcaaaaaccctgaaatagcacagacaatttaatgtcacatcacaaagaaatagagaaacaagaacaaactaaacccaaacccaggagaagaagtaacaaagatcagagcag

SEQ ID NO: 138420 - DNA, 253 bp, Homo sapiens
atgaacaaacccctatttgacaactgggtaaacagaggcacatggaagcagaatgatttattcctggtcttttagtttggatctaatccccagggccagggctttgaactcccttcagatcacgccccaccacacacaggagcacagtctggtgggaggtagagccttgagcaaatctgcttgaagctgggcaatgaagctgtgggaatgagagtgcaacaaaccctcggcacggagcaatggaaagtgtgtg

SEQ ID NO: 138421 - DNA, 572 bp, Homo sapiens
aagcacacacaacgcaacacaatccgtccaagttcacagccgcagaagaaccacacccaaaattgctgagagtgtgaaccttgactgccttacaaacacagaccgcaaagggaggtaaagcttattcggctacaaaagatgttgcttgtctcttaagtagttccttcattgacgccaaatgtcttttatttataatcacgtctctttttttttttttttttatttgagtgtatgcttgcattcccaccttcaaatcattgctctccgcccgagcacagagctcccgcgagcctgcaggcagcccaggactcctgcgcataccaggctctctggtcttggctctcccagccccacgccgcccactcacatctgcccagctctgctgttcttccacgttcttctccacattgggagttttttgcaggcgtgtcctgtctcatgctccccatcctccgctagctctccttgctcatctcttcagctttgttctctttgtccctgaactctcatctcaaatcttttcatgcctaagatcgtgcttggcagagagtcgatgctcaggaaatgaaaca

SEQ ID NO: 138422 - DNA, 273 bp, Homo sapiens
atattaaatacagacattttatttttattttttgtagagacagtcctgctgttgtccaggttggtcttgaactcctggcctcaagcaatcctcctgactcagcctccccaagtgctgggattacaagtgtgagccactgtgcccagctcagacttttaaaaatacaaaaaactcgaggtttattttataaagcccttaggaagaacaaatcctattatagcaaatacattgaattttcaatgtactgtgctagtaagatatttacactcctaa

SEQ ID NO: 138423 - DNA, 126 bp, Homo sapiens
ttattcagtcttcgtttacttccacacaggatctgaagcaacttacaataaataacgttgaaaccatgtgtcattaaaataaacattttaggctgggtatggtggcttacacctgtaatcccagca

SEQ ID NO: 138424 - DNA, 295 bp, Homo sapiens
taatttttgtatttttagtagagatggggtttcaccatgttggccacgctggtcttgaactcctaaccttgtgatccacctgccttggcctcccaaagtgctgggattacaggcgtgagccaccgcgcccggcctctttttgtgcctttttaagtagatttgacatagaaaggttatgcttcatcaaatataagaggagtcttattttgcatatgggcagagagcccatcatcaattaaataacataattagagagtatcagtaaatgctggctcagaaaataatctgcattttg

SEQ ID NO: 138425 - DNA, 355 bp, Homo sapiens
cagcagcgtgatgtaccgaccgcgtccgcggcctcgaggcttcctgctccgctccagtgcagtcaggcgtgcaggcaccacgcacctgagctcggtcaacacccctggggtcctgtccctcccgagatgtgacagaaatggccccacacacgagcggcctgatgctcggaggccctgtggcccctgggtgactcagtgagcggcagggatagggctggatccacagccccgccccaagcttcctgccaccgtgggaaccacaagctccacgtttccctgtcaggtaagcctttcggaggcaggcctgaaatcccagcctcactgtgtcgcctgactagtgaaacgagccccgcgg

SEQ ID NO: 138426 - DNA, 210 bp, Homo sapiens
cttttagctacaatcgcaggagagaaaacactactgtgactcagattagaacccaggttgcggcaaccacagctgcaagtattgaccactacacgaccaaaaagcctgctgacaaccattgtacttcttatatttttttatgtaaaaacactcatactattttctctgctttattctcgaacgtctgcagattttcgtgcttttctctct

SEQ ID NO: 138427 - DNA, 493 bp, Homo sapiens
agaagggactcctcctgccaagtaatcctctattattgcattttccatgctgtttcacaatgatctgcttactgtcttcttcatttttactgatggtagtagtagaactactattgttactaagagctagcttgtattcagcccttgctattcaagaagaatgccctaaaagctttaaaggaattcacacttaatattcacaacattaatttgagttagtggtcattattatcattttacagataaggaaactgaggcacaaaaaactgtgcacagtatcaaatgtagtaaatggttgaaccagaatataagcctagtaaatggctgaaccagaatataagcctacactctaacccacttatatggtgagctgttcaaaggcaagagtcatatgtctcatttatatttgtatcccaaatgccctaagtattgcctggcagctataggtattcaaaaaatgctgagatgagccaggtggatggtatcactgaag

SEQ ID NO: 138428 - DNA, 428 bp, Homo sapiens
acaattattagtttgtcattcgatcaagtaaaaatggtgttccatgaaaaatgcatctaattcagcttataactcaattatacaagtgttcattcctctagacaatcataagtagcaaatgtactttatacataattaatattttggcacacaaaatattaaaaagatatttttatggttgagatttaataaaaactagtattgctttattaagcaattggtaaaactgatttttcttttcttgtttaagattgttgtgtcagtaaggtataaaatgcaatgaacagttgagtgcactgccttgatttgtgctaagacacctgaacattttacacatcatggcttttgcaccatcagtgcaaatttcagcacgatgaaaatagcaacatcttagtactcttataaagatggatttgatttcatagtgt

SEQ ID NO: 138429 - DNA, 426 bp, Homo sapiens
aagatcccaaaagcaaatgcaacaaaaacaaaactagacaagtggggtttcattacagagcttctgcacagcaaaagaaacaaacagggtaaacagcgtacagaatggaagaaagtatttgcaaactatatatccagtaaaggactgatatccataataaataaggaatttgaatcaataagaaaaaataactcgattaaaaagtggcaaaggacatgaacagaccttctcaaaagaagacatacgagtggcgaaaaaaggtgaaataatgtgcaacatcactaatcatcagagaaatgaaattgaaaccacagcaagataccatctcatagcagttagatggctgttattaaaaagtaataaaataagacatgttggtgaggatgcagagaaaagggaacgcttacacgctgttggtgggaatgt

SEQ ID NO: 138430 - DNA, 480 bp, Homo sapiens
tctttaacagggaaatgctacggggaggagagtggaatcagccaagaggaccaaggacggagctcttctaaggtgttgaaagggctggtagaggaagaggagcccatgcctttgttgtcgaataggatggacactgactgcatgtggctctttaaatttaaattaaattaaattaaattaaaaattcaattcctcaatcatactaaccacatttctagtgttcagtagccacgtgtagttagtgactaccatattggccagtacatataatagaacatttccattatcacagaaagttctattggacagtgcttaagtagactaagaaataacaaccatggagatcagatgtgaatcagaccagtgagctcatggagttagcatttagtgtggtcaagtcctgccataggagccttaaaatgtgacccttgaatttgacaattagttactgtgggccttttaaagattttagttaagtgg

SEQ ID NO: 138431 - DNA, 122 bp, Homo sapiens
gagtatgcctctgcctggccacagactgctgtcattctctgaatgcagtggctgaagtgctgggctttaggttctgattccctgcccttggaagacccccttcaaggggaagagtccctcag

SEQ ID NO: 138432 - DNA, 366 bp, Homo sapiens
aaatatgaggataagtttggagacttctggggaagaaacgtgctcctgttctttaaggaaagaactaccagaagagccctcattctcctccagagtggcaagcagatatgggaactgaaacttcaagaaccatttggctatcaggaaggaggcagcctgacaacaaagacagccccagaagaggatgtgattaaggaaatcagagagaaacagagccaggttgctggatcattctgatcctgaagcctccattacatctaatcacagactgctgtggttggcagaggggtgcatctttgattgccgctggggacgaaagcagagtcccgaaagcagatgtcccagctgggtcccgcacctctccct

SEQ ID NO: 138433 - DNA, 602 bp, Homo sapiens
ccccaggtctctgtccctttcctgagccctcccctgtccttctccaggcaacccacagccccagcagcctgtgcacatttagcgctggatccctgatcccttgggcttggcctcactcctctctggctccatgcccccagatctctttggcatgaccaacaactggctggcgagtccagagatgggggaagaagggccctgagccatgagtgcacctcactgcatggccctggtcaggtccctctgcctcccggggcctcactgtgtccacagcctcctgcacgccacgaagcacctccccgatgtgccagctcccccagcaccagcctcatcccaaggaaggaggaggcgactcccactactcaaggggctgttccccatggcacccctcaggccgctgcaggagactataagcccctcacaaccgaggccattttccccactcccttccccgcaagccctaaatggcccagcaacaactctgaactctgatctcggtcagcccagcacgggtggggcaggaggttctgtcaacagcgagagaaactcgttaactgaatgtcaataggattaaaggctctgatggtccaggagaaaaatgt

SEQ ID NO: 138434 - DNA, 346 bp, Homo sapiens
atggtcggttaggaagtttgagaatcgtaaaggtttggaatacctcttatgagtagagaggatgggttgagtaagactcagacagagaagccttttgttttgttctttaaaaccagactggagaacccagctgagggtggagatcatgacacagtagggacacctgattactttctttaaactaaagaaagccctgcagtggtgctactacttcagcaaccctacaaatcaaagactagtcataatagatgtgaatattaattcaacatattaccataaagagacagaaagatacttgagaaggtagtgttccagagttgggttctggttctgatgcggcattgta

SEQ ID NO: 138435 - DNA, 284 bp, Homo sapiens
ttaacagaaaactcttattcaacaaatggcattatttaaaaagttaacaatcaagccccgaaccagaagatatttttactcatatagaccacaaagaattgatatgcagaatatataaagactgcctacaaatcactaaaagaaatcaacagaaaaatcacatgattagaaaatgtccttcacagaagaaacccaaatagctaaataaacacataaattctcaatcttcctagttatcaaccaaattctaataaaactacaatgagatattactcactagttat

SEQ ID NO: 138436 - DNA, 428 bp, Homo sapiens
aaatctacttgactgctatctccactgacacaaccatagtgcatccacccttacttacccagatgactacaggacttcttaactggcttctctggtgctcttcttgctgagcaagaagtacatcctccacacggttgccaaagggatttctaaagtacagtcaggtatacatcaaatcatgcatacaaacccaccaagggcttcccattataaccacgataaaattcaaatgcttggtcacatcctggaaggccctgtgtgacctggcccctgcacatctctccacccttattttcacctctctccctcgcttacaggatgcttctgccatgccagccttcttttggcctcttgaacatgttaggcttgttccaggcatattcccttcccggggactgtgtatgtatgtgctgtttcttctgtttgga

SEQ ID NO: 138437 - DNA, 416 bp, Homo sapiens
ctctagccagtggacggattcctcctgtgtgaggttcctcctctcatccagtgggctatgggtgtggggtcgttaaaatggaacacacatggccacctagccttccacatgggcagagggttagctgaggccagcaatgacacctgccattttacatctttatctcgcaacactcttcccaacttaggtgggacctgtcacacctccacattccttttctaatcctctgactgcactgaaatgctgtccttctacccttctctaaatcccattttagtctccaaggctcaaagccaatctttttttctttttttgagatgaagtctcactttgtcacccaggctggagtgcagtagtgcagtcctggctcactgcaacctccgcctcccgggttcaagcgattctcctgcctcagc

SEQ ID NO: 138438 - DNA, 542 bp, Homo sapiens
gtgactctagcaggatcttacgggggccttaaccctacccgcacacacacctgcacgtgaccctgatgccagtgctgggcgcccaagtcaggcagtccgcacagcagtggcaccagggtgaaaacctgctgctcaataccatcccggttaccacaaagagcctgccctggtggcccctgagttcttggaggaggccaagtcacagcaacccctcaagtgggcgggcgatgcacttgaccctgaggacatcaggtaccaggcccgccagctgacgccgacatcggagccgcagctgcagtctagacgtggtgcaccggcagtaagtgactggacaccccagaccaggcccgcccccccagtagcgtggatcctgaggccagacccccaggcggcaaaatcaggcgacgggccccgccagcagccgctcagtttcatccatgtggatacagagtgcccagcgcccgggcccaggatccagagagatcccaagaagagcggaacttgaggccaggtgggctgtgcactctgcgaccctgagggtt

SEQ ID NO: 138439 - DNA, 345 bp, Homo sapiens
gacctaacgtacacaggttatgcgctacacgactttgtatggctgttactaacaatagagagaccactaatggccattcacttgtctagagccgtgttataccatgatgctgtcccatttgttcctaggattaaatgcaaactgcaatgcctggctaatagaactctcagtatctggttccactactgtttctgttttgtctttcctactcttctcccttgaaattactcaccaaactttctgatttgctatcaatttctcaagacaccatactttctcttattcactaagccttctgaagagaataaattatgcctcttttttcattctgtgttacgtctagct

SEQ ID NO: 138440 - DNA, 419 bp, Homo sapiens
ggctggacgcagtggctcacgcctgtaatctcagcactttgggaggccgaggtgggcggatcacgaggtcgggagatcaagaccatcctggctaacatggtgaaaccccgtctctactaaaaatacaaaaaaaattagccagacatggtggcacacgcctgtagtcccagctacttgagaggggctgaggcaggagaatcacttgaacccgggaggtggaggttgtggtgagctgaggtcgtgccactgcactccagactgggtgacagagtgagactctgtctcaaaaaaaaagaaaaattaaattcttgtctaggtaaggcattcgctgcttcggatttgaaagataacaaagcatgtacagtgaaaagtctccttcatatcccttccaccagacagttctcccgctcagtagaccg

SEQ ID NO: 138441 - DNA, 158 bp, Homo sapiens
cccacagggaaggggaaatagaaaaccccagaagcacagaggggcaatgcttgtcttggtgagagtctggagtcattgagggaaaaataaattcagtcaagcgttctatttaagtttagagaaactatacgttttaaaagttgtccagagcatgcatg

SEQ ID NO: 138442 - DNA, 227 bp, Homo sapiens
ccccacattttttgtatctccattgctgttggagtaagatcagactcagcatattggtcaagtctatgacctttcatggttagtctccaatcatgcctttctgtctccattttccactcctctccttcattcagacttgccattttctctgctatgcctttagcgcacactttgttttcctgcttttgagcctttacttaccttcctttcacctgtaacagcctttt

SEQ ID NO: 138443 - DNA, 223 bp, Homo sapiens
cctaagttaatgtagataaaggttggtcaattttgttgattttttcagagaaacgactcttggtttcattcattttctctgttgtttttctagtctctactttgtttatctctgtccttttctcattatttccttccttcgctagctttgaggttagtttgttcttctttttctagatccataaggtgtaaagtgaacttgttgatttcaggtctttctccct

SEQ ID NO: 138444 - DNA, 662 bp, Homo sapiens
gggatacagggaaaattgtatcactggagagcttcaggagagaactgatgaaatcctggttgttccacatcttgcccaagacaaatcctataggttcagataagcaaaaactgtgagatagtttatctttcccttaaactcggaaagcacataaggtaccatgtgaaaacactcttctggtgagtgatgggaaataattcagtttgagagccaactagacctagattcagacctagatttgaatcccatctatgccactgattaggattaacctcagacaagcaatttatcctctctgaattgcaatttcctcatgtctaaatgggaggagaatgcccaagatgcagagttgtgaggattaaacaggctgccggcttgtataaagtgctcacatcttgcctgggagagaatcgctgctcaggatggtgacatggtaaacagtatgggttcaggagttgaactgcttgaggctgagccccagctccactatttaaccactatagacttcgggcaaatctctctaagccagtttcctcgactctagaatggagataatagtatctatttcttagtgttatgatgaccaaatcagatgatgtgcataaatagattaacctgacctggcacagggtaagcagctgccattcttctcctctacctcc

SEQ ID NO: 138445 - DNA, 390 bp, Homo sapiens
aatttcttatatttatggtagagacggaatctcaagggctggtctcgaactcctgagctcaggcagtccacctactttggcctcccaaagtgctaggattacaggcctaagccaccacgcctggctgattctactcttttgtcatggagattagcagccatcttttctctctcctccatcatgagattgaatccaagaggggcaacaatcttccaaagttagtgccagaagtaatacattgagttttaactgcctcagtatttctttcaatgtcaactatttcctcatccttttaatctctaaatccttaatgatgcagaagcctcaaaaaggtacagatacacctcatcaccaggttatcttcagataactggaaaatggcaactcaaa

SEQ ID NO: 138446 - DNA, 510 bp, Homo sapiens
tgtaagaaactgccagttgctccacttctcaccaacatttggtatagtcagtctttctaatttcagccattcttgtgggtatacagtggtatctcactgggcttttaatctgcttttccctcatgactagtaatgttgaatacttttattatgcttacttgtcattcacatgtcttcctttgtgaagtgtttaaaccttttgcccatgttttaaacaggactattttttttttaatcactgagttacatgaatttttaaatatatattctggtacattaatttcctactgctaacgttaacagattgccagactttatggtttaaacaatacaaatttattattttatagctctacaggtagtaagtccaaaaatcagcctcactgacctgaagtcaatgctttgtagggctggttctgtgtgaaggctctatggtgaaatctgtttccttgccttttccagctttttcagaggttccaaagatgaggacatggacatctttcttttctt

SEQ ID NO: 138447 - DNA, 898 bp, Homo sapiens
cccattttaactttctggaggataaaatagcatgctgaggaaagccaaagtgcgccagtttacagacagctcactcccagaagcagagccacctaattcaccagcatctgaccactcacacctgaaggagccaaactgagcccagaagaatggcccagctaagcccagcctaaatttctaaccagctcaaccctgagctagtatgtttcaggattgttatgcagttatagcttagtaatatatacacccattaaagacaggattccaggattccaggacagattgattacaaataacctgcaaatgcttggcaccctgtaagtattgatattgtgtttcctttatttaaagttaaatttgttgtaagatggtattgacttatatagaagtgaggcaagagaatagggtctggaggcagggaacttaaggccaattcgtgctgaattcctaaagaagaaacaccaaggtctgggagcagggaacctaaggccaattaacgtgaacttcctacatctaaaccaaaaaaaaaaaaaaaaacaaaaaaagaaaaaaaaagacgacaaaacacaataggaacaaacgacgcagatacaaaacaaacaacaaacagaccggaggccggcgacaaaacaccagcggagggaccaacaacacacaccacctataagaagagcacacaagaggtcaaaaacaaaccgcgggcgcggaacacaccgcgacgaagacaccgcggcgctacgtgagacgccccctgcggggactacgagccccccaacagtcgcggaaaacaagtgtgggcacccgtgcgtcgatcctcactactgcgagcccagtccccacagccacacacgtacccccagacccaccgatcacacaacgcggaaagaaaaagaagagg

SEQ ID NO: 138448 - DNA, 424 bp, Homo sapiens
atgtactgtctcttgtcatcatccctgatgctgctcctgaggacagagaggtaaggagctgccagacatgtgagccagggattctgctcgcccactggaggctgctttgcccttctcatctgtcacttggcctgctgggcaacaggagagatgagaaagtaaagcaaacatgggctgagaatgaggtttggaagaaactctgtttagcaagctatgttgcagattcttattgttatggaaacaagcaacaggtaaaaggatggggaagatctcaccagtatcttccttactcagtgcaaaaaggatcaggtcctgaaatagccaggaggaccacaaaaggagtgaaggaagctgaaggatgtggttttgagctatactggagctgaagccaaaacaccccaaagtatagacacaccctcgcccc

SEQ ID NO: 138449 - DNA, 386 bp, Homo sapiens
catgggtcccaccgataatacaaaatatattctctactctatgtctgtctccctctttcttatccccttagggctgcatttaagaatcatccaaagtgcacattttctttcctctttctcataataaccttgtaaaaacttcttcagaaaagaaaagaagctaatttcactctattgtgtctttagggctgggctacctgagctactgctcattttcctgtttgttttagggtctgatgcaagatgatttttaaattctgtattgtaggaatttagttcttaatatgtcagctccatcccactgagtgttccatcaacacacaacccagttatctgcagggaccttgaccccagacgggtagtcccagatggaagccaggacattg

SEQ ID NO: 138450 - DNA, 201 bp, Homo sapiens
gggaggcagaggttatggtgagctgagattgcaccactgcactccagcctaggtgacagagggagagctgagatcacgccactgcactccatcctgtctcaattaaaaaaagtcggggggtgagtggagttggatttggacacagagcccatgtaaacatgaagaccagccatctataagtcaaagagagagacctggaac

SEQ ID NO: 138451 - DNA, 226 bp, Homo sapiens
tgctgggtgactctgaggatcccagttcgacggagattctctgcaagtctccggaggctctccatcaggggtttccgcttgaccccacagaggaagtgcccgggcctggctggcatttcaggggacgaattcacgcccaggtgcccaggtactgcacaggtgcgctgggtgctggcacttacggtgtgtgtgagggcccattccctgaccacaggcagactggaca

SEQ ID NO: 138452 - DNA, 723 bp, Homo sapiens
cccaccctttttctttgtttctaacaaatctcaggtgccctagctctgctggtactcccaatgtttgtcatggaatgagacaagagtgagcttcctgtaaagcaccccacaatgatgaggaagctggatatatgtttacagctctcttttcccctacagaaacaagagcccaggggaatcttctttggcactgttacagcttgagagagggtgatgcgaaatgaaaccattcctcttaccctttgaatgcagctgttatctgttctgtggctggaggggctatctcccaaattcagggatattcatgaaagtattcttatctgcggatagttagtagttggatttatgtgacggggactggaactgcagaactcctcctattccgttatcttgctgacatcactctctttactttcctctcaatttacttttaataaaggaggtttcaagacagttcaatgaagaattaatagtcttttcatcaaatggttctaggacaactggatatctacgtgcaaaagaataaagttggagcctttccacacacccaccgtatacaaaaactaatgtaaaataaataggagacctaaatgtaaaagctaaaactctaatatttttataaggaaacatgagtacatcttcatgaccttgagataaaaggtttcctagatacagcttcaaaagcccaggcaataaaagaaagcatgataaattagaatttgc

SEQ ID NO: 138453 - DNA, 578 bp, Homo sapiens
catctatctgatgacagaggaatctgctcctcaggtgcagaaattaatatacaagtctttttatgaacatatgtgtccaggttgctcataatggccgaaaactggaaagggatgcaactatctatccacaggacaacgaataaacaaactgtgttgcattcatacaatggacctgctgacacatgcagcaatgtggatcaatgtcaataacattaagttgagcaaagtaagccagacataaaacaggtcatgccgcactattccacttcaatgaagttcaagaacaggcaaaactaccatgacagaagtcaagagagtggtgtcctctgggtgctgaagggcggggaaaagggactgggaacctttgtgggtgaggacagtgttctatatcttgatatgagtgttggtcaccaagccatacacttcatatttgtgtatcgtaaactatctcagtaaaggactgtcagtgggaaaacattctaataggaacattttcccctccaatccaaagtccagatacagttattccttctttccctttgagaatacaggactgttttctactccaataaggaatc

SEQ ID NO: 138454 - DNA, 450 bp, Homo sapiens
atcaaggctcggcacaaaggtactctcccaggaggccttcctgaattcttctgtgaggcagactacttcccgagctgccccggcccttctccggccaagtctctccagaaactcatcccattcgttctcagatggaaggggacccacacccacgacaagcctccgggtttgcttaatgactcagacagcgagggtgctcggtaagccccaccagcccgcgccctactcagcaggtaatgacggagacctactaggtgacgggcgccgcggtagacgctgggataaggtccctgctccagggagcttacggtctattcactaacgtcaaagagcagtgagtgctgttacgtgtatgggagccaccagggtctccgcctgcctgcagggccacgcgcgcactcgacgcttcgcgcctgcctcagtttctccgtgaggccgcacagccccagt

SEQ ID NO: 138455 - DNA, 212 bp, Homo sapiens
tctgatacgttcatttttttcatcagagaaaggaaagaaactctttctttttcttaggtatcctctatggcttcctaacttagcagaagttaacaatagctgctcataaaaataataggcacaattatttctattttctagtgtagtaattcccaatatgacttcctcagaacacctattgtaagagacgttaacgaacacaaagcaaaaac

SEQ ID NO: 138456 - DNA, 206 bp, Homo sapiens
acaagtttcctgaactggaattgcccttccaaggcgatgcttggaagttctctgcctaattcctgggttattttccccggagtcaccacagtggagatgggactattttctcagggatgaaagggctttgactttcatgagccaaaatgttattactccctaatgagggtgggggcttctcagggactcactccagcctagcactg

SEQ ID NO: 138457 - DNA, 440 bp, Homo sapiens
gataatacagaaaagcaattcagaaacttaggagaaaaatttgacaaagaaattgaaatcattttttaaaaatcaaataaattgttgaactatggaatgcatttgctgacctgaaaaattcactagaggttcttaactgcagaacggatcatgcagagaaagaaatcagtgagctaaaaccacctatttgaaaatacagtctgaggaaaaaaaagtaattaaaaaatgaaggtgtgctgctgtcatggaaaggaacggaaaaagtgagtaaatacagcacctttaactgaaatatccaggtacatgcattggaactaatcaaggaaataactcaactcacgaagaacagagaaatgtaaggcaggccaattccccacctgggagtgacacagagccaggagaacctcccctgcctagggaagcagtgagtgattgagaaa

SEQ ID NO: 138458 - DNA, 303 bp, Homo sapiens
cccttctgtctcctgtgatccagacacctcctaagcctcctcacatgggggcccagggccaggcacatccctctgggtgtggcctgctaggaaccctcgttctgggcaccacagtcctgccaccaccgccaaagatgaccactgcctctgtgatgtgactagtactgggtttgggggtcacgcatgtgattgctgagctgtgttacccaccctgtccttgtgcagttcagctttgggggtctttggacagggcctattcactctcttcttatagaactcaggttatcttgttcttgatcaaga

SEQ ID NO: 138459 - DNA, 694 bp, Homo sapiens
acatcagtaaggactgacttacacattaagatatttcagaagttagttcaagatgaggatgaatacattttcatagggaaaataggctagcaccaagaaggtgaacttctaatatattaactgaaattatatagttagccccaacttatctactcccaaatgactttatgaaatgcctgggacaggaaatggcctgcagccttaggcacagaaggaaatggtctgtttaatacgccacgtctctaaggggcaggtgatgttccagccctagagaaaggtgagagatgaggatcttcgctcttgccccaaacattctgcggcactctgggaaggaactctgtcattcagagtcatgtcccaaaacaccctgagggacagcaaaatgtaccatttgcctctgaggtacagggatgagtgatttcagttactaagcaactcacccttctgagctggcctggcctcattctggtctgtagttgaggtgagccgggacgagtcagagcaaatatgttgcttttagaaagagaatttaggaggtcaaaaacaacagatgctggtgaggctgcagagaaaagggaacacttatacactgtttcatgagaatgtaaattagttcagctgcggtagaaagcagtttggagatttcttaaagaacttaaaacagaactaccattcaacccagcaatcccattac

SEQ ID NO: 138460 - DNA, 628 bp, Homo sapiens
aaaggaaaaattatcttaatattttagaacactgaattcagatttcaagtgtcaaatgtttgcaaaaaagtcccaatattctctgaaaacattggatttctcttatgtaaaataccatttagacagaatgaaaaaagagaactgtatttggagtgctgagaccttgaaattggaatcttcggacctggtgaaggtgtggaatccaggagttgggaaagtgctgcaaaagcttcaccagtgggtgggttaataaaaataatttcgaatatctgtgtagtgctgtgtgtcaggtactgaaccaagtatgaaatgtaatcctagaacaattcattgagaagagagttgtacttttaactacattttatagatgagcaaagctgaggcaggagaattgcttgaacccgggtggtggaggtggcagtgagcctagatcacaccattgcactccagcctgggcgacagagcgagactctgtctttaaaaaaaaaaaaaaaagtgtgtagacagtggaggagaggatttcatcctgtgtataacattttaaccttatctttgccattctctgcgatcaagcaaatcagtcaaaaacactgaattgagcgcaggacttaaaagaaggagtaagaat

SEQ ID NO: 138461 - DNA, 503 bp, Homo sapiens
gaagatgagaggggctgccccaagaaagaagacatctggtctgcaacagaaaatgttgaagtgaaaacaaaaaagaacaaacagaaaatacctggaaatggagatggtggcagtaccagtgagatgcctcagcctccttggaagaaaagggcccccgggtagatcctactcttgaaaatgaggacacattcatgaacagagttgaagctaaaaagtgaagattcctgaagagctgaaaccatggcttgttgatgactgggacttaattaccagacaaaaacatctcttttttctttctgccaggaagaatgtggattccattctccaggattatgcaaattgcaaaaaatctcgtggaaacacagataatgagtatgctgttaatgaagttgtggcagggatagaagaatacttcaatgtgatgttgggcacccagctactctgcaagtttgacagaccacagtatgctgaaattcttgcagatcaccctcatgcactcatgt

SEQ ID NO: 138462 - DNA, 521 bp, Homo sapiens
catctaacattcactcccctttcttttggtaacactatcaacaattttctttggacaaccgtgcttcctgtgccttcggtccccctgctttggattgagctgaaactatccgatttcagggacaggcatgtgatctaggtttggataatcaaaatattgaacccccctggatctacagttgttttaggaacagaaacatgcaagtttgtctcatcaaagtgaggccaagacttctataggtatttcagggagagttgctcttttttatgttatattagaaaatggcaagatgtaagtttagagttgctaaaggatgacattaggaaataactcctttgacagttaaagcaagtattaagaaaaataggctgtagaaatgcagataccaagtcctgagaatactgtttgaacccttaatattttagtaatgagttaatttttttagccaattttcttttataattcctcagttgaccgagtaattatacccacccataggattgttttgtgagttaaaggaa

SEQ ID NO: 138463 - DNA, 363 bp, Homo sapiens
tgaggacagggagggagtaactagagacaatccatccaaaaggctggccctggcaggagaagtgaatggagaggtaatgaaaggcagggtgatactgaaggcctgtgttgtttaaaatgggaaagacttaagtaggtttcagtgctcgcaggacaaagtcagtggggaataaaaagtacacggtcagagagagaaagtctttgagaaggtgagagggaagggcatggggttcagggccttggacacgaggaaggactccccttccactgaaacaggaggcaaggaaagccaggcaggtgcagattccacagggagggagtaactagagacaatccatccaaaaggctggccctgggaaaagta

SEQ ID NO: 138464 - DNA, 307 bp, Homo sapiens
tactcacaggattaaaatgaaaattcctagtggaagatcaattatatgctgcttgctctagagtaggaaaaatcttgtcaaattttatccttttgatacagccttataagttacaatgttttatacctgtctgatgctcagttccgaaatgaactgagaagtggtggttgttacaagaatttagctgaagcattaattataagcagaggttcagcctacattggcacttgtcgacctatgggacaggtctgttgctgtttcatctgatttaggtggagtatgtaattacttttgggaatccatgctt

SEQ ID NO: 138465 - DNA, 461 bp, Homo sapiens
ttttcgcgggtggctccagtacagctgctggtgacccatcttgctctcaggagtgcaacgaggtaaaagcaagaagctctattcaacgcattttttaggtaagcactgcattgggtagggtgaaaaacagacgcagaaagttctggtactcatccaaacacacaggaagacacagtcttccacccaactgtttgcacagggtcatccacaggctcctgaggggtacaagggaccccagggagacctcagggtgcactgttcacactgttcggtttttgtttctgtttttaatctttttatctccataggttattggggaacaggtggtgttcagttacatgagcaagttctttagtggggatctgtgaaattttggtgcatccatcacccgagcagtaaacaatgcaccccatttgtagtcttttatttctcacccccttcccaccctttccctctaagtc

SEQ ID NO: 138466 - DNA, 211 bp, Homo sapiens
ttttcgcgggtggctccagtacagctgctggtgacccatcttgctctcaggagtgcaacgaggtaaaagcaagaagctctattcaacgcattttttaggtaagcactgcattgggtagggtgaaaaacagacgcagaaaccgaacagtgtgaacagtgcaccctgaggtctccctggggtcccttgtacccctcaggagcctgtggatgac

SEQ ID NO: 138467 - DNA, 214 bp, Homo sapiens
tcggccagattttctatgggagatccctgtgtctcatgaagatgtgagggagggggacatttgccagtttctcatgctaaaataaatatttggtaacacaataacttcttgttaaaaatatttgaaaaaatgattatgaatataacccagaaatttatctcaggctaatctgtgtcagacttaaggcctccaaacgtgtcatagaaaatatctg

SEQ ID NO: 138468 - DNA, 377 bp, Homo sapiens
tgcctcggcctcgcaaagtgcagagattacaggcatgagacaccattcccagcccctcttattttttttataaaaaatctaggaatattcaataagtgtgagattatctgtgtgtggttttgaattacagttttctaatgaatagtttattttgaggaccttatctcttatttgttgttcgattttatggctgtgcagaattgtccgttcaggttctttgcaaaatattagattggatgcttttgctactttgtagtgttttttgtgtacatgttagatgacaactcctcgtgaattacatgattgcctgaaatttttgcctaatctataggatgctttttaatttggaaagtagttttctttgatgtgcagaaact

SEQ ID NO: 138469 - DNA, 400 bp, Homo sapiens
atgacaatactttcatacaatgtaattctatatagccattacaaataatagagcacatcaaaagatgttcgtgatatgttaaagtaagtaaattataaagtagaatgaacggcataatcctagcaactataacacatagaagcaaaaatgttaaatgtgattatctccaaatatgagattctagtagtcttgttttcctttagcatatctgcattttcctttttttccacccctgttttagtttggcttttatttaaaagtcgttttgttttttttaatttattttttgactgcttttgcggagcaggctatcctataagcagtatgctgagagtagcgtattcagaagtttttaaaatggaggttcagatacaaatgaaaaggagatccctttgacact

SEQ ID NO: 138470 - DNA, 507 bp, Homo sapiens
tgtccgctcaataaggtcgagtctccaccctcgtgggactaagctcaactgagaaacaggtattgttcttgagttgtgaggagggctgatgcagccgtgtaaatacaaatgcacacaccccttactcacgtgcacgttggagcctgtgcgtatgtagttcttctttcatcactctgccccacttcgtggctctgcttacctacatcctatcgtgcctcccgcttgtaccccatcttctttataaaacctttcctagaaaaatctctccattgttgctctcctccctccaatcttcctctgtatctctggactcccgtcacctgtggcctaagtctatgcttcccaaatccaatttcccttaagaaacaattagaaatgcttaggcctctctcctttaagtatgagccgcagtaggcttagtatgaggctatggaatctacccgtttaaagtgatcttcatggctgtgtgcggtagctcacacttgtaatcctagcactttggttggc

SEQ ID NO: 138471 - DNA, 670 bp, Homo sapiens
tacccctgagacctcctacgctggggacattggtctgaggctggaagagggcaggtgggcatcatcggcaggctggatagttctctggatcacagaaaaaggtaggtacctcttaggagcgaatagctgaagtcactgagcagctcgtggtgacaggcaggtgctggaacccactagttggggactgggcagcagccgctggcaggtcagagacttctggacacaccactaaaatttatcatcatttccctggcctctggggctcagtggttattagagcaccagatatctgtactcactcaacttctgggtgatgagactgcttccaggtggcttgtaattatgggaactcaggaagggtccagaccatgcttggggcatgcagtacccttgagagctagctacagtgggcaagggatgcccacactggggccaaggtcaggctggaggaggtggactttggcccctagggagcccccacctgacctctacttgcaccttggctgttctgacatttggataaacaagaggcgccattccttccacattcggctattgggaggaaagccagtaggacccatttgttgacatggtggaaggggtttcactgtctacttcccttgacccaggaaaagcccaaccttcactagctagtcaaggagtcccaggg

SEQ ID NO: 138472 - DNA, 386 bp, Homo sapiens
ccggcgattatcttaaaagaagttggcatgaaagctgcactccaggtcagcatgaacgatggcctctcttttatctccagttctgtcatcatcaccaccacacactgttctgacggttccatcctggccatcgccctgctgatcctgttcctgctcctagccctggctctcctctagtggttctggcccctctgctgcactgtgattatcaaggaggtccctccacctcctgcctcagcctcctgagtagctgggactacaggcatgcgccaccgctctcaaatgccatttaaaaattttcctacaaaagcataatatattaaattgtgagctagaggtagatgaagaagaaaggaaaagggcttcctcatatagccatcagaaaa

SEQ ID NO: 138473 - DNA, 570 bp, Homo sapiens
cttggctcactgcaacctctgcctcccaggttcaagcagttctcctgcctcagcctcctgagtagctgggattataggcatgtgccaccacgcccagctaattttgtatttgtagtagagacagggtttctccatgttggttaggctggtctcgaactcccgacctcaggtgatctgctcgcctcagcctcccaaagtgctgggattacaggcatgagctaccactcccagccaataaattattcttaactatagtcaccctcttgtgctattgaacactagaacatatttcttctgtctaactgtatgtttgaattaattgctgtgtatagcgtgaaacagagattcagcttcattcagatattcagctttcccaacaccatttatcgaaatactttcctgttgagtatatcttgcttttatttttaccagtttcactaggatactctttcttgtttttgaggagaagtctttctctgttgcccaggttggagtgtagtggcgcaatcttggctcactgcaacctctgcctcccagattcacgtgatttttgtgcctcagcctccagag

SEQ ID NO: 138474 - DNA, 532 bp, Homo sapiens
ctgggtggtcccacttgagtgtggacatcccaacagctccggggccatacttgggctggttaggtggcagactgctgtgaccctccgaggatccaacatcactcagcagacatgtggtgggtgaggccctgtcaatgggggccagcagcctgtgcctcctgtgacccatgctcacccacagtctgctgggactcaaggtccagggacccttctcgcccagtgacatatgtctggccctgacggtgtctgtcataaccacttatggccacagatgctttttcctgatcatagtttcttctagatgccacatgtgtatcactttataagattgtaaactactctttggaacggaaagatgtactgaaattagtcttctgaactcgtctctgataaaagccaagtctagtagaacagttggggattgggctaggcccccattcaggagcaggctgtaccgtggccttgttgcacgggaactgcctctccataccagtgagttggacgtgtgcactggggcgtctcaggaggcagc

SEQ ID NO: 138475 - DNA, 378 bp, Homo sapiens
cctggcttgctcaggtctcctgctacctggctgcccagctgtcttagctgcattctccctcacagggcgaaggccagagagagctcagaggtttcctctgagtctaaaggtagcaccacccctacctgggggccaggaggcccagctcctagtcctgactctgttccctgtttcttggtggcctcaaactacttccacttgggcttgttacatgtataaatgggtcagttggtccaaatcattggttctccaccctctttgcacatcaatcctgtgaagagttttggaaaagcttagaccccattccaaaaatggttggggctagactgggcattgggatttttttttttttaaattccccaggtgactctaatgcgc

SEQ ID NO: 138476 - DNA, 319 bp, Homo sapiens
tctttgtattatgaatattccaatcgttattctaaaaggtacaacaaattgttgctgactgtagttactttgttgtgctatcaaatattagatcttacttattctgtaattcttatttcttagtatcaccaattgccatctcaaattcatctctttatgtttttagaataaaaataaagaatagttataaatgtaaagaaacaataagtgatgtaactaggtagacataatgatgacaaaacagtgacaatgttaagttctggatatatattatctcatttattcctggcagtagtcctgtgaaacaagtattattagt

SEQ ID NO: 138477 - DNA, 759 bp, Homo sapiens
cccaggttggtcttgaactcctgggctcaagctatccttcccactcaacctcccaaagtgctgggattgtaggcatgagccaccatacccagctgataaatggcgtcgttgatagttttaagagaattctgagttgtttagatcaaatggattttaaaacatcatataaatatgacatgcaacacataaacacaaacatccaagtaaggaaaacaacaaaaaattaataaaagggtggctaagctgtgagtttaggaaaatgcatagtctacagcaaagctcagaaattctaatctctgatttttagtcatctctggaaatgaatactttccattaatttggagctccattttaatattaatattactgcttatattcccctcttagggaaatagaaacaatgttatatttatggataaataccatatttctttttttgtctttcttcaagcttttttgatttgtgaattaatcttaagtttttcagaattatgtataattctaatattaaaaggatgatattttttctaaattggtttagttttcacatcctttttaaggctggcacttttgcagatagtaccatcttaagtaggccacagctttgattcttgataaatacctcacttactgaacacttcttacatgccaggcactgtgctaaatgcttttcagctattagctccttccagcctcacaataaccctgtgaggtagatactcttattaaccccatttcacagagaaaacagctgaggtg

SEQ ID NO: 138478 - DNA, 311 bp, Homo sapiens
tgacgggatttcagttatattacgatttctggttttaataaactaaagagacaagtgctttttaggcaaaaatccttagatttctatggagacagactgtttttttatcatcttattaaataacctattgcacactgattacatttattcttactattttctttattttttcctggatcattttcgcaattttatttttcacggcgttctcaatacttttcttcatgtttccttaatgttctgtatatagtccgaattctgtagcgacctctttagaagctctttattaatacctagctgaataatctcaa

SEQ ID NO: 138479 - DNA, 442 bp, Homo sapiens
tggcgtttctgttgactgctcaaactctttccttcatttcctgctcattggctgcattctggatggtggagactgctgaagagctcagtgctgggggtgtgagctgttctccaagcattttaggatgtagtggtaatacaggttatgcatatgaggaggtgggggaagatgtagggataaacatgtgatctcgttgagagaatgtggctggtcacttctcagttctgatctcacaggtgttttagagaagtgacctaattgtgctggactcctcctttttgtgacctagcaacctgttaccttcagggagcactaggagcattggttgctgttgaacagttctcacaataccaggatggagggctctcacccacagaagcacaggcctgcaggagcctaggtgacttgggttgtccttatgacttaggataccaggatctaa

SEQ ID NO: 138480 - DNA, 392 bp, Homo sapiens
gttcattgtactgggagaataaattggtacagccactttgaggaggaaagtggcctatctggtgaaactaaagatctgtgtacttcctggcacagcacttctaagcctgggcataacccccaaagctgaaatcagtaaactatagcccacagcctggaccttgtttttgtaaagtacgttttattgaatacagccacacatgctcatttacatggtctaatgctgcggctgcattcatgccacatcggcagaattcaatagttgcaagagaccatctggctcaaaaagcctgaagtatttttatctggccctttacagaaagtggcctgattcttgctggaagagacactggctcttaaatttagaggaccatgagtacaacctgccggtgg

SEQ ID NO: 138481 - DNA, 566 bp, Homo sapiens
agtcacattttcctggatggtgttgatgctagtagatgttctttggtgtctgggcacagaagagttaggcattaattgcagtcttcactgtttgagcttgtttgtaccaattcttcttgggaagacttcccagatatttaaaagaatttgagggttgtgatctaagctgtatctgctttaggaggcacacttagcccagtaatgccatggttcttgcagactcatagaggtacgccttgatgatcttggacaaaatctgagaaaattgtgtagattaccaggcagagactcgttctcttcccttactttctctcaaacaagcaaagtgtctctgtgttgtgacctaaactaggggtgggtggagtgacagaatcaccccttttgccaccaccactatgactgtgcagggtcagacctgaagctgacacaatactgggtgttgcccaatgcctgctataaccactccctggctactccctttgtttgctcaaggccctggggatgtaaaatgagcaggtagcaaagccagtcaggtctgtgtctttccctttagggtggtgagggcc

SEQ ID NO: 138482 - DNA, 375 bp, Homo sapiens
agaggcagaggtctgtctagaatatgttgagcttttgaggggcttacgggaagagtgtggatagacttggccgataggcggcccctccggatgtggacttccaggcagagctcggaggggcagaattagagacgtcagtagctcgtggggctgggggtgggattaaaaccaaggtgggagcaggtgccccaaacccaggagaggtgctcatgcgcaggatggacaaaccagtctccagcaagagcccgaggaagtcgggtcataccccatttttgcggagatttaggatagagccctgtgaaacccctaagtttaggatataggtcaaacttaggaggtcccgaagagggcagagaaggtgggagaaaagccagg

SEQ ID NO: 138483 - DNA, 917 bp, Homo sapiens
  misc_feature (53)..(53): n is a, c, g, or t
gcttggtaccggtcctggcctcgcggttaattgagccgggactcgcgggcggngggcggggcgtcgctgcgcggctggccggtgaggccgcggcatggggcgagtgcagctcttcgagatcagcctgagccacggccgcgtcgtctacagccccggggagccgttggctgggaccgtgcgcgtgcgcctgggggcaccgctgccgttccgagccatccgggtgacctgcataggttcctgcggggtctccaacaaggctaatgacacagcgtgggtagtggaggagggttacttcaacagttccctgtcgctggcagacaaggggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgagcaacccaacgtggcctctgccaccaagaagttctcctacaagctggtgaagacgggcagcgtggtcctcacagccagcactgatctccgcggctatgtggtggggcaggcactgcagctgcatgccgaccgttgagaaccagtcaggcaaggacaccagccctgtggtggccagtctgctgcagaaagtgtcctataaggccaagcgctggatccacgacgtacggaccattgcggaggtggaggtgtgcgggcgtcaaggcctggcgggggcgcaggtggcacgagcagatctggtgcctgccttgcccagtcggcctgcgggcttgagctcatccaattgactactaatttaagggttctctgaaggcgccggaagctacggtgac

SEQ ID NO: 138484 - DNA, 827 bp, Homo sapiens
agtaagcttcctggagtgtggacgggtccttccctgcctgactgacttgtccacagggcaggaagaagatgcgccccttggtgtgtcccgagtgtctcctgtaggcagctgagctttcgcagccatccgggtgacctgcataggttcctgcggggtctccaacaaggctaatgacacagcgtgggtagtggaggagggttacttcaacagttccctgtcgctggcagacaaggggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgagcaacccaacgtggcctctgccaccaagaagttctcctacaagctggtgaagacgggcagcgtggtcctcacagccagcactgatctccgcggctatgtggtggggcaggcactgcagctgcatgccgaccgttgagaaccagtcaggcaaggacaccagccctgtggtggccagtctgctgcagaaagtgtcctataaggccaagcgctggatccacgacgtacggaccattgcggaggtggaggtgtgcgggcgtcaaggcctggcgggggcgcaggtggcacgagcagatctggtgcctgccttgcccagtcggcctgcgggcttgagctcatccaattgactactaatttaagggttctctgaaggcgccggaagctacggtgac

SEQ ID NO: 138485 - DNA, 1370 bp, Homo sapiens
  misc_feature (53)..(53): n is a, c, g, or t
gcttggtaccggtcctggcctcgcggttaattgagccgggactcgcgggcggngggcggggcgtcgctgcgcggctggccggtgaggccgcggcatggggcgagtgcagctcttcgagatcagcctgagccacggccgcgtcgtctacagccccggggagccgttggctgggaccgtgcgcgtgcgcctgggggcaccgctgccgttccgagccatccgggtgacctgcataggttcctgcggggtctccaacaaggctaatgacacagcgtgggtagtggaggagggttacttcaacagttccctgtcgctggcagacaagggtaagtttgggagccagttcccgagtggtgacccctgggggcagcccttggagtggggcctgtctgtcctgtcctccccctttcctagatctgcctcttggatctggcactggcccatcttgtcccagggttgtgggccctgatggctttctcataggcgctgggtggctgaaggggccacctcccccttgtgctggatttgggtgggctctgacccctggcacagctgtttcacccttgccccattcccaaaccactctcctgttcaagccaagctcttatcctcagtccttcacccaagccacagacctgtgctgctgtggcgctggtgactgagacagggagacccagtgtgagctggtcagctgcagtgcccactcttatcctggccctgtggccacctcaggccacctcagggggggactgccccccacctccctcctgtctctgcagggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgagcaacccaacgtggcctctgccaccaagaagttctcctacaagctggtgaagacgggcagcgtggtcctcacagccagcactgatctccgcggctatgtggtggggcaggcactgcagctgcatgccgaccgttgagaaccagtcaggcaaggacaccagccctgtggtggccagtctgctgcagaaagtgtcctataaggccaagcgctggatccacgacgtacggaccattgcggaggtggaggtgtgcgggcgtcaaggcctggcgggggcgcaggtggcacgagcagatctggtgcctgccttgcccagtcggcctgcgggcttgagctcatccaattgactactaatttaagggttctctgaaggcgccggaagctacggtgac

SEQ ID NO: 138486 - DNA, 520 bp, Homo sapiens
atagagatgaagcacagctttaaactcaacctggctgaatatctttcttttccttttctggggggcatagtgacttgtgagggagtagaaaatggctataagttccttgaaacttgttgctgctcaacctctataaagttctagcctttttttctcattatccttattttccctggtttatttggaaactcctatccaaacaaatcaaagctcattgtattcacaagtaagtaaatactgtgtttttagctcctatctcagaattaaactttttgaactttatttcaattttaaaaaagaacatgacatacttgcctctaccaaaaagtaatctaccaatcaactacataaaacataggaatcactgaagaggcagtttcccagcagttagttaaaatcaagctggtgactctgactctgtcctagcaactggtggacaggtttccagtgcaatcttttccctaacaacacaaggcgggtggctggcatacttgtcattccttatatgccctggacagtg

SEQ ID NO: 138487 - DNA, 506 bp, Homo sapiens
gataggcaggaccatagagctcccaaaagtttatgtcctttgtgttaagctaccagggcaggtggagatgcatagccaggcagggcctatctcaggtggatcagcactctgactctccatttgtggggcaagctgcagcccttttgggggttgggggcagttctcaagccactgaggtaataatgttccagtggagagcacaactgacttggctacacagaagagttcacgcaaggaatggggaatagcaggcagcaggaagcctcacccagattccatgcagttggcaaggcagctctcactcccacagtgctctgctaatagtactggactaagtctcaggtatcctgcactgagaacccaaacttgccccaggccataagctttccctgcagagacagcaacagaggctttcagaccatgtcactccccatctgcctcacaaggccaggcacccagctcctgcactcatgcctgcagtgtacttcccactagccccaccaagt

SEQ ID NO: 138488 - DNA, 317 bp, Homo sapiens
ggactgagcttggtgtatttgagaagtggctggagtggagtgagccaaggggagagtgctagaaggtgaaggcaaaggcttaagcctcgagggctacagaaaagagtttagattttttttggagtgtaatgggaagctcttggaaggctatgagcagaaaaagtgatactgtcttctctacacctttaaagattactcacactgctatgtagcaaacggattgtaaggggcaagggcggaggaagcagggagaccagtttgggaggcaagtgcatcatctaggtacaaaggcaacacaagctagtgtggtatctagt

SEQ ID NO: 138489 - DNA, 459 bp, Homo sapiens
agaaggcgggaaatataaacaggcgtggaaagaaatcagtcaattttgcccgggcgcggtggctcacgcctgtaatcccagcactttgggaggccgagaaaggttaaaatgacttgcccaaggtcaaacagctattccactggatttgtaatggtagaggagtgcctctggctggctcactgacgtggagacaggtagcacccattggtgcgttattactgtgttttcctacgattttcagagtccctcatctgcaaatccctttcacagatcttgaccctagcaactatgctggaaggcagctaggaccatggttgagatccagccctatgcccctccactgtcttcctgctgttgcctttttgctatttttctgatcattatcacatttcccagggagaaggcgggaaatataaacaggcgtggaaagaaatcagtcaattttgcccgggcgcggtg

SEQ ID NO: 138490 - DNA, 373 bp, Homo sapiens
gggcggcatgcagcctggctgtgggtgactggtgtgccctggggaggcccctgtctcttagagcttcccactgcccatctgtaaaacgggagaaaagggtctgcccgaggctgtgcagggctctggggaacaactcgaggaagccccgagctgcctgcccaggctccatcaatacccaccagacttaatctttgccgttgttgttgttgtagagacagggtcttactgtgttgcccaggttggtctcatactcttgggctcaagcgattccaaagtactgggattataagtgtgagccaccatgtcctgccccaccaggctttaaatgctctgtggaagtttggtctttaccataaggcctgctgcagacttc

SEQ ID NO: 138491 - DNA, 231 bp, Homo sapiens
ctacgtttgaactgtgtgcttgtttgcctctctatcccctctatttaagctcttaaaatacaagtctatttctttgcctgcctacctgtctgctctgtccttgcctctctctcttttggaatttgttgttttaaacatctttattgagatacaactgatatacaaagaactacatgtatttaatatgtatgatttgatgaatttggatgtctttgttatattctaaatggg

SEQ ID NO: 138492 - DNA, 792 bp, Homo sapiens
gcgattctcctgcctcagcctcccgagtagctgggattagaggcactcgccaccatacctggataatttttgtatttttagtagagacagtgtttcaccatgttggccaggcaggtctcgaactcctgaccccaggtgatccgcctgccttggcctcccaaagtgctgggtgggattacaggcatgagccaccacaccaggcctagttggtttttttaaagtggaaaaacagttgttttcctaaacattgtggctaattttaattaaaaacagaatggaggaatgaatatgcagtggaaatactaaaatcactgtttaaagtcattgcttggtgtttaaaaatctataaaaatgtgaaatttacaatttttcatcaaaattctattcagacagtcttttttgggggttggggttaagagatgaggtctctttctgttgtatagactggacttgaactggtctcaagtgatcctcctgcctcagcctacctggtagctgggattacaggcacccagccaggtataatgttagtggaatagacccctgctgctatgccctattctaaccatctccatcacaaataattaaagtggatattaatcatatttacctaagatggagtacatcttagttaagtagaatacaacttctagtttggttcagtaagattaaattgtatttatttttttgtttgttccataggtttagtgcagaagttacttttttgtggtaaatgaatttatgattttttatgtttcataattttagtgaaaattcttgtgtggtaattaa

SEQ ID NO: 138493 - DNA, 367 bp, Homo sapiens
tgtcccaagaaagttctctcatgctctcacccaatcattatcagaaacaactgctatctgacttccatccacattgattagttttgcttatttctgaacttcatataaatggaatcacattgcatgttctctcttatgtctggcttctttcactcaacataatgtccatgagacacttattaattttgctgctggagctaagagccaaagaatgtagtgattcctactctagaatactaataggcttgcagagtgtgttcccaagagacctacaggtcccactaagccgggaaggaaacggaatcggggtctaactggggccgggagatgtttacccctgatttatctgattcagctctttatctct

SEQ ID NO: 138494 - DNA, 240 bp, Homo sapiens
cctgtggtgtgtgcatggtttggggcgaggcaaaattttaagttagaggccattaaaagagagcaacaattaagtaatgttttaactacagaaataacactagaaagaaagctattttctcaaaacattttatagttgaatttccttggatttgggggctaattggacatgacatctaatcaacaggaaggggttgaagagatgactcaagggagtctccaagggagagatcctagaaag

SEQ ID NO: 138495 - DNA, 385 bp, Homo sapiens
tatagttggaggttgcatcgcagtggtggtgtctgctaagacagaactctggctctgctgtattcattcatttacagattcattcatcggtgacttcaacggctggtttaagggaacattgaccacacccattttattaccatcatttcctttagaaaatccagtttccattcaagcccgctaatctccaattccaactagatgatcacctctaagtcacttttatatcaaaattctagagatactggccaggtgcggtggctcacgccattgcactccagcctgggtgacagagcaagactccgtctagaaaaaaaattctaggctgagcacggtggctcacgcctgtaatcccagcactttgggaggccaaggcgggtggatc

SEQ ID NO: 138496 - DNA, 437 bp, Homo sapiens
gaacattttcaggtctaattctgccatttgacaaccttttgactacgtggaaagtggctaccacattgtacattctaatttgagggaaggaatgaatgatttctttgcagagaagcagctggtacatagaaaggagcaggacaagttcattctgtctttgaagattaggcagaattataatgcctgtgctcagaaatgcctaattcagccaagtcttcttctatctcttggtaaagtgcactgccaagttagaaaggagccagctccaccacccttcctacgtctgatcctccagacacatatttgctaaagaaagagccatggtcctatccgtaatgttcaggaagggcagattggcatatcaggtgagcctggtactctgctcacctacaagtctcatgcttggtgggacacttggggccatggctgcagagcta

SEQ ID NO: 138497 - DNA, 688 bp, Homo sapiens
tttctcttaacaaaataagtggtgatggctcttatttagaaacctgcacagccatccaaatgatatgatatggcccctgggcaaaagtttctctgtactatacttaaggcaatgccactttccaaattcatttcagtgttatttacagaaagggctcctaaattttgtgtaatattttgaaatgattggttgaaaggggccatatcttgatgaaagcactgaaattgttttaatgttctctggtctttaatgaaaactctatctgctttttcaaagatcacaaagttaacaaggcacttctgagacagttttaccttgttatctaggtaaggttatgagaaaacaccatttaataccaaattctcaaggtaataatactcatattagctagttaataatggattcatacagtttagatatgtgaatatcatgatttatcacataccaatgactttaactatgttcttttgcagatgaagcagggaggcaaatattatgatcaaagtgtttggcttctggagagctggcacagggataaggggaatatttctaaataggttttccaaattttggcaagaacgtggcttagcgcaagttcaaacatacaccagattcacttactccacaaacttgatacgtacatttatacctacaccattatcattaagaaatacaatgggactaccgt

SEQ ID NO: 138498 - DNA, 247 bp, Homo sapiens
agaaactgcagcagggatagctcctgtcacacaaccctacccttatgccctgaaagcctcctcctaagggatatacagggctttttctggcatcagaacttttagactccatgtcaagtctgtagtaaatcaacaaagagaaaaatcagagtacaatcacaacaaagacagacagctatcctttcaaagaccttagagccctctgcctcccctctctatggaaagtccagtactggccagaatacta

SEQ ID NO: 138499 - DNA, 381 bp, Homo sapiens
aataaataaataggccaggcgcagtggctcacacctgtaatcccagcactttgggaggccgaggcgggcggatcatgaggtcaggagtttgagaccagcctggccaagatggtgaaaccccatctctactaaaaatacaaacattagccaggtgcggtggcaggcacctgtaatcccagctacttgggaggctgaggcagaagaattgctcgaaccagggaggtggaggttgcagtgagccaagattgcgccaccgcaatctagcctgggcgacagagcaagactccatctcaaaaaaagaaaaaaaaaaagaaaagaagatgctagagtcacctagggacctaactgccctctttcctgtaagaaacagagacccagaag

SEQ ID NO: 138500 - DNA, 111 bp, Homo sapiens
cagaaacggcacactttggctattcaataattatttggtgaataactgacagaatagaacagaaaatgctatcccagccaggcgcggtggctcacgcctgtaatcccagca

SEQ ID NO: 138501 - DNA, 250 bp, Homo sapiens
ggtctgaggcgactcatagaggatcccccggggacccttaaccctggcttgtagacaggcaccttcttgcttgtgtcctcgcaatgttagagactggtctctctctccttataaggccacagtcctattagattaggccctgactgttatcacttcataacgtaaattacttctgaaacaacctatctccagatacaatcatgctagggattagggcttcaacactattaatcagcgaggtcacaggctg

SEQ ID NO: 138502 - DNA, 263 bp, Homo sapiens
acagaaaatgattttttagaagtcagaactatgacatgaagtcaagcagggcactctaggactgaatttgctgtgctgccttcatacgctccttgctcgctcttttctggcagctgtgactcacacaggtcatggagagtatcattccctaaaaggaacaactccgatattcatctttatccattaagttcatctgtcccattctatgtctgtggatgctaacttttgatcattgatggtgatacacatggacatttatcatc

SEQ ID NO: 138503 - DNA, 363 bp, Homo sapiens
ggtccattttcatacccagatgtggaagaggtggggaaacagggctcagggagaagagctgaaaggctctcctttccctgcctcatctgagtctcctgtggcacctgctgactgtggagaaactcaggaagagcaggactagtctctgcccctcaggggtggtgggatctgagactcttggaagactgggaatcttttcctgtcaaccatcaatagatatactggtttatgtttatcgaagcctggaagtgggaacatctactccgctgtacacagtttttcatcatcattgtcatctcatctcagcctggaacatctgctgtgccccaaagcatgcagacttgtgtggcagaaaaatagggg

SEQ ID NO: 138504 - DNA, 501 bp, Homo sapiens
atagtcttttaatgttttattaaaagcataaaacaatcgtgtggggtagctactactttcatcctcattttacagttgagaaagtggaggattagagacacaagatggtttgtccatgtcatatcagtaagaacagagtgaagatggcaacccaggtccccccggcccccaggcctccttctgaatctccagtcctctcccgcctgctaggagccttgtcctgggagggcagagtcttttatttatttatttattttgagacagagtttcactcttgtcacccaggctggagtgcagtggtgtgatctcggctcactgcaacctctgcctccaggttcaagcgattctcctgcctcagcctcccaagtagctgggattgcaggcacctgctgccacgcctggctaatttttatatttttagcagagacggggtttcaccatgttggccaggctggcctcgaattcctgacctcaggtgatccacctgcctgggcttcccaa

SEQ ID NO: 138505 - DNA, 300 bp, Homo sapiens
catgcctggggccagcagtttttcccactgttgctttgtgcacaaagtcaacacagtggaaaaaggcaaattgtgtcatcttactactatgaaaatagttttgaattccctaaaaggatctggggactcttaggggttggtggactactctgaggaccggtgaaccagagaggagcgccagggtcctgtcttagcatgacgtcctgatcatcaagcgtgtccagtggagatgccctttatacctgtggtgtgagggagatggcttggacctgcttcactgccaagggcattgctgcaaac

SEQ ID NO: 138506 - DNA, 555 bp, Homo sapiens
tacataagcatagccttggccactctctttcttagaatctacaataattataattccttagaatctacgaggctcagggcttgatctattccaacaaagatgtcgcctcagaacagtggctcaatttaaagctagaacaaagatatttctaagaggctgtgaatggtttaggcccagacccaatgagctccaacttgcaaagaaaaatttcaatataaaggaaactttctactaattagaggttcttcaatatggaataacattattcccaaagcttcaggagagagtacattgaagcacagcccatcaaggatgtgagagaaaaatgctctacagagtagaaaactgagctagaagaagttaaagttcttcccaaattagaaaatcaaagagaacaatgattgaagagagtcactccaaccaacatttgaatgttaaatcatagatcctatgtatttgtttaagaactgaattcctaatgctacccctttcccatgtactagaacacttagtcactcatttgctgatcaacaacacctctcaggcaagaaagtt

SEQ ID NO: 138507 - DNA, 370 bp, Homo sapiens
ctgcctcagcctcccaagtagctgggatgacaagcacgtaccaccacgtctggctaatttttttatttttttgtagaggtggggttttaccatgtcactcagactggtctcaaactcctggactcaagcaatctgcctgtcttggcctcccaaagtgctgggattacaggcatgcgccaccacacctggctatgctgtcttaagagacacactttgaatatatagagaccaaaaaagtgaaaataaaaggatagagaaatatatatttaatagagataagaaggtgaaatataaaccagaataagaacaaacaagaaagctgatgtggttgtattcatatcaaacaaagtaggcatcaagataaggagta

SEQ ID NO: 138508 - DNA, 160 bp, Homo sapiens
gtgatctgttctatcagcctgcccgctgctagagaggccgaggtggtccggccagccgtgcgctgctgctggtgtctctgtgggcatgacctggtgagatatcattctgcatctgggggtccatcctatcagccctgtgttctagattccccagtgactg

SEQ ID NO: 138509 - DNA, 171 bp, Homo sapiens
ttacacatttttaaagaattaaaacagaaggtacaaatgatgtttttccacatttaacttttagccaatctctgaattcagcatttcatatattaatccctttataggaattagcttaaatatagtttcactaaataataagtaatgccatcactgactttaaaaatcagt

SEQ ID NO: 138510 - DNA, 430 bp, Homo sapiens
tttttgcagaatcctagagcagcccccagcggctcagagcagttgctgcctttgcagggtgatcccagtcagggtctctgagtgcccctgcatccacctgagagcacactcacacctgcttctgccccgcaattgctatatataactttgactgccagtgtcaccccaggtttgtgcctctttagcagtgtgacctggcacaaattccttagctgcttctccctctagctgtaaagtaaagcgactgtcatggagccacccagccgtgctgcagttggctgctttcaacaaaccaatgcctgtccagtgctcagaaaaaggtgtggcacccagcatactaacactcaccatcatcaccatcatcattgctactaccatcattgtcaccatcaccaccatcgccatcactatcactatcatcaccaccacc

SEQ ID NO: 138511 - DNA, 393 bp, Homo sapiens
ggtcctaggggttaggacttcaacatctcttttttgaggaaacacagttcagcctgtggtgatggggaaactggactcacacccctgtctaggagccccccgaatcccctgctctcagcctggctgagctgctctgctgggagtcaggtctgagtgctttgctcaagttgttagccaagtccgttacagggttaatagcttcatagttaggggtcctcagaggtaacgggtccccgtggcacttgtcctatttccaaagaaccccacggcagctccacacattcccatgggaagactgcacagtctacccctgcaaacatcttgctcttagctaaaattgtgtctgtcagtgtagtcactggttatcacgtgggaacgggactcaggacccat

SEQ ID NO: 138512 - DNA, 328 bp, Homo sapiens
atttttcattctgagataagcagtttttttgtgggggcgggggaggtggagaggagccagcttcactctctgttcatgcgagttttgaatgaaatgagtaaagttcatgttccccccagagtacacaaggttcaagtgggattacccagtgggaatccagcccgattgtaatttaacttgttcgagggatctaaatatttaatctgccttcatcacgaatcctagaatcctatgtaagcagcaaaggccgagggtctgaaagtaaacactgcagttagaatcagaagtgttgcaactagcacaactgctgctgtgacgtcctacaaac

SEQ ID NO: 138513 - DNA, 177 bp, Homo sapiens
tccaaactgttcctacaaggatatttctaaaatgcagatacatcactcttcttcataaatcctcattaattttagtataaatgtaaacacctattcggattaaaaaagcccttcatgatcctagctgtgattttcttgctcccccttgctatatttattctgggctccagtatgcaa

SEQ ID NO: 138514 - DNA, 450 bp, Homo sapiens
taagaggcactgggaatatggtgttggcaagtggaacagactacaattttaagaggtcggtcagggtaagtctcattgagaaggtgacatttgacaaaagttttaaggaagtgagggaattagtcatatgggtatctggagaaagcatactccagacagaggacttagctactatgtgcttctggtagtcctgtggctggtgcagagtgagcaaagaagagtgtagaagatcagattcaagaaccaacgaggccccagctcacggaggtcttgatggtcactctaagattttggcttttactctaagaacaaagaggagccattacagggctctgaacagagcagtgactgatatagttccaatgaattcgctgttgctatgctatgtagaaaacagacctaagaggggaggggtgaaagcaagtagatctgagaggaggccacagcagt

SEQ ID NO: 138515 - DNA, 397 bp, Homo sapiens
tctctaacataaaattatttcccagcagtaacatttaaataatcttaatgatatcaaatgtcacctaaaaaaggaaaaataatgcatatcttttttagtgttataaatttagatgagataatgtatgtagtgtgcaaatccaagtcctagcgtataatacagctcagataattgcacttgaatatgagtagatttgataattttacaataattaattcattgtctttaataattgagaaaatgtgctacatttgatatgtatgtttttgggggaacaaggaaaacttattctttacttaaattctttaaagataactaggcatcagttgtcttttactaaaagaactttaaggtccccttgagcttcagaagctacaattttattatgggaactact

SEQ ID NO: 138516 - DNA, 485 bp, Homo sapiens
gcccctttcatcatgcagggcttggctcagaactcaccttctggagaggccttccttgaccccccagcttatatagcacttgcccaaacgctggaaaacccagcacactcaggttactcttatgaccttttaataagctcttactatagtgccaagcattgtattaaatgcttacatgcattatctcattaacctcggaaccactgaaggaggcattctaatcatccccattttatgcaacaggaaatggaggctaagagaggtcaagcctaaagtcattcagcttgcactaaggtctgattctagaattagggctcttaaccattagattcagctgattcagctgcttctcactttaaattctgttctgagttatggattatatggcttccaggagtttaatttacaggactgattggtttctattgcacttgtgtttgagcaggtaaagtaactcaggtgtatcagtgtgtgctagggaggga

SEQ ID NO: 138517 - DNA, 509 bp, Homo sapiens
aaattctatcaatcgaagtttgaatagatattgttgaaaaagtaaaatgctgtaattgttaataattgtgaagttgctgattttatgtaccaaagcaattatgtaagagtgttcaaatagttaaatagtgaatcagattgcatttgaacattaagagtgtggtagctagctaaatagaggaatagctgggtcctttcttgtgaaaagtgagtttttgataatccgtgagtcctagtcgtaggtaatgcaaaatgaggtagcgaggagctttatttagatgagttataaaatccacaaattattttgaatataacacacttggtttcagtgcccaatatttcacttgttcaagaaaggaaaaagtatctctatgaatctaagaagcagattgactgacaccaaactcttcaatgtgatccaaaatagacacttaaaatacagaatcttctcaggtcccaacgtagtatacctgcagtgcctgaatatggccctgtagtacctgcttattg

SEQ ID NO: 138518 - DNA, 437 bp, Homo sapiens
tgagctcaggagttggagaccagcctgggcaacatagcgagaccccatgtctgtttcacacagcacaggtctgatctgtttttgctttcactgtcatcatttcgtattgtcatgatgcagcgtctcccttagagggccagaagaacattcaggtctctgaaagtgtgtagtagaagactagcatctgttttactgcttccaaagagagtattattttgtttttgaccctagcatgacctccctttattgcacctaatcacatcacccaccttctgagagcaccatgcctttttgttggtgttaccttttaccagcagaaaacatcgacgtgtacctatgtgagaggtatctttatgaagcccatggagaagactgttttctctgtgtcttctgatgttgtttgtttgtgtgtttgtttttgagacagtctcactctc

SEQ ID NO: 138519 - DNA, 556 bp, Homo sapiens
catgaactgtgcccatgtgagatggtgaacttaattgatatgtgttgtgtatgttctgattactgctctgatcgtctctgcctgctcaggctgccctaggccctgagacacaacaatattgaaatcaggccaattaataaccctacaatgtcttctaaatgttcaagtgacacttggacgtctctcactttaaatcaaaagctagaaatgattaagcttagtgaggaaggcaggcgtgtcagaagctgagataggctgcacggtaggcctcttggaccaaacacttagccaagttgtgactgcaaaggaaaagttcttgaaattaagtgttactccagtgaacacaaatgattagaaagccttattgctgataggaaaaaaactttgctctaggtagaagatcaagccagccaaaatactcccttaagcccaggcttaatacagagcaaggccctctgttcaactctgtgaatgctgagagaggtgaggaagcagcagaataaaagtttaaagctagcagagttcagctcatgaggtttaagggaagaagctgtct

SEQ ID NO: 138520 - DNA, 271 bp, Homo sapiens
ttttattttatttttttgtaaagaagaggtctcaccatgttgcccagcctgttcttgaactcctggctcaagcaattctcctgcctcggcctcccaaagtgctgaaattacaagcgtgagccatcatgcctgaccttaatttgatctttcaggagcagaacatgcctgttttttcttgtgttttatttaataaaaagaacatactaaacttatgtaaggacttaccaagaaggataattgaaattctggtgtctttagacaaaaaagctaa

SEQ ID NO: 138521 - DNA, 216 bp, Homo sapiens
caagctttggagccttctaagctggagctactgtgtcattcccattgtcacttccttctgtctggacgttcccattgtccagatctgttcagaggcttcactctcagcctccttccccccccctccatttccatcttctccaaagcttcagagaaatgacctgcagcttattctccagtgacagtggcagtcccctgtctagtccacgcccttctt

SEQ ID NO: 138522 - DNA, 266 bp, Homo sapiens
tggcatcttctgcctgtttttctattgggctgcatgtctggctggctgtctccctttctttctttaagtaaacattttattttgaaataattttaaatttacagaaaagttgcaaagtagtacagagaactcttatatacccttcatccagttttcccacaatgttaacatcttatgtcaccatggcacgtttgtcatataaagaaattaatgttggtacaatgctgttaacaaagttgtagactatctgggtttcaccacttttt

SEQ ID NO: 138523 - DNA, 376 bp, Homo sapiens
ggcaaacatcagctccagcccgcaagggcatgcttataacattggaaaccctaaagtggtgggtggcagggcaggagcaaggtctgcagagtgtaaggctatatacactctagccactctgcaaattccataaacaaaagattgcagggaaagccgggcacagtggtgcatctccacatcagcctctgcaactgggactccctggaatatgagattctcagcttactcattttcatatattcactgccaatactaggcccagaacatggtaggggctcgataaatacttgttgaatacaaaataaagttcatagaaaatatgccaactgccaacattggcatttacagacctagtacaatgcttaatacatagcag

SEQ ID NO: 138524 - DNA, 534 bp, Homo sapiens
taaagacagggtctcactgtgttacccaggctagtctctaagtcctggcctcaagtgatcctgaaggtatttttgaagtaaagatgattcagtaagttatactggaacaattagttaactggaaaaaaaatcaagtcatctctgcctcaagtcaacataaaatatagatagatcaaaaagataaatatttagataaattatttaaaaaataaaagaaaatatagataagttatctgtttaaacagtgaaagcgtatactgcaattaccattatgtttgtaattgcaagaaacttgtaaattaattgacatgattagacatcttaacgatatttgtttattctattcagaaatatggaagggaacatgagtcaggcatggtgattcatgccttagttccacctgcttgggaggctgagctgggagaatcacatgaacccaggagtttgaaaccagcctgcgcaacatagctagatcccgcctctaaaaaaataaaaataaaataaatagactggaacatgaagcatataaagggc

SEQ ID NO: 138525 - DNA, 588 bp, Homo sapiens
gaacgtggcacgagagagagaaattatgagattgacagagagagagagagagagagagaaagagaaagagagagagaaagagaaagagacagagaaaagaaactatgttgtttaaaatgccagcggaaagtccatgggggtgaaagagtccggcaatggccagggagttagcagcttggcgtagtgtcttcccactgttttgtctgtcttgagaatagcattcaacgcgactgtgttcccgcagcagacgttaggccgctgcccacgccttgagtgccggacgaggtcaacataggctttccgtcacagaatatgtttgggcaggaagatcggaacacttggggctgggccatctaccgctcccccacggcacacacgagtcgtcagggaaatgcccgcctctgtgtgtgttgtacgtgcagccttctgggcagagccgtggagagttggacgtaggccaggtgtgaggaggagaggtgtgtttggggtggccactggctcccttcctgcgtgacgtaggctggcgtgggctcttcccccagccccttgccggtgctgccacgtgagaagggcccgggtgccggtccc

SEQ ID NO: 138526 - DNA, 270 bp, Homo sapiens
cagaacaagcaaagatcattaaatggactcatcactaatataaagcctcccagccaactggaaggtcctgtgactattccttcacttgtgtctgttgagtagtttaaaatgtgttgtttggtggtattattgatttttggcttggctgtctctttttgctccaaaccaggatagtttgtgtctacatgacagggcttcaccaaatgttctcatgaattgcgcttcacctcctaaagtgtttctgaaactaactccaaataaaatttcaag

SEQ ID NO: 138527 - DNA, 486 bp, Homo sapiens
cccctgccctggcatttgggagtggggaggaaacggctccatcagaaacagctctaccattggaccttaggccagccacacttcttgttggagcttgtgtcctcagctgtactggggatgagagctagctgtctgggtcagcggcactgaggctccaggggagcatgtggtctgtgcagcaggcttggggagtgctgagcagcacagattgggtttcatagcacagtgggagcccagacaggccagctagccataagcacctctgctggaggaagaggtggactctcttgggctggagggcccagttcaaggaaagaaacaaacagctacactgggctccttgatcacccagctgtggcagttcttcttgaggacttcctgcccctaggtgggggctgccttcagctccctgctgcgtgtgataacttgggtgtggccctcacagctgtgcagaagctattcccagagggttctggccccaggtaa

SEQ ID NO: 138528 - DNA, 517 bp, Homo sapiens
tgggtgctctttccttccacttatttatgctttaaacaacagttacggtaaatataacgatagaaaagtgcctacagtggacaggaagatgatcaagaagtcctgatatacagcaatccacgttgcttctttacaatcactaacgaatcttaactggagccatgttccgttcccatgtgagtgataagcaatgatttattatgaagtgtcatgaaaccggaatgccatacagtgagccatgagctagtggaaaatgttttccctgtttcccaacctcattactcaaagatgcagtgtccctttaccaagcctaatttaactgacttttttgagcactctactcattggcaatggaaagtggccaattcgaagatgtccaggaaagcctggtacccaatgccacagcactggtccatatggtgtctgagctggccgacaatgctggaactgtgcaaactggccagtctccagaagtacaatcccaagaatcagctcagctctctgccaaagcagcaaa

SEQ ID NO: 138529 - DNA, 143 bp, Homo sapiens
agttcagacaggaaaagctcttagaatattaccctacacagttacctcctcatgtgaaatttcagctttgaagtctgaatagttcagtaggtttttgacatatcatcaagaatgattggttgactctaagcacccccgccccc

SEQ ID NO: 138530 - DNA, 396 bp, Homo sapiens
tctggtgagctgtcttgtatgtatatccactgtgtatccattacatgtgtccactatgtaatacaactgaaacaatccagcatcacttcacccatttcactatagtaaattgtaacttgttttttaaacgttaaaaaaattgatatttccttaaaaatacttcataattaaaaggaaatttacctaaattagatttttattgtttcataagtgatccattggagcaatatacaaggaattctttcatgtaagctttagagcaattatttttagaaattctacttaaacctttgataaggatactatattagagatttattaaaagcaggatatttagtagttttaagataattaaaaagggtttgttattgtgctgatagtcaactagttatttaa

SEQ ID NO: 138531 - DNA, 234 bp, Homo sapiens
caacagcaaaaactaagtagctacatgtaggtattctgagattttgagcaagtgccaaatgtcctacctcagcagagttggtgccgggatgaaccagctctcgaaggcatcagagttgggggatggagccttcaggccggactgacaggtacctgctctgggcctgcagctatgccctaagcaagttcgagaggagccactctgggcatgagggaaccttccttctggatcttc

SEQ ID NO: 138532 - DNA, 329 bp, Homo sapiens
aatagtcagaggatattagttcaggtaaaaactaagtctgggcttagtactgtagtattaactgctgtgctaattagagtggattgtatggtattttcaaacattggcagcctcggaaaggagaaactatcatactttaggacattataggaaatccatctacatgggtaatttcaaaaaacaaagcaagtactaaatcccaggcactaagcagaaaactggaatgtggttgatactcttctccttccccaggaatgtgagggcagtatatgttactgattcttgattactagtaaaaggtacaagcattttatatccttatagacctt

SEQ ID NO: 138533 - DNA, 306 bp, Homo sapiens
gagatatggcagggcgagcttaggggaaaaagctgggttaggaactgttgaaactgaaatccctgagggctgtgccgacagagagacagccggtagaaggttgtctttgcctgtctgtggttccaggtaacttcatcgaaagagagtttcaggcagtagaaataagagcacccaggacaaagccccagggaagagaaacatctgacggaggacagaggaagaagggtcaggaatgagactgagcaggtgtcatgtgtctgacaccagagcctgacacatagtacgtagtagacactcagcccctgt

SEQ ID NO: 138534 - DNA, 355 bp, Homo sapiens
catgggccatggaggaccagggcctagggaaggtaggcaggcctcctccaccctttcttccccctccactggctggagcccagacatggctgcaacccaacttcaaccatgcaaacaacaatgttctatgatgtggcagcaacttcaaaaaaacaggatcccaggtgaccacaaggagccgagctgccccctcacttggtctgttcacgttgaggacatcagggccattacatgagacagaaaaacaaactcctcattctttaagccactgtatcattagaccccttcaacgcagcagggcagctttccacaaagaaatgcacctgccttcatagggtgagcagagcatcaatga

SEQ ID NO: 138535 - DNA, 620 bp, Homo sapiens
tagtagacattaaatatatattttgtgaatgaattaatgaattaatgcttatgatgtggtgggaaaggcatggccccagaccctggttcacagtgcagcctcctcccacctgttctaatagcctctccagtggatcagcttctctgcccctctgtgtgtgaccctaggaacttttgtggcaccagtcataggaagctgagctccaagaagcaggcagaagagtgaggtaaaccagattaagagaaggacctttgaagcagtcagagaaccaggcttgagccacttgtagtgctctgcagatagagagcatccctgatgagacagggggagcccagaaagttggctcaggtatcaggagcaattggcattcttggggccagactgcatggatgttccaagaagccccagaaggcaggaggtcccaagttcccagaacccgaagtctttgtggtggcatgtgattctgagtatgtccactgcttcatggcacacagtgtatgagcctcccatgacaggccactcctgtgtgggctgatgctacactgatcattagctttctgggagagtggcccaatcgttcttccatatggtggccattcacattggaaagagcagaatcc

SEQ ID NO: 138536 - DNA, 324 bp, Homo sapiens
tgctgggattacaggcatgagctactgtgcctggcccaaagcagcatttgaactgagttttgaagaaagaattgaggttaaccattcaaagaaggggaaatggacttttctgacagagggaccagcaaaagcaaatacatggtactatgaacctgtactctcaatcacaggtgttttagggaactacatattattcagtgtcaacagagtaaaatttgaatgtggaaagggatggtaaagaggagactgtagacataagtgggagctggttatgaaaggccatgaatgtgacactaaggactttgtgctttattctatggggga

SEQ ID NO: 138537 - DNA, 235 bp, Homo sapiens
cggctgctatatctaggaaagtattacagtagtatctcccacagtcaaaatggaaaaaattataaagcaggaaagcgtctcaggaggacccaccgctccttccatggccccttcatatcctgctgcccaatttttcctttccttcccaggttaacacaagttttttgccttatttcaagggtttctatagttagggaactagctgacacatatcccactacccatttgttttctg

SEQ ID NO: 138538 - DNA, 288 bp, Homo sapiens
caacaaaaagtgatacatgtaaatattatccacttaggtttttttttaacttttattttaggttcaggggtacatgtggaggtttgttttataggtaaattgcatactcaatgtttgttctcacttataagtgagaatatgcagtgtttggctttctgttcttgtgttagttcacttaggttaatggccttcagctccatccatgttgctgcaaaggacatgatcttgttcttttttatggctgcatagtattccatggtgtatatgtaccaccccaaagaaatatac

SEQ ID NO: 138539 - DNA, 708 bp, Homo sapiens
ccaggttactggcatttcccactcatctaagatgagctaagggaccaagatgaagctcagcagagtgggatacacccttggctgggtgttctgaattcatgcctaagaccttcagtgggatcttggaacagagaatagagcctaaattacccatcagggcctcagccttctccaccactgtgtccaatgccagaggaagtcgatcaatgcattcagtattctgagaaaagttttactaacacatattttgccaaacgagatgatgtttgactataaaggaaataggcagacattcttatcaaaggatatagggaacggaacgtagttctcttctaccttcttgaaaactatgttacaatgaaatgccagccaatgaagagatgaatcaaaatgaagaacctaaaacgagagcatacttgcactcctggagtctctctccagccctgaactgtggccagcacagtgtgtcagcctgtaccagctgccggtatgggtgacctgggcacaggcaaggccatcatcatcacacactgtgtgcaccagaactcctcttggcatctccaagccagttcaccattgtgtgaactgtgcactgaaggagctccactgggactcagaggccttggcacaactgcagctgtggaacattgcgatgaggaaagattgggaaaatgacaagagcccattgtctggaattcataggtgcat

SEQ ID NO: 138540 - DNA, 234 bp, Homo sapiens
cagtaatagtgaaaaagtggaaattgggctggtgaagggaaaacagaagcatcctggatccttgagggatccaaattcttgagttctggactggttttcagatggtttaggcttcctgagggacagtgttcagtctcccatttagcatctgtggtttgtctaatatgggatgtgaagatttcttggagttctaggtttctggcctatgtaaattttgtgttcattctctatttc

SEQ ID NO: 138541 - DNA, 474 bp, Homo sapiens
gggccatactgttttttgaaatgcctgtagggtatccaggtggagatgtccagcatgattttggaaatacagaactgagcttaggagtaactaagggtgagagggacacgaagagaaagagatgagatgaggagttacacgtaaaggccatagtaaagcgctgaaaatagatgtggttttctttcttctcttcttttcacttttctttctcatctatagaaaagaaggctgttggccccaggaagcctcagcacaggatgaagaaaatagagcaggaaaagacatcaagcagccagaaggatatgaggaaaaacagaagaaatgctgttagaggctaagacaggaaaatgtttcaagaagagaagggccagccatgtcaaataggtctaggatttgacaattaattggtgtaatgaaaactaagaaactagattcagtagtggtgtaaacaaaagtcagattatggtgagggga

SEQ ID NO: 138542 - DNA, 306 bp, Homo sapiens
cttatttgccctgcacaggattcttggaaatgttaactgaatgaatgagggggcacgaatgccccagttgccctaaactcacctctccttaacatctgcttcactcattcatactatctggctaaagcccaaagtcaggtgcattgtcaaggctctgctctatactcactggtcaccactgtgaccaaactgttaagagggtaagagaaggagacacatacacatatccaccaacacctccacccacaaagacaggcctctcttggagaatggacaaaagccatcgatagagccaatttcacatct

SEQ ID NO: 138543 - DNA, 353 bp, Homo sapiens
actacttaagcagctgtgctttggatgagagttttattgattgtatatacttcaaatgtttctcttcactagccatgttttctttgtaactcttggcgaatattcccaaatactccagtggaaatgttaacaaaagttcttaagggtggctgcagggccagggcatttagagtggacccttgaccattgatactgaccctttggacacttggtgaagaaaacaatggttcatgtttgatgagatctggatgagactaaaggcaaatatggaatatattaaataagcctgccatgagaagaaataaaatggtttctgataaaaacagagtcattcccaactataaataagaaga

SEQ ID NO: 138544 - DNA, 1155 bp, Homo sapiens
tgaagcaagtctatcatgatcctcagtttaaaatggaatctgagggtttcccaacaagttaaacatagaatttaattaccatatgacccagtaattccactcataggtatatgctccccctcaaactggaaactgatgtttaaagaaaacttgtgccaggtgtggtggctcacgcctgtaatcccatcacttgaggtcaggagtttcagaacagactggccaacctggtgaaacgccatctctactaaaaatacaaaaattagctgggcatagtggcacgtgcctgtacttccagctgaaggaaggctgaagcaggagaatcgcttgaacctgggaggcagaggttacagtgagccaaattcacaccactgcactccagactgggtgatggagcaagactgtgtctcgaagaaaaagaaaagaactgtatctggcacgtagtaaacaccctataattattagttgttattggctgtggatggatgaatgagttttagatggatggatggatagatggaaggcatggagctgagcctggcgcctgttttcacactgcatgttactgggaatcagatcaaattcaactgattttcaaatgaaactcattaggcaagttttcacattagaataggttatattcaataaattgaggaagagacatcttatttttcttttccccagcaaattttctgaaaataaaggctttttctctcccctgcatttttcacccacccactcacccgcctcccagagtcagacattcagtccatagatataactcttttattaatttcccttgaagactgatgatttttttctactttttgccacgtctcataattgacaaaactacaatgtggatttaagatcagcagcttttaaccacaaatattaaagcattttaaaaataagttcaattagggacagttcacattgtataaatcagcctttttgtatctaaatatcatacataatcattttatgaggaaataaaatgtcacattgttaacaatacaactgtataaaaggagctacaaaaataaggattacatttgcccttatcttgggatttcaacagttccagaaattttacaacttcaagaccaccattttaaatatgttagtgcctaaatatatttcctgtgctgcaaagat

SEQ ID NO: 138545 - DNA, 372 bp, Homo sapiens
aatgaatgtaactaattagagagggtagggatatgagaccagcctgtcaccttcaaatatcatattactaaggaatctatacaaattctatgagcttctagaacgaaaaggatatgtctccttaaattgtgtctgataacttactagatactgtctacatggcttttttgagggaaggggaataatgggaggtggctttaactaatgttaactgatttctacaatcagggaatctcgctggccttgaagagaaattagaatgaattcaaatgacaggaaactgtatctacatctacctcacagtagatatctaggtaggaagaatgagaaaaatacatttacaaacagtaaaatatcaaaggatacattatg

SEQ ID NO: 138546 - DNA, 380 bp, Homo sapiens
gcctctcgacagttgccactgacccctggagaggagtcctagttgggttgggaggaagggggttgggcttgaactctccctgcccccttacttttggagcagcagcatccccccgaggagctgagaggtcactccctgggtcaagcagcctgagctagtccctctccacggacaggatgattcacagcccagaaaagggagcagccacctctggaaaccgtgtacatcctaagagcccctcctgcagcacctttcttaggttgattcagggagggaagctgtgggaggagtcggggaaaggcctgggagcagtgcttcctctctccctgctgcaccaacatcttggaagcttggtggaggtggggacacaactcttacca

SEQ ID NO: 138547 - DNA, 399 bp, Homo sapiens
cattctacccagagctcagaaagaagagtgttaaacatggaacaactttgaagcagtttggtaagttgattttgtttgtatgtgcacttaaaaggttttgatgacatatattacttaattgcttctacttgggaagagaaaggataccaggatacagaactgagtttacaggtgccatcatgctatgcgaggcttggacactgagggagaaggtcaatctactgagagaaaagtcacaaaataaagcaataaacaccacatctagaacaggagaaattctatcacagctttcgcataaagccttttaaccattaaaaaccgtatgaatgtcaaatagcaatcagtgaagacattcagggccataggtatctttgactatacagacctggaaagctactg

SEQ ID NO: 138548 - DNA, 2884 bp, Homo sapiens
  misc_feature (2884)..(2884): n is a, c, g, or t
tctttttaaatgtttgcttgatatttaatcatggatgtattgagatggactcatctcaaactatattaaaaacactctggatgctttaaataaaaaatggcaaaagttaatgttgtaagagaagtgaaaagaaaaccaagagctcctacctgcctcagcttaccctttgtttggtgcgtgggtgcagtgggcagtgagccgtgccattccctcctggcagccggtgcatggctggccatggtccttagcagtgactgtgaacagccgtgggctactttgttacccacccagtgctgcttttgtatgttggcaaatggggctttcgctttccttggtttgattctgtcattgatgcttcagactagtcatgcttttgtttgaagggaaaaaaaaatcaatcaatcaatatcagtaacttgctatagatttttataaaggaaaaaaccccaccacatgtatggtggggagtgagttgatgtggaatcagtcatgaccgcgttgagttaggagcatcgcggatgtggagttacagctctgctgtggatgtttttgttttaagaaaacatcttttaaaaatctaataatggttcattaaaaaccagaaatggtcaagctcactagaaaccgtcatcagccacattctgatgaaagaggttttgactttcttttttaaaaaattaatgaagatacatccaaatatttgtggcaggcaggaaatcaagcggattttaatgggaaattatgtaagaaagcttaatgactaatttttctggatcagacaagtggagaacggtcttagggaaatgtgtacatccattactcattagtttgctgtattataattactgttgtataggaagaagcatgtcagataattaggaactgggtggcattttatgctaaggatcaaaacaaagattttgcttggaatgttgagcaaaattatactctggctgagattaaacacatggcaagcatcctactccagtatttaaaatcatcaggcaggctttattctatttttttgggtctttgttctttcatgttttcctctaatgaaaaggaatgcttagaaaatagcactgggaggccagcaagaaatcagtgttgggattttctcatgtgtgaggagctgttactgctcctgtcgcctggtttcacccctcggttctgctcccaggagctggacccctccccgctggcccctctgtgctgcaagcatccattttgggcttggggataatggtcaagagagttggttggtttgggctgtgggctggacaagcgcttgctgcttaaaccatgttgattgtggcttaactgctgaaccaaaccaatacttcatccaaagaacttctccagggagggagtgggcttcaggggagccacatgggaagccccctaaccaacatttctgtagcacttgattggagcctccaaacaccgtcgctgtcgatgctacagcagtcctgtgggccgcagaaggagtactcactgtgtgttctccatgcccttctgtctctgagaagcagcgtggcgtgttcggattgtgccctcctgccgaccccggtggctcaggcaaagggcttgccagatggtcggtgttctttgccaaatgggaccgatagcgtgcgcatggtggggatgaggggaggactagggaagtaaatacagtgcctgctgccacgtcaccttcacacagtccatgtttaataagaggtcgctgctgtgatgatagggggtcggccagacatgtccactgtttaaaaagcagcatccatctgaggactcattggattaaatgtacacctaaaaaaaatacagtggcacctgcatgcagtgcccgaggatgggtgtgctgttttactagatctggtgttttttggaggtgcacatttggtagttcattgttgggttggtatttgtctccataacctgtttcagcctcaaggtcatttacctttgatcagtgcttcaagcttagcggtttgtttatatacatgttcatgtataaattatattactcagtctgatcataatatatgcccagtgcaaatcatttcattaaagcctcagggatacacggtgccaccgtttcctcattcagggacacggggatagtggtagtgtgtcttcagcacgacatggggaaattcaaaggcagccatccgtggaagagccaacggcagcccgtgcaggcgtcagcgcctggggaatagtagcagtctacatctttagctgtcagggtatctcgttgtagcctcatcctgccctctttaggggtccttggatgagttatcagttgtagtattgacattttctgtaaatagtgtcactcaagcgagtgacagtgggaagcagacaccagcccttagggagcagcccaggatgcttttttcctccaaatgcctctcacctattcccagatactcgctggagttggagcacacatgtctgcagatgtaaaacgacctgctcccccaggtgaatggattctcgccagggccaatacttatccgcaggggtgtgtgccaggcagcccaggtcagcctccctccaccgggccacccgcaccaggttgcctcccatcgtttgcaggagcggaagacccgatggagcaggtttcacagtgccctcgctgctgcctcccgtttcatctgcacgtctctttcaatgcgggcgtgcgaacttccaggtagagccgagttcaagaaaatgaagtactgcatgcgacgagcaagtttattgaagagggtgtgaggtcgcggcgcctgaccctcattatgtcagttactactaaatgaaattagaacttcactgccctttttctttttcccatcgaggtgcaggaggaattgatcttagggtagtattttggatttan

SEQ ID NO: 138549 - DNA, 2062 bp, Homo sapiens
tctttttaaatgtttgcttgatatttaatcatggatgtattgagatggactcatctcaaactatattaaaaacactctggatgctttaaataaaaaatggcaaaagttaatgttgtaagagaagtgaaaagaaaaccaagagctcctacctgcctcagcttaccctttgtttggtgcgtgggtgcagtgggcagtgagccgtgccattccctcctggcagccggtgcatggctggccatggtccttagcagtgactgtgaacagccgtgggctactttgttacccacccagtgctgcttttgtatgttggcaaatggggctttcgctttccttggtttgattctgtcattgatgcttcagactagtcatgcttttgtttgaagggaaaaaaaaatcaatcaatcaatatcagtaacttgctatagatttttataaaggaaaaaaccccaccacatgtatggtggggagtgagttgatgtggaatcagtcatgaccgcgttgagttaggagcatcgcggatgtggagttacagctctgctgtggatgtttttgttttaagaaaacatcttttaaaaatctaataatggttcattaaaaaccagaaatggtcaagctcactagaaaccgtcatcagccacattctgatgaaagaggttttgactttcttttttaaaaaattaatgaagatacatccaaatatttgtggcaggcaggaaatcaagcggattttaatgggaaattatgtaagaaagcttaatgactaatttttctggatcagacaagtggagaacggtcttagggaaatgtgtacatccattactcattagtttgctgtattataattactgttgtataggaagaagcatgtcagataattaggaactgggtggcattttatgctaaggatcaaaacaaagattttgcttggaatgttgagcaaaattatactctggctgagattaaacacatggcaagcatcctactccagtatttaaaatcatcaggcaggctttattctatttttttgggtctttgttctttcatgttttcctctaatgaaaaggaatgcttagaaaatagcactgggaggccagcaagaaatcagtgttgggattttctcatgtgtgaggagctgttactgctcctgtcgcctggtttcacccctcggttctgctcccaggagctggacccctccccgctggcccctctgtgctgcaagcatccattttgggcttggggataatggtcaagagagttggttggtttgggctgtgggctggacaagcgcttgctgcttaaaccatgttgattgtggcttaactgctgaaccaaaccaatacttcatccaaagaacttctccagggagggagtgggcttcaggggagccacatgggaagccccctaaccaacatttctgtagcacttgattggagcctccaaacaccgtcgctgtcgatgctacagcagtcctgtgggccgcagaaggagtactcactgtgtgttctccatgcccttctgtctctgagaagcagcgtggcgtgttcggattgtgccctcctgccgaccccggtggctcaggcaaagggcttgccagatggtcggtgttctttgccaaatgggaccgatagcgtgcgcatggtggggatgaggggaggactagggaagtaaatacagtgcctgctgccacgtcaccttcacacagtccatgtttaataagaggtcgctgctgtgatgatagggggtcggccagacatgtccactgtttaaaaagcagcatccatctgaggactcattggattaaatgtacacctaaaaaaaatacagtggcacctgcatgcagtgcccgaggatgggtgtgctgttttactagatctggtgttttttggaggtgcacatttggtagttcattgttgggttggtatttgtctccataacctgcccctcattcccagtatttgccctggtaggcgggctatcctcttgaagtcgaccgtgcatgtatgtattcttggtcatctggtccgtacttactcaaacgtatcgtctggtacgccccgttagg

SEQ ID NO: 138550 - DNA, 100 bp, Homo sapiens
caaatgtgtgaacaaatgtgatataaatatgatgtgatataaatatgagataatagtttatattactaatatgaatcaaatgttatggttgcacagtgga

SEQ ID NO: 138551 - DNA, 281 bp, Homo sapiens
gtcttttgttttcatgccatccttttctgactactatcttagtttcctaaaagattttcctatgtttcttcaggccagtaccacataaatcctcctaaaatctgcctctgattatgacttggaacccttcagtagttgcctgctgggtcaagtttaaactccttaccctggccccaaggggtctcttgttccttgtctaaacctctgctttaggcaaactgcatggggcacatacactgtcttttctgcagcctttgtgcatagtatgattcatctctccc

SEQ ID NO: 138552 - DNA, 147 bp, Homo sapiens
atcagaagggcttaaaaggtttcaggtagtttcataaaccagaaggagggatccagaaaaaatagtgtttgatctcccttccgtcaggaatatgcaccatggtaagacttggggtatgtaatggctatgcttttcttttctaaggtg

SEQ ID NO: 138553 - DNA, 383 bp, Homo sapiens
aatgtggcccgatccctaggccagcggcacttgctcttgcagttgccaccttcatccttaagtttagggcagaacagccgtgaatctctgggcctgttcccaggaatggaggccaagacaactgttggaggaggtctacagagtcccgccacccctcagagcccagtcaagcatgaatgggcttttacaatccgtaggaggctgcagtggtcaaggtccttctaaagcacctgcaaaatcccagcagtgtcccacctgtcactgtgggtgttctttggcttcctgccgttgataagagttctctcctttttgacaagaggccgaacaaattgaaactgtatttaaataacaacactctttttacataatagaacacccagttt

SEQ ID NO: 138554 - DNA, 472 bp, Homo sapiens
agaaaaaaggagactctcaagatgagttccaaacatagtattggctgaaagttagcaattttttaggattttgttatgtgccaggcaataagcttggttctttgcacattatctgatttaatcctcagtacaagcctataaggaacatacaatattattttacagactttaagcattctgccagggtcacacattaggaaatggttagccaaatatgacttttgatgattcaacttcagaaccaacaatttacaatgtagcataccatggtttttcaatagcagcactgtcatttgggtcagataattttgttgtggtttgtccactgcattgtacaatgtttagcagcatccctggcctctacccactagatgtcagtagcaacacctctctcccttcccctaaatatttgacaatgaaaaatttctccagacattgccaaatgttccctggggggtggggggcggggaat

SEQ ID NO: 138555 - DNA, 225 bp, Homo sapiens
caggaggctgaggcaggagaatcacttgaacccgggaggcggacgttgcagtaagccaagatcgcaccactgcactccaacctaggcaacggagcaagactctgtctccaaaaaaaaaaaagaacactcatttccagagtcaagttacgtgaccacaggtggcacagggcctgtgagaacagcctgcgacgacttcctgccagtcctcttcttccccatctgtgc

SEQ ID NO: 138556 - DNA, 372 bp, Homo sapiens
cctgtgtccaagtgttctcattgttcaattcccacctatgagtgagaacatgcggtgtttgattttttgtccttgcgatagtttgctgagaatgatggtttccagcttcatccatgtccctacaaaggacatgaactcacccttttttatggctgcacagtattccatagtgtatatgaggcagctccaattctattatgtcactgacatctctctaggacttttcttacacatcctaaaggactcgacttcatatttacactaacatgagtataatatagaaatattacctctatatgggctgggcgcagtggctcacgcctgtaatcccagcactttgggaggccaaggcgggtggattgcttgaggtca

SEQ ID NO: 138557 - DNA, 155 bp, Homo sapiens
gacaagcctttcattttctgagatcaggaagatattttcttgaagtcacacagaaagtgagtggctaagcaggtgaaaatctgagtctgaggggttccaatgactgtgaccttctcacactgccagcaagacatttgctccatctgaaaacaaag

SEQ ID NO: 138558 - DNA, 165 bp, Homo sapiens
tttgctgttgaaatattttttctacagcaagtgagacttgagtattttctgttctcagtaatggttatttccattttttggtaataacagtgtatattctgctgctgctctaaagtgctttaattacctgcattctctcctttaagggagcataggtctgtttat

SEQ ID NO: 138559 - DNA, 176 bp, Homo sapiens
gtaagttattttgctgtgaagagtaccttttatttatgatattaaaggctttaacttaaattatccttcaaaactttggaggcaacaaagatgtctaccatggtttcttggatcaggtattagtcacttgtggaagtggtcacatagttttgtcttagagaaagttttgattataa

SEQ ID NO: 138560 - DNA, 131 bp, Homo sapiens
cagagagacaaagcagaataccagaatatctctgatggcatttaagctccagagctcctcatggatcaagctgaggctagacttcacctgagcccttattttgtgcttggcttctcctcctgcctatccag

SEQ ID NO: 138561 - DNA, 307 bp, Homo sapiens
actgtgtgtgcagatgtgacctcgtgattgtgtggggactgtgatttcaggtgtgacccccatcttgggttgacctctgtctggggaggactgtgcgtctgtcgggactcccatttgtgagtgactctgcagtgtgaccagggtccaggggtgactggatgtgcaactgggacccttgattgggtgactgcgtgagccgctggttctgagacctgtggccggggtagttctaggccctttgcctgtatgcctggctgtgcgatgtgagatgtgactgttgctgacctgccgtccggggactgtgcca

SEQ ID NO: 138562 - DNA, 544 bp, Homo sapiens
caaaaggggaaaaaacaggatgaggttagcatatgaaagtgttttctttccctccctttgggctggttttacaatgctagtgtgctagtagaatggctgctttcttcagcactttgttaaaggtccctggttgggtaagaaacttgactgcactaggacacatcaaacaaccagccaggctttggtcttacccaggcactgaaaagctgagccctgtgctctgctctcccatttgccacattttgccggatgagtctggtatgcttcagacaagcagttacacatttcacgaaggaaagaggtcggtggatggaaaattactgtcatttttagtgggtgaaggcaaagaagacctaccttctcttccattgtgagatactgtacagcaccttcgattcatgtgcgtaggtctgaattctgttttcaggatacttagtgttgtgtttgtagaattgaggagatgctacctaggggagaccatggagatccactgaagtggctgcggctgattgtgattgaatttttaagcatttactgaacattc

SEQ ID NO: 138563 - DNA, 325 bp, Homo sapiens
tgaaaggtccattccttgagttatgaggaaaggaacctatagattagagactgggaatatgatgggatcaactgttaagaaatttgggagtcctcagaacctgtgggtacagtaaaaagaaaacgactttagggcagagacagtttaatgtagctaaagaggcagttttcgatttatgagtgaacaactctgcttctgggtaatgtagtaggaaggaccggataagcctccaggtgggagttcaggtgggtacaaggcagttttctcggtcacatcccattcattgaattattcttctttatctgacacagaagagcttttactg

SEQ ID NO: 138564 - DNA, 427 bp, Homo sapiens
gttctggtgggtaaagccttgcggtctttttcacaaggtaaaacggtatgtgatatatgctcagggcaatacccctggagatgtgttgtgaatcgatggacacatttttttttcatttgtactttatttagtgactaaccaataaagtaatagataatagagtactaactttatgtgttactactactactttatgagtaactcgagacctttgcatatatattaatgcttttattaaaatatatattttgataaatacctggtcattgtaaaaagtttagaaagtgcagattagtaaaaagttcttaaatctcacaaataaccactgttaacatttttttggtgtactatcctcccaatattttatatgtatattttttaccaattgtatatattgtaaacacatatgtaacccctgtgttccttc

SEQ ID NO: 138565 - DNA, 808 bp, Homo sapiens
cataaatcataccaatcacttggtacagttgtttaaaatattcagtattctgtattttcttgttttgtgcaatgatcatctcttgctttagtaataaaaattacagggagaaattacaatagaaaatataattttacaatattttaaattatataagagagatagaagagaaagagaaacagaagagaacacctataattacattcataagctaaatatacaaatgatgtgactctactgtataagggcagggatgagtggggagctgagaaatgggttaaatgtttgagatcatttaaaagaattgtagcacaaccagggtaaagttttctctgaaattatgaaacattgagtggaattcagggctttgttgactctgcttctatttctgtctgcagacgaaagtctgatttggggtttgcagtttgtcagtttctaaaatcctaccttgattcattaatacaaagttgaaaattactttcttggtgctatatacataaaagaacagtttttgaaaaaattatgaggttaagtgtgttgtctgccctatcggtaccctctcctattaacaccctctttccttactatggcattatgtttacacctgccctccctggcaggagcaaaaccttaacatctctgtctcaacctgcttctacaccttcataaaaacttccctgtcctgcattttcttcccactgattaatagtctttctctgctagtgacaacagctcagctgaccaatttattcatgctaatttatctatgactattaacaacttgatgggttagtgcatccagggaaga

SEQ ID NO: 138566 - DNA, 466 bp, Homo sapiens
agcccattcatagagcaaagctaaatttattgcttacctcagtgtggaacatcaagaattggtagaggtgtagtggcatctcagaagaggatgacaaaggcatgcatgaggtttttttggtctggtttaaggcaggtctttgttggggggcacttaattaggattggacaactttgtggcataatagttttaggattgctggatgcaggggtgggggagggtttcgaacaaaccctttaaaactaaatagtcatttgatgctctatattgtcctgagacatgggtgtgttttctaaagagggtaagttgagtagtctagtgttaggatagagaaaaggatttttgcaaaattcctgaaacaaataaaaaagttatctgtgagttcatcttcctgggtaagagtgtcctaagtgagtagtcatgttaatgtatatggtgagctgtatgggttcaaatggttttggtt

SEQ ID NO: 138567 - DNA, 749 bp, Homo sapiens
agggagactctgtctcaaaaaaaaaaaaaaaaaaaaaaatctggaaaagataataaagttgtgaatgtaggttggaactaaactgtggaagtccctgaatgacttcaggagtctaggactttaactgtgttagccaggcacccagcattttagtgagacattctgctttgtagcatttgcattgcgggcacagagagtggaggtggcgctgggaagcgtgctcctgccagccacatttttctcctcactggggaaaagaaaagagcctggtggtggtgattggccatgatgtcataggtcagttaccggcaaaagccctacaagaggcaggggagagcacctgcaaactggggtgcaacagaagggacgtggggaagcagaggctgaggagaccaacccatgggaaggaaggcccgtggaggctgctgcagtgggcagtaacgaggggctggacttgaggattggagaaatcactgcagaatgggcttaatggaagacaaatttttaaaggaaaaatagtgactgatttgtaaaaaaattagatgaccgaaattttaagcacatattactgatagagtgttgataccactggcaaaatgaaaaggcaaggaaggatgatggcttccatgttggacatgttgagtttgtggtaacggcaagaaaacctgttagaaatctccagacttagaactatggacccacgtggaactcaaaaggtcagtttcgatatgtcacttgaataaaatagt

SEQ ID NO: 138568 - DNA, 515 bp, Homo sapiens
gtcaaaccaagacactttcctaatgacatagaataggagggaatacattagagggcatcattcacagtcaggttgagtactgtttcatgaaacctctgttatatttgtatgtatacatacacacggttaaatactgggttgcaatgtaaaatgtactttatattgcgagtcatggttttaaaaagtttgaaatcttcatactctgctagtgagaatgcaaaacggtttaactactatggaaagaatctgatggttcctcaaagagttaaacatagaattagcatacgaccctgtaatttcactgtgtacacatgccccaaagaaatgaaaacaagttatcaaacaagtatatgtacatgcatgttcatagcagcactatgcgtaatagctcaaagtcttcaatgtctatcaatggatcaatgaataaacgaaaggtggcatatatatgtaatggaatattattaatccgtaaaaaggaatgaagtttgggaacatgctacaacatggatgaaccc

SEQ ID NO: 138569 - DNA, 110 bp, Homo sapiens
atcatttaacatgtttaaaactgtgctatcattttcattaggtttctgtcttttttactgtcactggcaaaattttttaatattaagtcccaactccattttcccatagg

SEQ ID NO: 138570 - DNA, 414 bp, Homo sapiens
gggagaggcatgccatgtcattttaaggaactgcaggttgcttagaatgaaagattcgtttataggtgatagaatagctagagtacaggttggagagaaaggcaaagattggtatatgaagtgtcatgtaatcttgctaaagaattagaaaaataggaggtaagagaagatagaagaggaaaacagagatatattaaggaattttaggtgtgaaaaaataaatcatagtagtctagctagaaatcatgatataactttataaagaccttaatccaatgtattgtcttaatgaattgaaatcatgaatatggctatggttttcttaccactggttacccctacagaaagagttgagagacatctcagttgttaggtgtgcaggctgtttcttcttttctagtgggccctgtattt

SEQ ID NO: 138571 - DNA, 413 bp, Homo sapiens
cagccttggcctcccaaatgttgggattacaggcatgagctactgcacctggccttggagtgattcttgaaagcttagaaaagtcagtggcccacattaaatgacgtagagatgacaaaaccatggcagacttaacaaagggatccaaagattcatacatacacaaactaggatggaactagaagataagaccaagcaacccaccttcagttatgttccttaggagggtctggagagcattctgtttaccaaggttccaaggaatgccctggttggggggccatcagcatcactgagaagcttggtagtggctatcctggtttgcaggggctggttattatataacatcaccccagaccattcacattacagccagaggtgcagcagtgggcatgtggccatggggaccattg

SEQ ID NO: 138572 - DNA, 608 bp, Homo sapiens
gagttggatagctccccagtgaggaggcagcacatctagagttacatatagttttaaatttaattcatttaaatcaccaaatgcatgagccttcactgttgtgatgaatttttaatgtaacttgagcaaggctcccagaattttgcattctctctactgcctgaacattttaaggtgaaacattattctctagaatttcctactgtgtctgtccaatttattaggctagtagaacatagtccagacctaggttaaatttttcatgtgacgctttaggcaattttaattttgtaactcatatcccaggcatcagtggtataatgctatacatagtcttagaaaatagtcattatggctgttgaatgtctttgtatggtaactatttcactacaaaatccagttttattgatattactcagtggtgaatcatacttgttcagatcagggttctgtgctgttgacttgtttctggcacaggataaaatagaaataaaaaaaagcattccaatttgattgttgcttttttttttttaaactataaatgcagtttaagtctttgttttgtttttgagacagcctgggcagcagagtgagactttgtctcaaaa

SEQ ID NO: 138573 - DNA, 113 bp, Homo sapiens
aaataccccacacaatggtctgattcatcctcaagcctagttacacaagcctggctcagggtagagaaaataaatatcaatataagtgtccacgctgggtgctggggtgagta

SEQ ID NO: 138574 - DNA, 426 bp, Homo sapiens
tacactgtgagcatagaaccacctactcaagcctcagcaatggcggacacccctccccctgccaagctccagcatcccccggtcgatctcaagaattcgtgcgctagcagcgagcaaggctccatgggcgtgggacccaccgagccaggcacgggagggaatctcctggtctgctggttgcaaagaccgtgggaaaggtgcagtatttgggcagaagcgtaccattcctgcaggtacagtcactcacggcttcccttggctaggaaagggaaatcccccaaccccttgtgcttcccgggtgaggcaatgccctgccctgctttggctcaccctccatggctgcacccattgtccaaccattcccaatgagatgaaccaggtacctcagttggaaaggcagaaatcacccatcttttgcatcgatct

SEQ ID NO: 138575 - DNA, 188 bp, Homo sapiens
tgttcccgcacatgaagtccttatccaggaactcctggaatctgagattgtttcagagcctctctgtacccacccagtcacagccccccttccacacccatcctatcgaccaatccagctttcatgcttccaaaggcatactgactagaacactggccctaacagttgaggcagtgtttctgaaaatt

SEQ ID NO: 138576 - DNA, 460 bp, Homo sapiens
tcaatacttcaacttgaaaaattgccctaaaaaatttatggaatactgggcttcaaggcaagaaactaagccagaaagaggaggaatagaatgcctcattaagctgtaaaatctgaggtatagttaaaattattatgcttttaaaaaagcattctaagtaaactttttttttgagatggagtgcagtggtgcgatctgggctcactgcaagctccacctcctgggttcacgccattctcctgcctcagcctcccgagtagctgggactacaggcgcctgccaccatgcctggctaatttttttgtatttttagtagagatggggtttcaccgtgttaggatggtctcgatctcctgaccttgtgatccacccgccttggcctcccaaagagctgggattacacgtgtgagccactgcacccggccaaagtattctaaataaactcttaatttgaaatgta

SEQ ID NO: 138577 - DNA, 484 bp, Homo sapiens
ttaaatagttcagtcagaatgatggttgggaatattttatgctgctttcattatgcttcggctaggcagggtaattcttatgaattaccttgtttatttaattaagtaatgcaatacacgacaaaatattaccctgggtcatgaaaaatagagatctttaataagcatcatggtctcaaattgtaaaattacttaaaaaaccgtggcaggggtggttagttggttcatatttgattgaagcagtaattcattacatttatgaaatctttagagttcatttgctgtccaggcattctaacgtattacttacttggattgcatttttaaaaagctgctggcattaggcaacaagcaatcttacagcactaggctagagttagcaccttttccttgtggcttgttcaccgctaagtctccacggtgtcttgcgtatgggacaaaaccagatacctactcaatgcacccatcccaaaacatgacttca

SEQ ID NO: 138578 - DNA, 559 bp, Homo sapiens
tctacatttgaatacaaaattacttaaattgatgatagaaagcattctttagtaggtgagagtgattattctctttttagtttagttcaattgagtttaatactagagttttgtcttatgcttataatcataggtatctttcctaagacttaaatttaagatcaaaccaccttgtggataactaatcatatggtattataagattttcttaatttgtggatagcaatgtaagcaatttaaaataatcacagtgataaaagtggacatttcagaattatttgagtgtattaccctctttgaaacacttaatatttattcaatatataagttctgagcacttccattaaaaatctaaccattaaaaatataaaatcaccagcctgagcaacatggtgaaaccccatctctgaaaaaaatacaaaaattagccaagcatggtggcactcgactgtattcccagctacttgagagtctggggtagaaggatgcttgagcctgagaagttgagcctgcagtggatgtgatcacaccactgcactccagcctgggtgacagactg

SEQ ID NO: 138579 - DNA, 299 bp, Homo sapiens
taactctcaggaggaattggtcattactgtctgacgttccaagaggtcaagcagaatggcactgagaaagagattgtttcatttcttgaccagaaggttactggtggcccttcaaaaggaagtcccaagagagttgtggtaagaaaaggcatcccagagattcaatttagagaagataatgaggaattaagagaaagtttgtaagtttaaagaagagacacagaacagcaattgaatggagcaccttcttccaagaggaggcttgcttgtgtttgatgacagattttgagaaggattca

SEQ ID NO: 138580 - DNA, 512 bp, Homo sapiens
tacccttttaactaattttatggaaatataaaccaaattatttatattgcttattagtgggtggtgacattgaggcaggcttgtgatattttaatgttttctaatttttttctacagtgaaaactttaccacacaatttctggcataacaaaaataaaaaggggaaagctgttgtgttctaagttactgtgtttaaaactaatcagaagtttctggacattaatccaacacagagtttccagcattcttaatctttaatgctatccattatactcacagaaatgtacacctcatttggtgaacatttggcaattccaaggattctgcatgctaaggtttgcatttgcatgtgccatttgggtttgtgtgtgtcattttctaaaatgttactataatttcaacgaagtttgaattggtctttgaatcactttaccagatgaaagtgtaagacaaatgcctcccagttttgtacttcctaacaaggtagcttccaactgtggcatgtcattaaa

SEQ ID NO: 138581 - DNA, 211 bp, Homo sapiens
ggacgctcactcccagaaaagggaaggaggagaggacagagatggagacatgatcactctttcaataaaatatactttaaaagtttatattccttgcagcattatttataaagaaacaggcttagtgtaaatgaatgatgataagaaacatccctacctaatttgttactttccacaattggaactttcctattcacagttctcttgtccc

SEQ ID NO: 138582 - DNA, 257 bp, Homo sapiens
ctggaaaccataatgagaccccgtctctttttttaaattaaaacaaaaaagaggactgaaagtgggggaggagtcattccagaaaccagtatacagccacccagaagtctcttgagaaggatttgctgtgtctctgataaagagagaccctccttgaatgacatcttcctgggctgcaaggtaactagagaaaacagactgattctcacaagtttaccctcctaagtcaactgtgaaatctggtggtgtccagcagg

SEQ ID NO: 138583 - DNA, 454 bp, Homo sapiens
ctgtgtccttgaagacagcctcatttgatggtcatttggctcttctccacccccagcctcactactagctctttctctcactttgtgatctataatccaagcactggtgaaatatctcatgcacatgagccccggtgtcagtgtttctcaatcatttagaaattactgattatgcctgttaatgtgttactactgcatgcttaaactttataagaggatcggcagcattgtgggctggactgttcacatagcaagagtctggaagtctaagtttagttctggctttcccattgactggctctatgacattgggcatgtttcagcagtttcctcatctgtaaaatgggagtattggatgtgatttgatttttccatccttttttttttcgatgaatatctgagaccaactatgaaatcttttcaagagaaaaaaaatcataagcaattgatagtg

SEQ ID NO: 138584 - DNA, 391 bp, Homo sapiens
atctcgctccagcatggctctttcccagacccaggtagcatgaccctcccttcctggtaggagaagatggcaggaagataggcctccactggggggcccccttttttcctctgaatgtggcactggagactgccagcagacccaggccctggggcatcctcctggctcaaaggcctgaccttcgaccctagctaagcccagcctgcctctgcatcccccaaggggaaccacagggcaggtgctggctccaaaatgtatgggatcatgggactccactcacctggagacccagagacggagcagggaaacagactgggctggcactgggttggtagccacaggaaccttcctactggcttatttaccaagcatgactttacctgttttctta

SEQ ID NO: 138585 - DNA, 207 bp, Homo sapiens
agcggttcacacagtgggaactccacgtgtggtagctctcactgctattttcacttatgtgagcccctaggtgcaagtagaccatgaggtcacagttgagagggacatcaccagcgggacccttcatcagaagtggggccacaaagaaactcagaggacaccaagaatgagggacagagccaggaaagctaatgaaaagcaaaaaca

SEQ ID NO: 138586 - DNA, 282 bp, Homo sapiens
ggtcaccacacacagccagcaatagtttcttaattggtctttgtccccatttgtatgtctctacacatcaaccacagggataaatcatatctcgctccactacactacttaacacctccccaccatcacacacccaatggcttcctggtgtcatcagaataaaattcaaattcctcacctttgacctaatggccctttctggtctagttcttgcctataatctattttctacttatttcccccttgttgactgaatgctaaccacacaagccttttttctgt

SEQ ID NO: 138587 - DNA, 450 bp, Homo sapiens
tggatgatattgttctaaggtcaaaaactgtcctacactgaaattcctcaatatgttgacatcctgaaatgtttaaaaattacttattgaaaaactaatgaatgtaagttactaaaggaagatgaaaataccctaataatcagatttcatttttatattgctattaacttttctagttgaagaaggaaggccaatcccagagaaaattatggaatagaccacggttctcatcactgtcttccaagcctctctccatatttccagcccctgtcacccttgattccctgtttcagcattgccttggtgcccaatttccatttcagtgtgctgttgcttttataacccccatttagcatccctctccagtctgggctaatgcacttttctccacggctttttaactctctacttcacaaagaacagactaatactcaaagtatagtgatagta

SEQ ID NO: 138588 - DNA, 331 bp, Homo sapiens
gtaaattgagagatatctttaatgttccaaagcaatttgctaaagcccgaatcattccttcacacacctgcaaaagattcagaagcccatggggaagtaaacatttatttcaaaaataaacttaaaggtttggaaataaaaactgacaagctgttttctcatgtaagatgtggctctatgccaccagaggcactgtaatcagaatttcaaagagtagaaataacaggtgacaacttactcggagacattcaaaccaagggaactgcagaacaagtgtcatttacatccattaaacaccatatcagcagagaggactggaaataaagagaca

SEQ ID NO: 138589 - DNA, 229 bp, Homo sapiens
ccaccctgctgtcccgagtgcaagatgagtggcaagcggtgcccgtcacgggatccctctggaggcctttacatctggggaaaggtcctacctctaggcaaggaaatgagaacacagacctcgctgaagggacagggagtgaagggggatgtccccaaccaaaccgtccctgcagctccaggatgttcttaagcattctccgttactccccttactctgcccacctccc

SEQ ID NO: 138590 - DNA, 415 bp, Homo sapiens
aggtttttgtaaaacctgtcttagagtgatgagttcaggtaattggagtattccaaaaaggacctctaattagaatgagtttgaaaatgatcatagagttttaaagttaacaaggacgttagagagcaaatagacccaacttccagaaactggatgcaaatttgtgcatacacgtacatatgtttgtcatatatggatggggtctctgcctttcattaaattaggagttgacaaactacagcccaaagaccaaatttggtccattgtctgtttttataaggcttttgaactaagaatggttttcacattttcaaattattgaaaagaatattttgtgacttgtgaaaattacatgaaattcaaatttcaggccaggtgtggtggctcctgcctataatcccagtgctttgggagc

SEQ ID NO: 138591 - DNA, 203 bp, Homo sapiens
tccctaactgtgtatctctcctctcccaggtactctcaacaatcttttcttcctatacaaataactggcagaacaattcctgcactggctgtttctttccttagtaggctcacctcccttccagctaagagaggacatcaatcctcccactctctgggagtcctccatggaatggaagaagctttgtatatgtatccttgggg

SEQ ID NO: 138592 - DNA, 451 bp, Homo sapiens
ctacctcagcctcccaggtgctgggatgatagtcatgagccactgtgcctggcctcattttccctaagtggaccagccatagctcctcatttagaaacctaaatttgagtcaactcatctctaattataattcaaacccaagaagatcattaccatccagtcttttcttgtcttccctgtgtttagtgaactagtcaccttgacaaccagattcagatcactgacagagtaaacagatttccattttcatcctccttgttcaaattagaagttatttatagctgcattttaagtgaaaatgaaactcaaaacgagtaccaggaaactagtgtatacaacaatagtacacagccctatctcagagataatgttgagagttagacccagtgtttcctttaacggcagatggaccatgtgagaccgcagggtggtctccacacggccctctgtt

SEQ ID NO: 138593 - DNA, 502 bp, Homo sapiens
ttgtttaaaaataaaaatcctagctaaactcttgcctatcccagaaatgaatttaaggaccgtattccttatgaattatgaagggaatttaaaagggaagcatccaggaaggtgtaattagtgtctggtaaactggctcttgtgttttctctgcctttcctctctttcttttaccagctacctgtagaccatttccctgtttattagctgcagtaccagaaggtggaataggaaatgaagtttacatccttcagttttgttatttgttagctgatttcttaaattttaggtgtgaagaactataaaaaagttaggttgtttgtgctgcatccttattattttttgtatcctgttatcacaggcattgatgacttatgtataattgagtaaagctgcaggaaagaaaagcacttaggaaatgcctcttcagattttcaagatcttttcacacctctcttggagaaaagaatttaaaaaaaaaaaagtcgacatggattctaat

SEQ ID NO: 138594 - DNA, 284 bp, Homo sapiens
gatcttcacaggtctctgagcggagggctgggctttccagccctactttctgaaactcttatggtcagcattggagttcactggttcccctaggcgttgatcagaggatgggaaccagcccggccgggcccaccttcactcactggatcagtaaataccctggcggtgcacctggtgttggaagctggtgctgcacaggcgtgtgaggattagatcagagcagaaaactcgggcgatggcagggtggtgaggcacaggtgaactttatgggcagtaagtgaggt

SEQ ID NO: 138595 - DNA, 196 bp, Homo sapiens
caagttgcttaacttctataagcctcaagcttgtcatcaccaaatcaggattaaaaatagtgcccacctcatggtagttgttatgaagaccagtgattatccatgtaacagccatagcacaatcctgggtacatggtaagtccttggtaagtgttgcctgtgccacactattattatattacaggtgctgttgttc

SEQ ID NO: 138596 - DNA, 763 bp, Homo sapiens
cagcctccctagtagctgggaccacaagtgcaagccatggcacctggctaatttaaaaaaaaatttttttgttttttgtctcactatgttgcccaggctggtctccaacttctggactcaagcgatcctcccaccttggcctcccaaggtgctgggtttacagtcatgagccactatgcctgtcctgttgtatcattatgaaatgtcagtctttatttctggtaatactctatcttggagtctataactgaaaataatatagcctctccccattttttcccccttaaacattacgccataagaagcttttcaaaaggagctaagttgcctggctggagtgcagtggctattcacaggtgtgattataacccactacagccttgaactcctgggctcaagagagcttcctgcctcagccaccccagtagctaggactatagacacaagctagcctttttatacttactgttttcatcaaatgtctttttccaactagtttccaacctgtctttgtatttgaagtgcatctattgtagatagttcagtgttgcttttaaagtgcttactccatttgtgtttagtatgttgacatggttggatttagatctactattttgctttctgtttttattcctgtttatccttttttacttcttacagcttaatgaattttggggggggaattccattttaatttctctcttgggtttttagctacatctttctttaggattgcactagagattacaatatacattcttaa

SEQ ID NO: 138597 - DNA, 443 bp, Homo sapiens
cggggtttcactgtgttgcccaggctggtctcaaactcataggctcaagtgatatgcccgcctcggcaacccaaagtgctgggattacagacatgagccaccatgcccagcctggcatttttttatgtgcccgacatctgtatatcttctttggagaaatgtctatttaagtcctttcctcatttcttgaattgggctttttgttgttgagttgtatactctatatacttaattttcatctattccttgggttgcctttttacctgttgatagtgtttgacacagaaaagtttttaactttggtgaagtgcagtttgtctactttttctttggttgcttgtgcttttggtgacatatccaagaagtcactgttaagtcgaaatcatacagattttcccctatgttttctgctaagagttttatagttttagctcttatatttt

SEQ ID NO: 138598 - DNA, 522 bp, Homo sapiens
gcctacacctagataaatgtctatcacattgtaagtgctcggtaaatatttgctgaatgaataaatacttgtgttttaatcaatccacacaatctctccgattgaaaatagtgcccttatatgtaaggagggagatctattactttaagacatgtgctggaaagatttactgtattagttcattttcacacaactataaagacatacctgagactgggaatttataaagaaaataagtttaattgactcatttccacatgggtggggaggcctcaggcaacttacaatcatgacaggagaggcatgtcttacatggaggtaggtgagagacagcgtttgtgagcgcaggaaaaactatgatttataaaacaatcagctctcgtgagaattcactcactaccatgggaactgcatgggggaaaccactcccacgatccaatcacttccctcccgggacatgtggggattacagttcaatatgagatttggatcaggacaaaaagcctaaccatatcacatact

SEQ ID NO: 138599 - DNA, 172 bp, Homo sapiens
ctgttttgatggggttgggagtgaggttgaggataggggatagattttacagtttctaggatgtagaatattcagaacttgacaagaggttagtaagggtgtcagaggagcctagctaggcacagacttgcaggtgtctgcactggacaactggaggtataatgaaggcctt

SEQ ID NO: 138600 - DNA, 494 bp, Homo sapiens
agttcgacggagactctccaaaatccattcaagtaccaaaaagttcttccttgtatctgacataaatccagtatgcttctcactgaggatctcttcaattcttccatctataaattgaaactcttttaaaaagagactaaaatacaagctttcatctggctgtattggaatccattgagaaaacagatcccaaatttagagtggtaaataaataagatgatattggcagactaaactcagggttttaaaatagaggggcactaagcagccagcttgacaagtacattgaaggtcatacatgtccattttgccttctctaatatgttaaaattttctggtatcgccatggcaatttacagagtcaacttcctgctttctgggcacccaatctaacctggaccacatatctgcctttgtatatgtaaatgtacaataataggaaagctacacagatctctcaaacaaaggaaggctttgtttgagagtctccgtcg

SEQ ID NO: 138601 - DNA, 299 bp, Homo sapiens
gagtttcctacctcgagtttcaggattacatagccatgcaccaagcaaggctttgaaaaataaagatacacagataaattatttggatagatgatcagacaagcctcagtaaaaacagccaagacaatcaggatataatgtgaccataggaagctggggagacagtaggcaatgtgcatccatgggacagcatagaaaggaggggcaaagtggagagagagcaacagacactgggatggtgaccccaaaacaatgagggcctagaatgacatagttgtgcttcattacggcccattccc

SEQ ID NO: 138602 - DNA, 358 bp, Homo sapiens
aggcttgggagccagatggcctgaattcaaagatctgcatcatggttttctactcttcattacagacaaattccataatatatgtaaacttcagtttcctcctctgttaagtgggaataattacagaacctaccttagagtataattataacacttattcaagtaaaacatgacaagcataagtgctcagtaactgttagatattatttcctattaagcaaagttttgttggtggtggtggtggtggtaatagactcaaatctatcaatcttttcctatttcttgattttagcttccctacctgaagtaatcctaataaaagtaatttttccctcaaatagatagctaattcttgcca

SEQ ID NO: 138603 - DNA, 207 bp, Homo sapiens
  misc_feature (189)..(189): n is a, c, g, or t
cttcccaccactggcccggcggctagctgccttcatgggtaggggagatgcaggcagctcggtgtgtgctcaccagagaacccagagtgtgcttacctgggtacctcctcagcctcagaaaccatggagagacatccctgcattctgacaatgttgaacttgacctgagccctgtggacaacgaagtanaggaaacccccacccacc

SEQ ID NO: 138604 - DNA, 429 bp, Homo sapiens
cagaaccacactgcaacaccaccttcaaattaatatgattgttcttagtcttgactccttcctggggctttttgtcagccatgatgagcaccggtttctcctcagctgccgcttcacaaaagagatatcaggtccacactgaacgagcacatgagcagcaccaggagccacagaagaaggaggcagcagcagcagatgaaggagagggaattttacttcattgagtgctagattttgttgtattcttttcaaaagcgctagactttgttctggcatgcagttaagttacttggaatcagtggtatcgttttgaagctagcatgtaaactttgttaggctggctccagagcacccattaggaatgatgtagcccgagtacttatctgccgtaaggcagtattcttctgaggactttacctgatgttgtgt

SEQ ID NO: 138605 - DNA, 561 bp, Homo sapiens
ctctcattagctttacgaaggcggttgagttttggagaagggatattatcatttaaactataaactaaatgtctcccaaagtttgcttggcccaagcccagatatgattaaaggcagtttggatgttgaaggcaagatggggattggtgagacccaatctttcactgtcgtaatttccttactgttataattttttgcaaagacagttttaggagagacaccaggccgtggagtcacagaaatccagtgggaagagtggatcaagaaaagactaatcagccaggcatggtggctcatatctgttatcccagcacattgagaggccgaggcagggagatcacttgaggccaggagtttgagcctggcctagctaacatggtgaaaccttgtctctgctgagaatacaaaaaattagctggaggtggtggcacacacctctagtcccagctacttgggaggctgaggaaggagaatcgcttaagcctgggaggtggaggttgcagtgaggtgagaccgcaccactgcactccaagcctgggtgacagagcaagactccatctc

SEQ ID NO: 138606 - DNA, 255 bp, Homo sapiens
gcctgactaatttttatgcttttagtagagacaaggtttccaccttgttggccaggctggtctaaaactcctgacctcaagtgatccgcctgcctcggcctcccaaagtgctaggattacaggcatgagccaccatgcccagccaaatttttgtgtattttaatacagtgttttacattggaaaaaaacagaaattgaagatctgccaactgccatgcctagcataataaaaatgggcttccttccccccacacc

SEQ ID NO: 138607 - DNA, 380 bp, Homo sapiens
ctgcagaaagtggccttcttctactagctagaggggttgcttgcagaactgtgctgtccctcttacccccagctcctcctctctcgcctactgactatcaccaaaccaacaactagggttaagtcacaagaacacctagttcggggtgctggatctgcgaagggaggaagggactgtacacacaaacacacacacacacacgttcccaaactgcaccaaggcaccccaaagcaccaccacagacacaaaagaataccatgggatatttcagaattttaaaggaaacacagcaatatctgtcacaaattactagcttgaggtagttcacggttttgacattagctcatgccacatttcttttgatgatgtcatatttttgc

SEQ ID NO: 138608 - DNA, 251 bp, Homo sapiens
tgggctctggtccaactcctggccgacatgagcatggacaatgtggcacagttgtggctctgcatcttgtgtgtgactgctgccctgtttttgtttagcaagctgctgtgccaatttactatgcatgttgttacatattctgctctaatttgactgccattttgcttcagcgagacgatgattgtttatggcagggctgtaatgtgttgtcagcacaggttactcgctacttgttggcaatggcctaacat

SEQ ID NO: 138609 - DNA, 169 bp, Homo sapiens
ggcattcatttttccattcacagaacactgattctgggttggttggtttgtttgaaatgggtcttgctctgttatccaggctgactatagcctcaaccttctgggctcaagcaagcctcccaccttagcctcccatctcaccctcccaagtacctaggactacagatgc

SEQ ID NO: 138610 - DNA, 299 bp, Homo sapiens
cctagctagtcagaagtctggggcaagagaatcacttgaacctgggaggcggagattgcagtgaactgagatcgcgacactgcactccagcctgggcgacagagtgagattctgtcttaaataataataataaacgaaagccacatagtatgtgattccacttctatgaaatgtccaggacagacccatttacagacaggaggggatgcgtgggggccagtggatgaagggtggcagctgctggggatggacatgactgccctgagactaggcagtggtgggagctgcgatacctactg

SEQ ID NO: 138611 - DNA, 439 bp, Homo sapiens
cgccaccatgcccacctcattttttggtattttagtagagatgggtttttaccatgttgcccagggtggtttcgaactcctgagctcagggaatctgccagcctcggactcccaaagtgctgggattacaggcgtgagccacctcgcccggccaaagcttcaattattaattgtaaaatttttctttgtaaataatactctatagataagatttgttaataataagaaatctgaaaaattcagtgtctaaatattaacttttgaaaattttacccttaaaaatggataaaaatctctgaaaatttttctataattcatcaattttaagaagtacatgttttttcacatcttaataatcctcaaatcagggttagtcttacaacttacagtacatcacagttgaattagcagcatttttcttggggacacataaaataag

SEQ ID NO: 138612 - DNA, 283 bp, Homo sapiens
gaagacaagttgatcctcaagtcagccagaatgttcagcgaatactgaaattcttcctaagcaagttatactttagattagaatatatttgactctttatatctggcaactgatttttgtttgtgtagggatattttggtttggttatcttgtaggtctctttgaactttccaattgaacagtgatcttaattgcctttcttttatttatttatttttttgagacagggtcttgctctgttgcctgggctggagtacaatggctcgatcttggcttactgcag

SEQ ID NO: 138613 - DNA, 183 bp, Homo sapiens
gaacccacattatgtcctggttttgcataataagtaatgctgtttattctgtttccctcagaatatactataggccttttctcccctcccagagcctttatccaggaccctttgacgctgtctttgctgcatacagtgtcaatccaaggcccaggtccccatatgagcccagggggggtgtgg

SEQ ID NO: 138614 - DNA, 304 bp, Homo sapiens
ttccagataaacttgtgagggtcagaagctgacagaccaagctcatttttcaagccaatctgtgtcatacagagaccacgggttttccttgggttgggtccttctacctggttcagtcagctgtgaacaaaacttgtggaatttggtcgttttccttaaaatggagatacgagagatcaccatggctggcgtgaaactagttctggatctgattgtcttttcaattgtttgtccatcaggtgaacccactctgaagggacttttggtaacattttccccaaaataaagatcattaattaattat

SEQ ID NO: 138615 - DNA, 355 bp, Homo sapiens
caaggtgataatttaccccgcaattctcagacttcacttgtaccagaaatgtttgggggaaatgtgctaagatgcgggtgctcaggcccttcccccagcgattctgattcttggaatttcaactgggactcaggatctgcattttgaagcaagttcttctggagattcggttgtgctgttctacagacaacatttttagaaagactgacttaggggaggtgtttttgatctctgtgtcttctgtcatttaagaagatttttcagtcacttgggctgattgataaatacagctgatcactcaggacacaatataaagttcctactcagagagaagctgacttgagctatctctacc

SEQ ID NO: 138616 - DNA, 262 bp, Homo sapiens
cccagagagctattcaatgggggaaaggaaaaacataaactcccaaatgagtaactccgagtgtcctttaattttcctctaacagaaaaccattttctaagagaaggtatgtgcacaaagaggtaactttttagaaatttaccagtgattttatcatggtaaattgagccacaatcccaatgagaatacttgctattattgttagaaatgcatagagcctgtatttattttcagaggagtttggtatcatttttatgagttg

SEQ ID NO: 138617 - DNA, 374 bp, Homo sapiens
tgccactggaacaggctgagctgtaattgaattaaatatctgtgtaatccctaggagaagctgaataaggtttgaggatcttggaagttcagttatactctcagtaactgaggtgagatccgtaggcaaggaatgacaagatcgagattgattagctacatgaccttaggaaagtgacctaaaggttgttcacattcagagtcctcatctttgaatgtgaatgatatttctggcctctcctatcttatggagttggtgtaagcatctgcatgagatgatggacgttaaagtgctttgttagctgttgagactcttactgaaatgaaacccaaggatgggtgccactgaaagaaacaagaatgaatgcaaactag

SEQ ID NO: 138618 - DNA, 203 bp, Homo sapiens
tggcaggcaccatgcaggcattgattcctttggaaagtggatcaggcatgactcagacttctggtgttagcacagaaacaggagatgtagtcaaagatatgggtgtcaataaccagagcaaggaaggaaggtgtccatggaaggatcatgaggcagctccctggatttctgaaaagcctaaaaagagaggcaatgaaggcaaa

SEQ ID NO: 138619 - DNA, 222 bp, Homo sapiens
gaaggtcgctcgttggaggctcccccctcggcaggttgtactacatttctggagtctgaaccaattagcctaaaggcagtacatgctccctccatgcacctttcttttctttttttttttttttgataaggagcagtcttccctctttgatttatagttctcataaggaaagtaatatatttcatgattagttttagtcccaagtcatttgcatattgaata

SEQ ID NO: 138620 - DNA, 689 bp, Homo sapiens
gtttccttgaactattggtctgagaatgtgaagggttttttttttcctttaagtaattggcctagaaaataaaaattttatgtcttatcaagggaatttcttgttcttgatgttgtcttttatcacgtctttggttacttaagaaaactaaatcttctcaatatcaaaaaacctaagtttttcttcacaactatgtaatctgctatatttgcctttaaaatattttattgtcaccaacatggtgaaaccctgtttctactaaaaatacaaaaattagtctggcgtgatggtgcgtgcctgcaatcccagctacttgggaggctgaggcagcagaattgaacccaggaggcggaggttacagtgagctgagattgcaccactgtactctagcctgggcaacaagaatgaaactctgtctcaaaaaaaaaaagttatcaacactttgattagataaccgagattatgtttaattaagtgctttaacccttttgacattttttataaacttcccaaaatcatattctaaattaagtctttttaacttcaagttaattttggtattttccagttgagccccaggatatctcaaaaggtatgtctctcacctagtaaaagaaagatattaaaataattacacttatttcatatgttaaattatataggaagcattgtgaaatgagaaataatgt

SEQ ID NO: 138621 - DNA, 428 bp, Homo sapiens
tcacagcatgatcaaataaggcttgtgactcaatgagacataaaatggcaataaaaggcatacaaattggaaaagaagaaataaaacttcatccttattcacaggatatgattgtttatgtagagaatcccagagaatctatttttcaaatctcctagaatgaatgagttgagcaagcccatacgacacaaggtcaatgcaaaagttaaccatatttccacatgcgagacgaacaaccaggaactggctatttttaaaaagtaacatgtacagtagctcccccaccacatgttatacacagtcagcccttgtgtctctgggttccacagcgtcagactaattcaactgcagatcaaaaatatcttgggggaaaaagactttaaaaatacagtatagcaactatgcacacagcatttacatgtattagg

SEQ ID NO: 138622 - DNA, 164 bp, Homo sapiens
agcttcctgaggacaggctctaggtcttacatctttgcattcccaggactttacatagtacctgtcacacagaattaaacaaaagaagttattaatagttcaatgaaaggtgacactcacgccaaatacttggttttgaggaggatcacatgagataatgcatg

SEQ ID NO: 138623 - DNA, 237 bp, Homo sapiens
ttcaattactatattctcattcccctataaacatcagctccttagaacttctgctccacatcaaccatcctgtctcactgacttcgagcacaaactgagctctgctgtactcactcccaaaactagtatatgcacattctgaccacttgagaaaaatgtgacaattaagcaacacaactcctcatttcccttattctcaggaaatctctggcaatggttattctacactcctctcac

SEQ ID NO: 138624 - DNA, 372 bp, Homo sapiens
ttattgcactatggaactcaaacagatttagttactcacttggcagcctggcaggaagtctctggatgggctgctgtattttgaccctgtttacactacactcagtttaacacctccttcccacttctcactctcagctggcagtcttgctgtttattgcaccaagaaaatagaagcacctgaaaaaaattcttggtcctcctattgccaaatatactaatcttcctacatctatactcgtattctctgacattcttcttattcaattagatgaactgccactgttccttccacttgtatgttggtcttcttcgttttgcctactcattgttcctagaattctctcttctcattctagtttttcatctattt

SEQ ID NO: 138625 - DNA, 183 bp, Homo sapiens
cctgaaggaaaaaaacagatggaccattctgcaggtgccccactcagtgaggttggaaaagaaggaatttcgatgcacgttttatgtgtgggcaacagaatgagaccacactgagtcttgaaggctttttcaacagtgatgtggccaaagaattagagcacacccagtggtacacatggagtc

SEQ ID NO: 138626 - DNA, 215 bp, Homo sapiens
cagctgagttccttgatgttagggactacatcttattcctttctgtatcttcagagatgctcaataaatgttttttgaatgtcttagttcactctttgcatccaagcttgaggctcttccttgagggaatacttcaggacaaacattgaaaaggattttatatctgagatgaaattgtattcacacgtccagagaatggggtaaaattcacaaac

SEQ ID NO: 138627 - DNA, 218 bp, Homo sapiens
cagggggaaaaaaaaccccaaacaattgaatgcagttacaggatgggtgggggagtggattattaatgcgctgcaaacatcctaaaaaccccctttccccatcagtcttcacagactgcaacaccccatccaaaatgtcttccccattctctgcttcgtcccagaaaatgatgtgaacttggctgcttggccctgtcttcacccggtcatatcctcag

SEQ ID NO: 138628 - DNA, 277 bp, Homo sapiens
ataaagtttgaattacatactatgtagcctttttatattggcttctttcacttagtaatatgcatgcaacttttctctgtgtctttttacggcttgatagctcattccttttttagcatcgaactatcctgcttttaaataaaaattatccggacactttgtttcccataacacagccacatgaggtcctatggctatatcatacttttctgatgattatcaggtgaaagggtgttgtaattaaagcattatacaacagaggggaaacaatttatcc

SEQ ID NO: 138629 - DNA, 336 bp, Homo sapiens
ctgcctcagcatcccaagtagctgggattacaggcatgcgccactacgcccaactaattttgtatttttagtagagacgggggtttctccatgttggccaggctgttttcgaactcccgacctcaggtgatccgcccaccttggcctcccaaagtgctgggattacaggcgcgagccactgtgcctggcccttgttgctttttttgtagaagctgctgccctttggaagttagaagggcttcaggagtacttcagttctggggtgcccatcaagatagaaggaacgtctagcatccccaaggccgggaggacctgagaaaatgggatgtgagtaca

SEQ ID NO: 138630 - DNA, 507 bp, Homo sapiens
taagggtatggtagatgttggtcttccaggcagccaaggacttgaagggaaacgcttctgggtcacacagcaactgcaccctgaaagtcagaagagtggccactccttccgcgctcttgggtctctgtggattctcttggactcacccttcttgcatgaatctatctgaccttccgatctcactcccagcagctgactggtctagtgcccaattccaattctaaggagagaggctctgatgggctccttggtcaggtgtctgctctggtccaatcggctctcacctcacccagacgcagcctcccactctcactcccacagttggctgggctgagggcaggttctcttagaaagggttggactcgaatcggaggtcagagactgggccagaggatgcattactgaagaatactgcagccatattttgcttggctggcatagtgtcttaaaagacctagaattggaatgctttgaggtggggcacgctctctccagccgaccccaggc

SEQ ID NO: 138631 - DNA, 198 bp, Homo sapiens
tgaaaactgtaaacccatagatccaagagtgtcaatgaaccccaggcacaccataagcacaaaagcagagaacagccacctccaggaatgccataatggacacttaggacagtacccactgccccactctaggcagctgtggaattgaggactagcatgcttaacccattgtagctacccacaacaccaacatggacc

SEQ ID NO: 138632 - DNA, 119 bp, Homo sapiens
aatacagcctgggcagacagaaaccgggacaacaaacaaaactcagtcatgccactgggactggatcttcacctgacagcaggcacggtgctttaccgcttcctgcctcattctcctca

SEQ ID NO: 138633 - DNA, 170 bp, Homo sapiens
tggtcaggctgatctcaaactcctgacctcaggtgatccacccacctcagactcccaaagtgctgggattacaggcgtaagccaccacccccggccttgtcctggctttttaaatccattgtaatttgtttttgcttattctagaaataaagaattaaaaaaaaattttt

SEQ ID NO: 138634 - DNA, 819 bp, Homo sapiens
atgcaccaccacacctggctaatcttttgtattcttaatagagacggggtttcgccatgttggccaggctggtctcgaactcctgacctcaggtgatccacccgcctttgcctcccaaactgttgggattacaggcgtgagccaccgcgcccggctagtatttctttactatattctatttggctgtctcaccaacagagacatcacaccattttgtcagttacagaagaatgagacatctggccgccagaggtcagcctaactatatttcggttagttttttttttggtttggtttggttttaatggttaaagccatgggggtatgggttcagtattttttgatattataatctgaaaatattttttcaaaggtgctagattaaatttaaacaacatagtatactgccttaaagcttacatttttcctgacttttgtactgtgaaacagaacaaaaacaattatgggaaagtaagagcctttttaaaaattttctgagtaacataataactgaagtatagccaattagtaatctcacaggtgcaatctggttgaagtgaaaatagtaaaaatattagaggacagcacaattaaaagccaacagcttctcctgtctcagttaataaagacttacggtccacgacaaagaatgaatactctttttcagattgaacaaggtaatagtactataatctaaacttagaagtattacattgtttcttcttaaagttataagcagtttcctttatattgctgtagtagcatcatatatgttgatcctgccttaaaaaaattatctcatttgtctttgtctaacat

SEQ ID NO: 138635 - DNA, 421 bp, Homo sapiens
ttttctccttccaagcctctgcagtctcatgagtttgtctgtatttttcttcttataacctaccttgctaccttagccagcctggatctcataggagattaactgaaatactcccaacattgggcctttcctgtgcccctgtcttcctgctgtaccctggcaaaatgccagcccaatccagtctgttgttctacttctgtatgagagggctaaagaaaaagcaactagtcatacagattaactctgttttaaattaactattaaatattttcaacctcatctgagtactctgccttgcctgatgccttttgcttgcctagccctgtttagttctcattctcttcaagaactttaccaaatcttctccttccccctcttgaccttcctgtctcttcacctgatacagaggttcttagcttcc

SEQ ID NO: 138636 - DNA, 119 bp, Homo sapiens
aggagagctttctggaggaggaggcaccaaggctgagacctgaaggatgggttcaacagctcttcttgaaatggggacctggggcaggaagatggtaaggacagttggggacatagtag

SEQ ID NO: 138637 - DNA, 251 bp, Homo sapiens
ctaactaaatatataagacgtagaccatgctttcaaggagctttcaactgacttcactggggaagtaagacatgagcatagaagcaggactggaaaggtaccctgtgagcagcacggacagtgaggacagtgagtggtgtggaggacataagagtcctcatcagagtggttttcagtacatttctgtggagctccacccatgtgtcagacactgctatgagtgtgggttccttgcggtctctacaaacccc

SEQ ID NO: 138638 - DNA, 161 bp, Homo sapiens
tttccattcttattcttagagtttccttgggtcatagaccacttactctctgaatctgctgattcatatgtggggtcctttgtaccccatgctgctagggttaaagcatctggtctactactcctgtagctggatagtgttttgctcagtctcctcctgaa

SEQ ID NO: 138639 - DNA, 410 bp, Homo sapiens
tcccctcctcagcctggtgtgatgactaaggcctccagctccaggtcactcagcctatgccagaatcacagctcagccagacctgagcaagccaggcctggcttgctcaggtctctcaataccttaactatggcatgttttataatttgcttttgtttttgctttatcacagtattttcctatgttttttatagtcttaatttttaagcactgctttaggtatctattaatagttcagaaagttgcgaagattacaagctcatatttgtgaaagtgtctggcacataataggtgatcaataaatatttccttctagcttgtctgtcccctatctcccactggttgtatgtatgaaacaaaaaaatgaaggagaaggctgagcatagtggctcatacctgtaatcctagca

SEQ ID NO: 138640 - DNA, 389 bp, Homo sapiens
cagcaaaggggctgagatggcaggttagccaaggacaccacacgcgtgagctcctggcagactctgggtgcgctacagcaaaaggcagaagaacttcaaaacgtccagcagacgacagagaatttccaatgactttggaattgggaagagtttcttaaatgtaatagaaaaaaatattagatataagctatgactgctaaactcaactatattgcaattgagaatttctgctcatcaaagacacctcagaaagagataaaagaaaagccaaggtgggaaaaaaaggtacactactgctgacagccagtcagtaaccagtaaccagaatatagcagaaactcccatggaacgggctgggcgcggtggctcatgcctgtaattccagcact

SEQ ID NO: 138641 - DNA, 485 bp, Homo sapiens
aattattgttcacattttcttgcatactctggataagacttgcatttttggtcatcaacaatgaagcacagcaacaacttttgagaaagtcattgaaagccagtattcatggtgcagcatcatctataacaatataaccagacttcaataaattgtattgcaaaagtagtacagatgtatattgttcattgtaaacaagttcccaagaacttggcattgtgagtaatgacagtattgctacttttcttcatgactggagatatggaattagccaagaacacagagatagtgcctggacattatgaagaaagaattttcacatgcactgattaagtaatgaatatgtaagtacctcatctgtatccattattctgaatgactttcaataaaacactataccccacatgggtccatgaattttgtaatactttcttagtcaaattatttatttagaaaaaggtcccacaaaaaaatatttatctgag

SEQ ID NO: 138642 - DNA, 320 bp, Homo sapiens
ggtgggagatgacgaagaaatcccttcttcctcagaggatttcaggaagttgcccagaattataaaggatctgaggttttaccctatttgcatgctaacaggttagctggcattatggactgaatgccccaaaattcgtatgtgaaattcccaacccccagtgtgatagtttttggatgtggggcctttgggaggtgcttaggtttagatgaggtcatgagggtcgggcccccatgatgagatcagggtcttcacaagaagagagaccaaagagctccctttctgtctctctctctctctctgtccctttctctctctct

SEQ ID NO: 138643 - DNA, 934 bp, Homo sapiens
ggagaatgcgagctctcacctctgacagcctgtatccatagggaatgtcatggaactgtcccacggtactgccggagtctctggtgccctttgtttcaaagcaccaacctactcttttgattcattcaggtcttttaaaaatgagttatacatatttaaaattcgaatctcaccaccacccacacataattaattatatcagttctttgtaaatacagatcctgctttttcttctcatttcttaattatgagcctttgttcatcacttcttcccaaaaataccctttcttaatgtttttccacccccaaagcatgagttacaacccattaattggatatgaaatcagtctggtagctaatgaccaacagtttttgaaaaatggaataaagccatcctggctaattttttgtatttttagtagggacggggtttcaccatgttagccaggatagtcttgatctcctgacctcatgatctgcccacctcagcctcccaaagtgctgggattacaggtgtgagccaccgcgcccagccgtttggaggtttatttctgactttatccatgctgcggccaagaagttgtctgcctccaagatctatctgtaattagctcttaaatgtcacagtagtatttatatagcacagttctcaaactgtaaaagacctcatttctaccctgggttgaggacattagtctgagtgaccttggggagggagttcagaaacatttcctcaccatacacttgtttggcttcgtaattaagtacatggtagtttaccctcagtacttgctcccgtgggataacagagccagcagtgtggatttttgggaactttgctgccccgggctgctgcacttccttttcaggaatgtctgctcttctttttttaagagatatggaaaagagttgcagccagtggttttgtgaagga

SEQ ID NO: 138644 - DNA, 492 bp, Homo sapiens
gtactcgtaacactgtagtgttagtgtactcataacactgtagtgttagctaacagacatagcctttacccttcctttgatccagaatgagaatctgcaactgccacaaggtttttacatcattgcctccaccctatgtgaacagacaatatccacaggaaattgtcaatttctttgcacagactaagcacctgcttgtattattaccctgctgtatacaaatgagccattttaggaaatgagtagaacaaatatgctctagaaactgcagtacaagcagtacccaatttgcagacaggttgtgttccctgagttgatttccaaattagctacttggaaatcagaatgcattatcccaagaagcagtgttataaatgatggccagcttcacaactgtcatccataaggccctggtaaactagcaacataattaaaatgacactgtctttaagaatgggctgttctttatggggtaaatgccctttacagggc

SEQ ID NO: 138645 - DNA, 188 bp, Homo sapiens
tctagatccaatacctccctacttctctatgtagatggcccttgaggcccacccatagaggttaagtgaggtttgcaaaatcagtgacaaggtggctagaagcacgaaagggaaaggccatatctaacactcacaatcactcttttccattacatcataatactctcgtttttttttttttttttttt

SEQ ID NO: 138646 - DNA, 416 bp, Homo sapiens
tcttgatacttcccacaaaacagaactaggaatcagcggttatgtcaactttccagggaatccctacaagtggaaggctagaatgataggacaaagaactgcctgtgcctctccaggcaaaaacctgcaaacatctagcaaaaaccttaagcactcttgaaattcatttattcagataacctaaaaattgaaatatgaatttatgctttattctttctttaccaatatagacatggtctcattgatttgtggacaatgatgagcttgaattcaatgcgaagaatctttgaacactttcacatactttggccctagttctaccacagctggaggagctctgtttcacttgatcgttgtgctggatgccattcggccacatggcttattccagccgctcttgtggtgatctgctctgc

SEQ ID NO: 138647 - DNA, 222 bp, Homo sapiens
aagttgctcattttggagtaggaactactttaaaatactgactttacaatattatttaagatactgaacacttattcaggtggataaatgctgggagaagttctatgtattaatttattcctgttgcacaaaggatgcattatctaagaaaatgcttgggcttatatataagcagtacaagtaaagggataagggggttgggtgcggtggctcaatcttgta

SEQ ID NO: 138648 - DNA, 289 bp, Homo sapiens
ttcataaaatctatgatgtttggtaaagtaattgatcagctgtcttaatatatatatatgtgtgttgtgtgtatttttagggctggaaattgatttttaatgataaagtacagtggacagcacagagggggctaagccaaactgtctgggatgctgtggtggcaatgagctggccacacaaactgctgctgctgctgcttctaggtggctgccttgctggtgaggtccttgccttctctgtagctgccagtgccatctcctttgcctgctccttggcttccttggctgt

SEQ ID NO: 138649 - DNA, 400 bp, Homo sapiens
agccctactctgaacatttgtgtatatatatgtttttgtgtggaaaaatgctctatttttatctcaaagatttgtgcatgcttcattacatgccaaaagccttattaaggccaaaatgacatcttagcatgaaataaagtacactttcttaaaccatattaatttgacttaatgagattctgaattgttaagtatagaaatcaatttgatttttgtgcaaacaatgtaaaataacatttggttgacctgggctccaaattacttggtccaggcagaatatgtaaatgagcattctgaatataaaatctggaccgtagcatttacaatttaataaaactaataaaatggtatacactgtactagagccagtgtctttggcaagttataatattctgtaaca

SEQ ID NO: 138650 - DNA, 529 bp, Homo sapiens
acccgatcctccgaggtcccctgcccccttctatcctgccagggaaacccacatctgcccttgctcccgggcctgtgggtttggacaaaggcagctcctctaccacccagcctcgtggccagcgccatatgcctcatccctcctgccccggcgttctgtcttcacaccagttgctccagccatggccagccacggccctgtccctggatgggcctgttaggcctgctccccactgctccccttgggcttcatgccaaagccatcaggccagtatcagtcctcacaccctgttcagctgggggcacctttgcacacagcgctgggttctcttccttggggaagctgggccccaactaaccctacctagacgtggtctaggtgcctggcttggggcccctggtccccttcattgtggcacagagaggaacccatcctcaggccaccctcgcaaaggtgggagccctaagtcctctcccgggagtgtacacctggactcggggagcttccagcctaggaggactcggagggc

SEQ ID NO: 138651 - DNA, 202 bp, Homo sapiens
tgtgcacatgtaccctagaacttaaagtataaaaaaataaaaataaaaaacacgttttggataatcaaagttaaaatgtccagcaggcggttgtgtgtagtccaaatcttattgggagaggcctggactctgctatagactcggggataattgaaaccacgaaagtagatgggccaaccttgggtgagattgtaaagggaga

SEQ ID NO: 138652 - DNA, 616 bp, Homo sapiens
gttcgcgaacgtgttatccaggctagggagcagatgacaaggagaagcttctctaaagcaatagcatggctcttaagcgtggctcaaaactgacacactcacttctgcccacatataattggccaaaacaagtcacatggccaagtccaaagtcaaagcataagaaagtacccttcacccataatgagtccatggtaagaagatagatgcagggaagactgaaaacactgaggcataaaattaaactaccataatgtctactacagcaaacgtcacacattcaatagagattcattggatgaatgaataaatagaacccaaaacattcagagtaaatctcaaagtttgtggaaataaaatatgccttaaaaaaaacccctcagtaatcatattcctctttagtaagctttgagttatcaatttaaccttgtttggacttaagtacatgcatttcttgttatggtaacaaattaccacaaattcagtagcttaaaacaatataaatttattatcttatggttgtggaagtcagaaatctgtgtctcactggactagaatcaaaatgctagcaggactatataccttttggaggctctgggacagaatcctttttctt

SEQ ID NO: 138653 - DNA, 372 bp, Homo sapiens
gaaaggaatgaaagacctagaatgtaggtgacctagagcggaggctgagtgaaacctccaaaaagtaggccaaagtcagggtggaagaaccctgaaggataaaggtactccctaaaagtgagacttgtggaagctgtggttggaaccctcaaaccttccatgtgtggccctggctcaggaatatgatatgactgcaggggtccacactggatctgggggtgcagtgggactggaggggtcattgttctatcagtgttccttgcttctctggcttcctcccctctttctctgactcctttggtggcttctccctgccactccctgcctgtcccctgctcccttctctttgccatgttctcccctgtggtgctg

SEQ ID NO: 138654 - DNA, 318 bp, Homo sapiens
taggctaatagcaagttaacatccatcgatagcactaacatcagtttttatttagttcaaacaagtgacataaacctcagggctcttgtttaagttcctgacagaagaatgtcatattccttatacatgattgttctaattgttgactgtccctatctcagatcttagcatctgcttaggtaaacttatatcaacaatatggaacaatcgttacactgaatcggctgttgtccaacttatctcattcagtcttacgtacccgtgagataactgacactgtttttccagtggaaaggccgaggctaaggcgttaaatta

SEQ ID NO: 138655 - DNA, 113 bp, Homo sapiens
agcaatcaaaaagaaaaaattcagatttcaccactcagagatgacactgctaacaggctgaagcatgtgttcccctctttctcatttgagtcatcccaggatgaggttatata

SEQ ID NO: 138656 - DNA, 188 bp, Homo sapiens
tatagtcctgtacccatgaaactccttaaatgtggcaccttgccgagaacccaagcaactgggttctccataaatgctttgtggccactgactctgatatacgagtaaagcaccaggcaattccgtttatttagccagcattaacctagcatctttatgttctaggaattctggggacacttttttct

SEQ ID NO: 138657 - DNA, 396 bp, Homo sapiens
aggaggaggaaaagcagcataatgtgatagaccagaggccaactgaataaagtacttccagtaggggactaattatctcaaatgttgcctactagtcaagtaatacgtgattggaaatcggctactgggtttaccaatgtagaggttattggttctcttcataggaaatagaatagggcacaaaaacctaactggactaggttcaagagagaataacaactactatggagttaatacaggcaaatctctcatggaattttgctattaagggaagcagaaaactggagcagtaactaggaaaattgcagataaagagatgcctgtttttaaagtagatgaaataacttcatgtttgtatgctggaaataatccagtagagaaggcgaccctggtcat

SEQ ID NO: 138658 - DNA, 310 bp, Homo sapiens
ccagattcatataagcggtagcatctgcaggatgatttggtggtggcttgtgtggtttggtcgggaagttccatgtctgcagtctaaagacctcttcagatggcctctgcagcagggtactcagacttgtaacatggtgactcaaggctttggaaaatcttgatagttcttaagaaagacttgggctgtagccctgcagagccacataaaattgcttttcgaacatacacatttaattctctctatattttcttttgctgcatttatatttctaagttacgtttttctcatattcgtaattgttgtggtg

SEQ ID NO: 138659 - DNA, 221 bp, Homo sapiens
aaatttttaaaatattttgtagaataggggtcttgctatgttgcccaggctgttctcaaactcctggcctcaagcagttctcctgccttggcctcccaaagtgctgggattacaggtgtgagccaccacacctggtccacaccggctcttaaagtattcacctggaagtcactgccgtttaaaaggcattggctaaaggaagtcacgtggccacactgggg

SEQ ID NO: 138660 - DNA, 253 bp, Homo sapiens
cttgaccttgaaccttccctgaggcctccagaggcaatttcctcctcaggactcagctgcccttcactcttccctcgtgcacagcctgtcctgtgagtaggtgcaggtactgactggtcttatctttcgccctgaaaatataaacgttttaaaggcacctgaggatttgtcagcacctccccacccccaccctgggtctgacctaggactctgagtcagggaggcctccctccactgagtaatagtagccttg

SEQ ID NO: 138661 - DNA, 397 bp, Homo sapiens
tccacaggaatcgaaaggactagaaactatgcatggagtcgacttggtccgtgttgttatgtgaatcgtagctgatactagtcgactccataccgtaatctgggtcatatgtttagtttcatgttatgcatgttttcccacaataaaaaaaaaaacaaaactcagcagtagagaacaatttaaaaacgggcaagagatgtgaagatacatttaacccacgacaacatgcaaatggaaacaagcacctggaaagaggttcggaatcacccgccactggggaaatgcaactaagaccacaaggaggtgttgccgcagagagaatggctgaaggttaaaaatagcgactgcagggatgttgacagtgtgcagagaaagtgaggccgggcgctgtggctca

SEQ ID NO: 138662 - DNA, 391 bp, Homo sapiens
ttttccatctggggagtaaaaagttctggaactaaacagcggtgctggttgtataattccgtgaccgtactaagtatcacttcatactttaaaatggctaaaatggtaagtttcatgttatgcatgttttcccacaataaaaaaaaaaacaaaactcagcagtagagaacaatttaaaaacgggcaagagatgtgaagatacatttaacccacgacaacatgcaaatggaaacaagcacctggaaagaggttcggaatcacccgccactggggaaatgcaactaagaccacaaggaggtgttgccgcagagagaatggctgaaggttaaaaatagcgactgcagggatgttgacagtgtgcagagaaagtgaggccgggcgctgtggctca

SEQ ID NO: 138663 - DNA, 574 bp, Homo sapiens
cataagaaccctcagaatgcagtaagaaaacaaccaaccagatttttttaacgggtaaaagatttgaacagatgcttcccaaaagagaaagggatggcaaataaacatatgcaaggatgctaaccatcagcagtcattagagaaatgcaaattaaaaccaccactactcactaattagaatggcaataattaaaaagactgactgcaccaaatgatagcataatgctggtgggaatgtaaaatggtactgccactttggaaaaccactggcagtttaagaagaaactaggtaggtatagaacatatagctaccatatgattcagtcattctactcctaggtgtatgcccagagaaatgaaaagtttatgtccatacaaagacatgtacatacatattcatagaagctttactttaaaagtcaaacactggaatcaacccaaatagattatcaaaaggtgaatggatacacaaaatgtggtatatccatacaatggaatactacttaccaataagaaagagtaactattggtgcatggtacaacacggatgaatctccaaataatgctgggtgaa

SEQ ID NO: 138664 - DNA, 273 bp, Homo sapiens
aatctgcatacacacacgcaaacacacacacacacacacacacatgccccaaggaagggcacaaagggaaaatggccatttgctgcagacacgtctttgtaatgagaattggcggttaggacagcactcatccctgtcttcgaggtaggaacttcagggaagataagatgctcagcccaggcccaaggccacctctcttaggaacaaggttcctttcccttgttactgctgctgtcaacagcaaagacagtgtgggaggacaggggagtgcca

SEQ ID NO: 138665 - DNA, 292 bp, Homo sapiens
gggcaattaaaacttttgttccagtaaaggtttcattctaaagaggtttcattaattatgaaaaattccccgtgggcattacattgtgaatccttttgtagctatcataaataatgaaggaaaaacacttgtcaaaatatagcagaggtgactagataatgcatctctcctttgatttttgatgggtttccttttttaatttttaaaggaataactcttgcttatttttttaaaaaagtaaatactcgttataaaaaattcaagcaaaactgaaaagtaaaaagaagccagc

SEQ ID NO: 138666 - DNA, 321 bp, Homo sapiens
gttttacgcctaccagttgaatttattggtatctttgaaattgatacctagcacaaagcaaacaatttatcttttcctctcttccgaatcttgctcttttgttttctctttttttggtgttaatatcagaaccagtatctactgtgtcatctaaaacaatttaggaggttatctgaatttccttatatatctagatttttatcgatttctgtgagtcatttcatttgctgctactctggtgtttatgcccttactgtgccctatttatagtagtttcttaattgatttttataatcctagtctagctctcattgtcaagag

SEQ ID NO: 138667 - DNA, 120 bp, Homo sapiens
gcgcagccgcggagccgccctcggccgcagccacggaaagataagaatgttctgggcccaggcggtgagctcggcccccaggaatgcagctccagctcccgctccagaggcgcaggggga

SEQ ID NO: 138668 - DNA, 268 bp, Homo sapiens
ataaagtgagatccttagaactgtgcaagaatatgtgtcacccagctgttaactgtagtgacgcggcgtgaccacgcaggcctggagcgcgggccagccttcctgaggaggctccagtctgtactcacgtgagaccgttgaaaagaacgtggtgtttctgtgcccatcttcacactgtgtgtgtaatttgccaaccaaaaaaagaaacggaattaagacagatgttcggcatgaatagagcttatttttagaaggagaactgatgagc

SEQ ID NO: 138669 - DNA, 580 bp, Homo sapiens
taatgacaggggaaattgggaaatttaggtctggaacatattcaggtgaaaaactgagagtcctgttttaggcaggatgattaaaatgtctactaggcatctaaatagaaatattatggaggtagtttaacttatgagtcctgagaaggaggatatagcaggatatacatatttgagacccatcactgtgttgtttaaatgccctgaaacttgaaactgatgttggtaacaagtgaaagaagagatccaggggcagagccttgagccatgcccacattcagaggcaggaggagaggaaccaccacaggacacaaaggactggtcaatcaggtgaaggccagactggggactgtagtgtcctagaaattaagtgaagaaaatgttcctgaaaagaaggtgatttgctgtttaaatgttgctgaggaggcacgagggtgttagaagacagagaataaaccattggaagataggtattgcttgtatcttgagaagaatggttgtagaaacaacttattttgtagtggtgtttttttttatggcctaatttttagtcacttttgtgtccatttggtaattttta

SEQ ID NO: 138670 - DNA, 563 bp, Homo sapiens
cgttcaggaaaaggagaaaccacgtacctgtagcatcccctaggctcctggcttcagtacgaacccacgtagccttagccccacggcggggatacctgagaaagcatgcaccccgccagcatgctgcttggccctgttacccccaacccccgctgcttctgagcctctccagccaggtgtctgcagggcttccaggccttgcatgaccccagcagctcctgggaccatggccctgtgacagtcaggacacacagatagggctcctcgagctctgtggacggtcctaccccagtccacagctacatctcttctctcactcctcctcccatccgtttgcttaaaagcagggcctttatttttttttcttccttaaatgttttaagtaattggagaaatcttctggaagctgacaagctaaataaatacgttgtccactcttctgagaggcttcacattctgttggaaaatggatttaatccctaaaaaaagccttgccccattgggtcttcccagtaaatgttgagaggtacggtaggttgagtgtggtttagccttctggctgt

SEQ ID NO: 138671 - DNA, 262 bp, Homo sapiens
agttcgacggagactctcggcttggggcggtgtcatctcgaacttcttgctcttctccatcattatttatcatcagtattttcatcattttcaccataggtctcttcagcattatgctccagttcccccatgtatctggcttgcatctctcagagggctctgcttctggactagttcaagtatctgttgtacacctcatggaatgaacccagatacttgaactagtccagaagcagagccctctgagagtctccgtcgaact

SEQ ID NO: 138672 - DNA, 225 bp, Homo sapiens
gccggaccggctctttgggaggcacttggcgtggcacctggcgtggctcttcgtgtggctcgtgggggaagcgagagataggagactctggtctctttaaagtaagataatatatttgctatataatctctttactaattagtaaagagtccgtgaagaaaataagaatctactaacgaagtggcaggattcatccaatcaattactaaacacatcccaactccg

SEQ ID NO: 138673 - DNA, 269 bp, Homo sapiens
cagatgaggatggcaggctcagcacaggggcccatgtctctgtcaccaggcaaggtgggggggctctagggccagaatcgctcccacctccagccggggatcagaggtctctggttagcagccgaggcgagcgggacacaggctgagggatggggacagctgctcgcccggcacagacaaggctcccctccccatgctggagaccccggctgccccatcagtcacggcccacccaggaccatgcaatcatcctccacttctcctaatcc

SEQ ID NO: 138674 - DNA, 221 bp, Homo sapiens
cttgtgcatgctcccactaccagtttgatttgcagcctcatggttgtgttgtactaaatgttctttcttctggccttgtccagtgaaaacggttcacatggctaacaccacttcttgagatacgggcaccacgtaaagcaggaaaaatgggcctctcgggtgaggaggaggcacaatagtaactaaaccaatccattctcagctttacgtggtgcccgtat

SEQ ID NO: 138675 - DNA, 434 bp, Homo sapiens
cttatgagaattgccacgaacaaatctaagagatcatggcaaagaaaagaatgaaatgaaaccagaacatttcagcagcttttgcaaagatgtcaagagaaccagtccaggagtcagactggcggcatccttccagcttcttgtcatgaattctaaacctcacatccagactccaaagcttagagagttaaagaatcagctactggtcaccaagctcacgtgtgcaggatgagggtcacagccaggttggctgccttccagccctgagctttcttgggggtgtgtgtgtgtgtgtgtgaaccaccttctttttgagacggagtttcttttttcttttttgagatggagtttcgctcttgttgcccaggctggagtacagagtgaacgagactccgtctgcaatcccggcaccttgggaggccatactggcggat

SEQ ID NO: 138676 - DNA, 744 bp, Homo sapiens
cctctgatccataaggcgcgtctgcgtagctgcccaagggatctgtcaacacacacatcaacatgctgattccctgcttaatcccttccccaccagtttcactctggataatgttgaaattcttcaggtgtcatccagagcccctaatctggtcatgaccttttctcccaagccttgctacttaccctccaaccccctccctatggctgctctgtcaaactgcctttcatcctgtcctgagtgctcactcactctcacctatttatgccaggctaatggctacatcatttagacttttacctcctctacaaagctgtcaatgcctattccttccaagctaagttgggtcttctcctctgccttccacatccccttagaactttctctcttacatctcatcccattctaccttactctctattcatcacctatccatctgactggagagtgagcttcttgagggcaaagaatgtgttttatttttgtatcctacactccaagcatagggtcttgctcagagtaggtgtaaaacgtgtgtggaataatcaaattgaatgtatggatgaggtcaaaacaaagacaacgttgggaggcagttctccatgggttgcttatgtttctgcatgtctttcaagtaaggcattggctgctgattgttctggactttctttcacagatatttgaatagctaacagcagccttggaagactgatattgtctcctgctgggacaaaggcaggcaga

SEQ ID NO: 138677 - DNA, 461 bp, Homo sapiens
cccagacgccatgaccttgcagcctttggccccactctccatgatgaaccgcagcacaccatagcaggccctccacacagcaagccctcctaggagtttgtaacgcagagactctgcctgggcaatggcacacagacctctagtggcaaccttttcagcataaagctctacactgccctctggaaagccaaacctcttctgaactatagcagtcagttcccgaatccgtcagcccttctcaccaggaatattctgtgttctggtggctaagataatgatttctgtcctggttggtgtaacttgcatctcaactccagagtagccatcttcagccagctcctgagtaagaaactcattcagttcagctttgaagatgtcatcagtgacaaacatcctcttcttggaaatttgcacagccatcttgccgccacgctccactgaaaggaaaggcctaattttgt

SEQ ID NO: 138678 - DNA, 376 bp, Homo sapiens
ctgtgctttgggacggcgagagaggtccaatcttccggccggaagattggacctctagtggcaaccttttcagcataaagctctacactgccctctggaaagccaaacctcttctgaactatagcagtcagttcccgaatccgtcagcccttctcaccaggaatattctgtgttctggtggctaagataatgatttctgtcctggttggtgtaacttgcatctcaactccagagtagccatcttcagccagctcctgagtaagaaactcattcagttcagctttgaagatgtcatcagtgacaaacatcctcttcttggaaatttgcacagccatcttgccgccacgctccactgaaaggaaaggcctaattttgt

SEQ ID NO: 138679 - DNA, 348 bp, Homo sapiens
ggatgtgccctttatctaaaagggattgccacagtatctctttaactcaactctaacaaaaattttggaaaaaaaacaaaagaaattctcctgcccaatggcctggagtcttcctgttctgctctgtaaaatgcaaaggctatttataataaatgtgtataacaagaatctttgttaagtggaagagattccgaagccctaggcaggcagcatagctcattttctttatgcaatattcagcagaaaaaacctcccactactccaaagactgcgggccattccctggccttcactgtactataaagagatttgacttatcttcccaccacccaccacccaccagatctc

SEQ ID NO: 138680 - DNA, 263 bp, Homo sapiens
aacaacaacgacaacaaaaaaggagggcaggataaaactctgcctgagaggttctgttttctgaggcctaaagaatcccaacattctaccacagggctgtctttcaccttcatcactgatgctattccaaagctgctttgggaaccacggaccaaagtccacatactttaacagaagagatacttattgtttcagtcacttaggaaataacaagcgtcctgggagtgatgagccatgaacgtggatggaaaccaatgtacatg

SEQ ID NO: 138681 - DNA, 498 bp, Homo sapiens
atctttacctagcttgacaatatatcagctcatggccaatcttgtgtcatctacccattacccactgccctctgccatgttttattttgaagcaaatcccagacaacatatcattgcatctggaattattttagtatgcatctctaaaagaaagggaattttttaaaaagctccataacaccaccattgtcacaactgaaaaataattaacaataattctaataattccaataattccttatagcatgggacgccaacaacaaaacaaatcattaagcctcacccaaggaggatcatggcaagggaaaggcaatcatgcaaaattcagattaacagcatgaatcacccaaacaaacaaaagtacctcatcttcagtcttgccagagtaaactagcaggaacatagattaaatgaatatcttaactggaaatgcaaagccatgcacccaaatggtaggaaaatctttagttcagcagatgtgacacaagtgctactaag

SEQ ID NO: 138682 - DNA, 163 bp, Homo sapiens
gccccacaccagctgattgttcagtttaacaggtggttctctgcaccagcacaggtggcagaacccatgttctgcagaggcatagttggtgaatcaggactagcgggggagagctggagctctcatttcaggcacatgaggtgtctacttccagccctggtgt

SEQ ID NO: 138683 - DNA, 544 bp, Homo sapiens
ctttttagtagagacagggtttcaccatgttagccaggatggcctcgatcttcctgacctcgttattcgcccacctcgacctcccaaagtgctgggattacaggcatgagccaccgcgcccagcttctaccagtcttgatacctccaataatagctctcttgtgctcacctgcaagttcaggttcagggaacagatgcctgggagtccatctttcatgcaaatgactttcttccagtggttgggaagatggcaagaatggaacaggagagccgtggattcaggctcgtctgagttctagtctcaatcccaccatttcccacccgagaccgtgggtcagctcacaaattcatacgtactgaataggtgcttaaaatgtgccaggcattatgctagatgatggggaaatcatgataaatcagaaaggcacagccaggcacagtgactcactcctgtaatcccagcactttgggaggccaaggtgggtggatcacttggagtttgagaccatcctggcaacatggcaaaaccccatctctacaaaaa

SEQ ID NO: 138684 - DNA, 287 bp, Homo sapiens
aggaagcaacactgactaagacaccctcctgccctccaagtgcacagggatgaggggatgtgctgtggtatattagatctgaagccaaaaagaacaacttgaacatggccttgaacttgtaaatgtttttttccaaacaatatcactgtggctgggtggtaacaatatgttcagcaaatggtagctatttaaatggtagctatttaaaatcagagccagctaactcaacctgtgacagcagcactatgatatatgtggggaaagcaatattatattcagcctttaga

SEQ ID NO: 138685 - DNA, 464 bp, Homo sapiens
accccactcacattacacagaaagagaggccccaaaggcagagagggtggctccaattacactggaggtcaatggaagagtcaggatcttggtggctgggggcacaccccaatgcccccctcaccagaagaacccctcaacactaggacagctgagtcaactcacagagaagcctcctccagcccagccccacccaatccaggccaacaggaagcgaggccccaggtcaaggtgggatggggagataagggccttggtcctgccttgtgcggctagtcaagcaggcaagtgacctcttctggtgtgtgtggagcagaggggtccctggcacagccacactcacgccctgtctgccacaagccggcaaggggggcttctgggcagattctggagccaggctgtgtgggttcaaatcttggtttcaccacttcctagacaagtgaccttgaacaagttacttaact

SEQ ID NO: 138686 - DNA, 367 bp, Homo sapiens
agacctgctccgctcagcgtcgggcacgatgcccacctctgtctgaagacttggaatgagctccctctccccaaccgcgaaacgggagcggtgcaagcccctagtccctcatctgcgattcccaagctccaaagctgcctggaagcccagaagtttttcgtaatccaattggtggcaaaattgcgcttgaactgatgtgaggctgttgatggtctttatttgtcaaacttgtgtgaatattcatgttttgctgcagaaatgcaaatgagctcgatgaccggctgctgccccaagccctgctgggaggttatgtgacctacagcaggtgtgtgccccatagtctctttccaagtcccagctgttctgt

SEQ ID NO: 138687 - DNA, 314 bp, Homo sapiens
tgactgccacccagcctcaggatgtgctgccacttggctagctttggcccttccctgtccagtgcatctggagcccctggggcctggccgtttcctttcccacgattgtttgaggttttatcccccagagtgtggagccgggagagtttccagagtccccgggctgtccctgcgccccacagcccacccaggtgttgtcgccacgtgaacgtgaacctggtagcccgagctggggcctcctgcctatgggagctcctctggcccactcgtggggacagccatagtgacggctctgccgctagccagaaaccaca

SEQ ID NO: 138688 - DNA, 325 bp, Homo sapiens
ggcatgccctgcaagcagaagcttttagctcacactcacttgagactgagggccacatagggtgcaaccgtacgtacaatcttacggtgtggggtccctgtttctcatgaggttctctaggaaaggtagtttttttggttctccatcatgtacccaacgaaattaaaagaatatggaacaaaacagccttgcaataaaatttcgttgagtgaatgacacctgtgtcaatacacttggaatggatgtagaaaagataactttttctgttacatctgaatttgattggcaagcatgttgtccagtgagtctgcatctttgcccttag

SEQ ID NO: 138689 - DNA, 133 bp, Homo sapiens
catgcccaggtgtccccagaatgaaatgcaaccaccacatgcacatttctattattcctgttcagatcttgggctgagctcttccttaggagtttcttcactggctgtactatgttgagaggaagactctggg

SEQ ID NO: 138690 - DNA, 103 bp, Homo sapiens
cgccacagtaccaggcctgtaacgatgaggtttcttcacccctccagtagagggcgcactcttgcgagcggcttttgtagccagttgcttcctgggtgcttac

SEQ ID NO: 138691 - DNA, 374 bp, Homo sapiens
gatgaagactacacagtccaaattttctattgctgctgtaaaaaaattaccacagccttgatggcttaaacaatacaaacttcttaccttgcagttctttaggtcagaagtccgacatgggtatcactggactaaaattaagatgttggtaaggccgccctcccttctagaggctctgagggagaatccattttcttgcttttcccagctgctgggctgcctgcattccatgctttgtgacctccttcttccgtcttcctcgccaacgcagcaagttgaattcttctcatgctgccactgccacctctctggttctatgtccacagctgagaaagtttcttctctttcaagactcatgtgattagagtggcccc

SEQ ID NO: 138692 - DNA, 347 bp, Homo sapiens
tggcaacttcattgctacatcttagtgtttaaattacagcagtattagagatataaaccaaacataccttatctaacatcccccaaaactcatcaattctaattctagttagaaagtcttcaagactcctgtctctaaaaaaagaaaaataaacacgtaacgtgcatagagctacatgtgtgagccttgcattgttctaggagctcatagagataattcctcacttcattcagtcatcttacagattcctttcaaatgaaggatagtctgtcttaattgtcatttagatgaataactgaataagggaggtgcattcattcaagtcttttttactttttctaaataat

SEQ ID NO: 138693 - DNA, 235 bp, Homo sapiens
gagctccttgctctggcgtggtgtttacttttttaaaaaataacgggggccgggggctgtaatcccagcactttgggtatgattgcaggtgggtgtgacacagtcagaaatagtgtgcaaaggcggaaccaaacatggagtggcttctgctgggtccatccacttatttctctaaaaaagaaagcggaggcagacatgcaagatgtcagcgtttgttggctctgtgtggcaagca

SEQ ID NO: 138694 - DNA, 379 bp, Homo sapiens
gcattttaatttgataagcagcagcggcagttttctctgaagtgctgaaaacatggctttttctggccctgttccagataggattctggttgccacagagaggggtttgatattgttgtttatttctcaacaaagatcttgcatatttgcataaatgtggaagatgctgcttggttctagacaaccagaatcaaatgaatacaggctatctttaggttatgaatatctatctgctctaggaaggtcacagagatactgccccatccccagctcacaggaccacccagtgacctgtgcagtggatcttctgacttaatgtccttacccttctgcctcccccatctacttatatgtcacactattctcaatctcttccctt

SEQ ID NO: 138695 - DNA, 720 bp, Homo sapiens
tattctgtaaagatggaatagaaaaactttttgtaaatctgctgcttttagcttttgcaaatgtatctgttcatctgtatcatgttttaatctgtatcatcacttattcaacatatttttctagtttaacttttaaaaatcatacatttttggttcaaaattaaaatacacacactctgaaaattttctctctcactctgttcccacatttaccactatttgtctaccctttagagtttcatgcttatacagtcatgtatgacagtacaatcttatacctctcattttttacacaaaaggtcacagacaatacatgttgccttgtaccattaatttctcatttactatattgtggtgatgtttccatatcataattttttataagtcaagattatatatgcacatcgttgaaaagttgaataattataaaggttccttaagaaaaatagtactacattgtccatctcaccatcactttcattttcctttggcatactgaattcagcaatgcatattatgaccaaattgggtttattccaggaataaaagttgtcttaacattcaaaaatataattgtgataatgcatgatagtagcagattaaaggagaaaaatcatgagatcatcttaacagctgatttggttaacattcagtattcattcttaatctcaaaaaggatatcaacaaaaaattatcacaaagcatcaaacttcatagtga

SEQ ID NO: 138696 - DNA, 129 bp, Homo sapiens
ttctgagggtcaaaggcaacctctagatgcttccataggcccgcacagagttctgctcctactggttgtccaaaagcactcatcctggcatctgcatctgctcacctgtgtgctcccccttttgcaagg

SEQ ID NO: 138697 - DNA, 209 bp, Homo sapiens
ctgctcctccataccacccccaccatctcctgacactgcacttcttttgacttttcacagagaagagtaaatctcacctgagattctcatttatgaattgactgatacgtttttcacccctctcctccaccagaaggtaaactccaccaaagcaaagattctgttgtactcagagcaatatccccagcacctagaactgtgcctggccc

SEQ ID NO: 138698 - DNA, 394 bp, Homo sapiens
gcaaatgacattcttattttctacccagtagtttattagagtttctgacaagatataagaactgattaaagggttcatttttaattccctttctcagccatggctaccaatgagcactcaatggataaagagatgggtgattagagaagagtcattccatctagctcaagtgcctgaggtccctgctcctagaataatggacaattaaccattaaaatgccctttggaagctctgccatcccagagactgcagggagagggcaatggggaatgtgtttaatgggtgcctggagatggacggtggtaatggtagtgcaactatgggaatgtacttaatgccacagaacctgacacttcaaaatcattaatggcaaattttatcaatatttcacca

SEQ ID NO: 138699 - DNA, 213 bp, Homo sapiens
tctgaaatgacagcctgtgcttctcatgatacccatggttttggtgcgtcagcttttgatttctggttaaacaaggcactggctgaatagttagttgtcttttaattctcttcccactagagtgcccctttcatcctgctcagaaggaaggactgtaatgttacctctttttaggactcattgtttctccctctcccagagtgaccagcattt

SEQ ID NO: 138700 - DNA, 299 bp, Homo sapiens
gcctgactctctcagggcagcaaaacccagtgacaactgggcacttcctggtcctcttgaggtcaggccagggcagagtgtgtaaggcatccataaaacctgggggtgactctgggctcataccagggctgcagtcctcagggtgactaggataagagtgtgcaccgtccctgggccagctggagggaaggaaggagattgtgccctttcctggggagtgacagcccctctccatttcggcctctgcaacactgagggaaaatgaaagaccccacattccgctggagtttccaccagag

SEQ ID NO: 138701 - DNA, 286 bp, Homo sapiens
tcagctgaacaagcaaagtacaactctcaagcaatgcttaggtttgggagagaggtttttgcatgctctgcctatgctaacttccctttgaatttcatagttcctttccgctcagagtcaggatgatgaaatgtattcagatttagacgattagaatctcaaagtcccaactcttctctctgttccctgccccaccagcagctttcttagccctcttagaagatagaggagctgattcagtgtattctttcatcaaatactgattgcttgttccgctgaacgccct

SEQ ID NO: 138702 - DNA, 269 bp, Homo sapiens
  misc_feature (258)..(258): n is a, c, g, or t
cctagttcctggcaggtgaaggacaaccgtgtgagacaattgcccacaagagaatggactgcttggatgatggaagctgacccagacctttccaggtgtcctgagatggttctccagttgagtttgtcatctgccacgccccgcagcaagcctgtgtgcattcataagaattcggaatgtctgaaagagcagcagaaacgctactttaaagtattttcagacagagtggtatatactccagaaagcctctgcaagganccgctggcctc

SEQ ID NO: 138703 - DNA, 437 bp, Homo sapiens
tgaggctgggttttggaaaaactcttgtgctcgtgatgcagtcaaaggaaggtccgcgggtgaatcattctgtgaagccaactttgcaagattcctgaggacagactgtgtgacctgtccctgtccctgcagcccatgggcggaggcttcaacacacattttacagtttacaatgaactttattttttaattttatcgattcagggactcactctgtcacccaggctggagtgcagtggcgcaatctgggctcactgcaaccaccacttcccaggctcaagcaattatcctgcctcagcctctggagtagctgggactacaggtgtcagccataacacccagctaatttaaatttttttttttttatacagatggggtttcaacatgttggccaggctggtctcgaactcctgacctcaagcgatgtgcctgcctca

SEQ ID NO: 138704 - DNA, 397 bp, Homo sapiens
agggaccctggcacatctgccacccgcaccagcccccagagccaaggcccccgacccatgctccggcaggtctgggcagcgagccatgccctgagtccagggctgtatttcaggacggtaaaccaatgcccatgctccctacgtatgtcctgggttggacacagcagggcaagacatgtgccttccaaagccaagcagcatatggccgggaggtcagctgcttccctggccagagacaggcccagaggctccgaatctcagtccatggccccaggggacatgtggaccccagcaggaatgctcccaggaggcctgacctggcccggggaggggtctggctgcttgtgacccatggccctggaccccaaaactcaggctccttgctcacaggctcagc

SEQ ID NO: 138705 - DNA, 309 bp, Homo sapiens
tgtatgtctgtcctgtcactgtagcagaaattgtaatttaggacaagtctcacatgtaaaagtaataaattatataactcaatatatgtggcagattaatggactttaagatgtttgatgatagattagcaaatgaagttaaatcacctctataatgttatcagacattgattcaattttatcctttaataaagtccatgaagctaataaaacctttgaggtaacctgccaaatagactgaaacacaccttctaaaaacaaaagaatccacagatgtcactttaaaaatctgcatgctggctgggggtg

SEQ ID NO: 138706 - DNA, 277 bp, Homo sapiens
cctgcaccaggacctgattcttcagacagaagctacaggatagacctgttcacaggccgacctcagatcaggtagaaggctctgagatgcgtcctgtgctgagggtccctcttgaattgttcctaggagggatcagaggccgaggagagctgttgggttctctttcagttacctcttttagaaccttaaatatcaaaagcagtgtttttcagactttctaaaaaccatcttcctactgtaagagatacattttgtgttgtgacccagtactcccatg

SEQ ID NO: 138707 - DNA, 369 bp, Homo sapiens
ccttaagtcctcagcgtctaaccttgggtttattttttgtttaattacagttctgtcttgtaatatttgtttctgtaagttttgtctctttcactagattataagctcttttgaggtgagggatcacattttaccaatcttgctagcaccaagcagaggactttgcaaacaaaacataaatgatcttcaacaaaagtctgctgcattgaatgagcatctgggatgagcctaaacccaaagcaatagaccgccacctaatatatctgtattactccccctggggaggcaggtagccagcccagtgggtagccctgccctctatttttgaagtaagatctttccctgtcccagacctaaactaatcccagg

SEQ ID NO: 138708 - DNA, 178 bp, Homo sapiens
gcaaagccccctggatagtttattttttagcagttcagcttgtgcttggacccagttgttccagaaatcagtaaaacctatttgagtattcaagaaaaaggatctttttgttaactaaggattaactagaaaccttattttataagggttcctgaagtctgcttatttactaaggaat

SEQ ID NO: 138709 - DNA, 372 bp, Homo sapiens
gtctttgtatctattacctcatctgacctgccaacaaccttacaagtgattagactcatgatccctattttatagatgggttaggcagaggcccagagaggttgaaaaacgacttgttcaaagacacacagctggcaagtggtgaagccagcatacaggatggtctccaaagcttacatttgcaactgtcactacagggcacagtatttcctgtttaaatcatgatttttaaaaattaaagtaaatggcagagcatggtggctcatgcctgtaatcccagcaccttgggaggctgaggcaggcagatcacctaaggtgaggagttcgaggccaacctgaccaatatggtgaaaccccgtctctactaaaaat

SEQ ID NO: 138710 - DNA, 144 bp, Homo sapiens
agattctactgtcctatgacttgtactcattactgattctccagctcgtaattcaaatacagtttgtgtatctatatccaaaatgcttggaacctgaagagtttcagaatttggacggggagaggttgattttggaatatttgc

SEQ ID NO: 138711 - DNA, 386 bp, Homo sapiens
tgaaaagaacccagagacccagctattattattattatttgacacagggtgtagctgttgcccaggtttgagtccagtggtcactgcaatctgtgcctcccaagctcaagctatcctcccacttcagcctctcaggtagcggggactataggtgcgcaccactgtgtcccactaatttttctattttttgtggagatggggtttcgccatgttgcccaggctggatgcaatggctcgcacctacagtcccagcactttgggaggcggaggcagaaggattgcttgaggccaggagttcaagaccagcctgggcaacatagcgagaacctgttcctatgaagaataaattaaaaaattagccaggcgtggtggtgtgcacctgtagt

SEQ ID NO: 138712 - DNA, 336 bp, Homo sapiens
caattatttatataaattgaagcactgtggcgatgtactgagcaagtttcttggtgccattttttcaacagcatgtgcccacttcttatctctatgtcacatttttgtaaatcttggaatatttcaaactttacaatttttattatatctgttatggtgatctgtgatcattgatctttgatgttactattgtaattgctttagggtgccacaaaccacgctatataagatggtaaacttaatctgtaaatgttgtgctgtgctctgccaatcagtagttccttatctctgtgcctctccttgggcctccctgttccctgagacagcaatattgca

SEQ ID NO: 138713 - DNA, 395 bp, Homo sapiens
cgtgggacaggaagcggaagcggaggtcaggctgagaggagatacctaggaaagccggggcacagagcaaagcagccgtggaggcgtgcatgaccaatgcagagccagccatagactcttccaagcctccttcgaggaggccagtgtggggaggtggaatatgtagggatgaacacccacactatgtgtggaggtatgtttcactttaggttttgatgaactaagacctaagaactatcgagttttcacagtagttccaaacactttcaaatacataacctagtggagattgtttagacaaggtccttgccttcagcatttgatgattctatttataattgagaaatcagaggtgaatctatcgtctcaataattatgacaggcgaagttccatt

SEQ ID NO: 138714 - DNA, 777 bp, Homo sapiens
gtacagtacataacttcatgaatcatgcttatacacatgtatccggtgggtcaagtgtgtttgccagttgccacaatcagggctttaaaacttttgaagtcaatatttaaaagttgacattttgcattttttaaaatttaatttcaaggttgtcttgaaacaacagaagctctgaccacactggggctgcaagcctacgtggtatctcttggctggatcagagcaactgttgccctttggacagggcatgtaacattcagtctcccctgctctaaattttctccccaacatcaaagccagccttgcttgaactggtgcttttcttatactggagaaatatttttttggacctttgttgcttttgcagctggagaaataagatatccacatggttattcttaccccagcctgcatttactagatttttggattttacagcctcatctcatcaaattattggaagcatgtgggattgtaaacctttcagtttgacaaaaaacgatatacattccaaactaataaaacaatcatctcttttaccaccatttcatgaagcaaaaggacaatttcacaccaaaaattagggtagatgtaattatgaagaaaagaatgggcatccccaggaaaacactcgcatgtggttgcaagtgggagtagccccttcaaagctggcttaagcataaaagggctccaggaacagctagatctaggaggcacgcatgataccatcaatgcctggtccctctctctctctctctctctctctctctctctctc

SEQ ID NO: 138715 - DNA, 441 bp, Homo sapiens
tctgttactcagctttgccaataacaggtgtttcagtagcccctgaatctgagctctgcgtgagctccacctctgccccatggtcaggaaattgtcacaggcagagagagtttggatgatcctggaacttaccttgtgagcttctcttttctcaggcattgcagtcttgtgctacctcttgtctgttgcctgaaaatggctacttcatgtatttggcctgttgtaatagtcgtttatggcaagagagctcatctggcaccagttattctgttatgacccaaagtggaaatctctccctgtgtcattttgagtttctggaggccacagtttatggccagacttggagggtggttcctcagaatgtcagctttatccttattgtttcaggcagctcatctgctagtacaatggttttcacacattaggaggagggagaatcat

SEQ ID NO: 138716 - DNA, 344 bp, Homo sapiens
tttctctggcagaactcagaagtcaggacaggcatgggtgggccgcccaatcccccaggagagtgaagtaagggattccaatgcgttgacaagcgcatcgctgaagtgttggaattcaaaagcagaggcaaagtccagcaggagcagaggggttggaaagggacctggaatgggaaaaatctgatgttcttattgtaatctgtcagctgagctgaaggacagaagcttctggtgagtgggatctctggatttcagctcagaagcggttcctggtattaacagtgtctttttagggtaacctcctcctcctagtttgagcactgaaagtcctgcgtcctgtgaaa

SEQ ID NO: 138717 - DNA, 149 bp, Homo sapiens
tagtcattactttttacttgtaaatgccaaatgcctttataaccatatgacttattaatagagtctccaagtcaaaaaggttgaataactaaggtcaagtatcaaatgaccagaagacctggaaatatgtgatttcaatatactgaatg

SEQ ID NO: 138718 - DNA, 320 bp, Homo sapiens
tccctactctcattgccccagtttaattcctcaacacctctcacctagattattgtgatactctagttttatcttttaaatcctttatattgcaaagcagagtgatttacctaaaacacaaacacaaccacaataagcctctatttaaaaagctttcaacggttcactgttgtctctacagaatgtaaacagagcgtcttaacatggcacaccaggccctccttaacctagccctcccagcccatcacaacaactatattccttgatattctcgaattgcactttattttgttttgtttttttgagacggagccttgctc

SEQ ID NO: 138719 - DNA, 395 bp, Homo sapiens
acataatatcatagctggcagaggccccaagggtggggaggaagaagctgcctcctggagaattaaccaaagaccccacacagagacatgaggccatcctggccccttgtctgttgtccagagcagctatggcattgtggggcttggggaagacagcagagaagtagcagcaggttgggtaccagccagggggtggacctatgagttccagcttgctgtgatgaatgctctagaggtctgtgactttaagagtcttggaaaagaatgagacatgaaggattaggaacaaagtgtccttaaagagaacatgatgggccagcagggttaccatagccaaggatggaggggcaggttttgaacaggggagggaggttctggggattctggatgagaac

SEQ ID NO: 138720 - DNA, 404 bp, Homo sapiens
aaatctttttccacctaggccccacctctaacgttagggagtataattccacataggttttgatagggatatagagacaaaccatattattctgtccctgatcccatgaatctcttgtccttttcacattgcaaaatacaatcatgccttgccagcatgagtcttaactcatttcagcattaactcaaagttacaaagttcaaagtctcatctgagtcaaggctgcagcctcttttgcctataagcctctgaaataaaatgcaagatcactgcttctaaggtacagtggtggtacaggcattgtgtaagctttccatatccaaaaggaagacattttccagaaagcttcttatttctatctgagacctcctcagcctggccttcactgtccatgtttctgtcag

SEQ ID NO: 138721 - DNA, 405 bp, Homo sapiens
cccatagaggatccacccaaagccaccgggagaaccaacacatccctgcagacgacaaaagcgtccttttgctcatggccacatgccttgcagcacaagctcctctcaaatacttcccaggacctcaccgtaagggacagtcaaccagacgtgtgcttccacatgttcttcaaatgtgtttttcatttgcttgggttcaacctcattataatggcattagccagaggaggtagcatggtggttcaggtttctggaagtggggttaagccagtcctttcactttcttaactgaaattccccaacgcccttggcttactcacccctcagcatgctttgttctctttctgtctttttctgtctaggttctctatcatgagtgtcctcttctctgaattcatagccttt

SEQ ID NO: 138722 - DNA, 258 bp, Homo sapiens
cattcccagaaagaaacgtgtaaaaacaaaatggtcacacctcctatttgaaccatacccacagaaatttgttcattaggtatttcacagagactagaaaataagaatggaaggcttttagattaataaaagctccatgaaagccaggattttggaaatgctgtttctacaagttactagctggatgagttcacttctctatgcctcaattttctcatgtgtaagatgagaaaattaatagtacctgtgtcatagagg

SEQ ID NO: 138723 - DNA, 341 bp, Homo sapiens
tacaagtcagaggacctcagctccaggtcaaggctatagcaggatgcagaggaggaggctgagaggtgggcctccactaagttcaggctgcctgggaggacagagcctgggcaactgggagccactgagggcttttgagggccatgagatgatcagatgtgcattcagagagatcattggctggatcgtggaggactggagacctcgggagtctgttgcctcggaaaatgatagtggcactggagatatgaagaaccgagaggtcgaggtaattgtctggatgtttggggccagggagcagccatccgtgctgcctctgatgcctggctgacaaggagcct

SEQ ID NO: 138724 - DNA, 278 bp, Homo sapiens
aagctaatgaccaatgacttacagaattcagagctccggtaccccgccataggtcctccacttcaaaggttgcactgacctgccttttctgatgtctctggacatgctccaccttcagaccctcagctccaccgagaccaccagcatcaggctccagcccatcctgtgcaaggcctccccttttttaaggagctagtttgatgtctgctcatcttaccaaggaccctacacccacatccataacttgctagtgaagacatcaacctaggtgccaccta

SEQ ID NO: 138725 - DNA, 401 bp, Homo sapiens
aagctcccctctagcatcactccccgttgaggctgcaggtgaggggacaaagtagagcgccgagggtcagatgcctttggagaaagtccatgagaggagtgtagcctgcacatctagacatagcttggaacggggaagtgaacggtaaaaagctacggtgggtaaacatggagacacaagatctgggttaactggccatgctatcttctccagaaagatagggccaggattaaacctagtatcagctcactctaaagcctgtgcttctatcacggtgccagtggccggcctgggaatggaccccaagcttcagaatcctggtcgagtgtgtcttctcctgtcacaagtttagggccctgggttcggcaaattggggagttcacggaagcaaatggctttgg

SEQ ID NO: 138726 - DNA, 472 bp, Homo sapiens
aagctcccctctagcatcactccccgttgaggctgcaggtgaggggacaaagtagagcgccgagggtcagatgcctttggagaaagtccatgagaggagtgtagcctgcacatctagacatagcttggaacggggaagtgaacggtaaaaagctacggtgggtaaacatggagacacaagatctgggttaactggccatgctatcttctccagaaagatagggccaggattaaacctagtatcagctcactctaaagcctgtgcttctatcacggtgccagtggccggcctgggaatggaccccaagcttcagaatcctggtcgagtgtgtcttctcctgtcacaagtttagggccctgggaagactagaggcagggctaggcaggatggaagtcaggagtggtggacagggagggctgttttctgtttaaagcagtcagtgtggagcaagaagtcacgtggagaatagagt

SEQ ID NO: 138727 - DNA, 334 bp, Homo sapiens
  misc_feature (24)..(25): n is a, c, g, or t
agaggatcccgttcactttctacnnagaaaaagtatcttaaaacatgtcctggaggggaggtgggcaaagtggtgatttgggaaggttttggatgtgttggatggattggtgattgaagagactgagggtagagatgtaaacagaacagttaaaacattgagttgtacaggtctggcgtacagagggaatagactaggataataacagcaaaagtagagagaatagaaaagaaagagtacttgaaagcatagatgaaatatctgtagcaaaacaagaaacctagttgttggcatttcaaggcatcacctacttttggatttgttagctacttat

SEQ ID NO: 138728 - DNA, 1144 bp, Homo sapiens
tctgttaagtcgaagtaccctagccagttcagttgaaatttccatttattcaatataatcctggatgagaagcggtcaagatttgataatccttaagtggcacggttggtccacatttgaacctgaggcaccagagaggccagggtattaccaacttccatgctttgctatgactcaccagcactgtgaatgttactctgctgtagtcaaagcaaagctggactgaaattctctgtctttcccaacactaatggatctaaggggaatattagaagcacaactggaattgttatgaaagaagttagatttgtaatcttgaggcctgacatagcagaaagtgggttaaacatttacactctgaagtgtattatttacactccaaaaagggtaggggccatcctagttataaataaattcattcagatgtggctaatatgatactttaggtacagaatgaagaacaggaagggtagtggcacctattaagtggacttcacaatcttttttatttctggtaacagcttttcatatacatgggaacatgatgggactttatttgcttattcatttctttaaaaagcttttcattttgaaaaaagttcaagattagaaaaaagttactaagtatgacacagaattcctatatttacttcatcaaactagtcttagcatcttaccacacagcaagtatcaagcaggaaatattgagaaaatattaactaatttatagatctcattcaaatttcattatttatttccctaatgtttttatctgatccacacattgcatttaggtgtcgtgtctccttggtctcttccaatctgtaagagttcctcagtctttccttgactttcagttccctgtcttccataactttgatacttttaaagataactggtcaggttcgtttttgttttttcttgtactcactgacagcagatggtcaggtattttgaagaatgtccctcagtatgtgtttgatgtttcctcataatcacattcggtttaggcattttttgcaagactaggacagcagtctttctgtctttctcagtgtgtcatagtagaagacacatgattgatacatctcagtactgattatgttacccttgagacacattgatatcatgtgccccttgacat

SEQ ID NO: 138729 - DNA, 208 bp, Homo sapiens
tatgtgagcctgggcaacatggcgcctggcagagtgggcgctaggctgaggttgacctggactagactgaacttcatctgcagggcagccagcattttggattgaacacatagctctttcagtcaggaactgtacagaaagatagggggaaaagcggtttgtggtttgatccttgctctacaagagctgttagtctagagagacccca

SEQ ID NO: 138730 - DNA, 397 bp, Homo sapiens
aatcatgtgcccattagcaatcactacccactttcacttcctcccagccctaaacaaccactaatctattttctgtctctaaatttacctatctggactgggaatgtgcctgtagtcccagctactcaggtggctgaggcaggagaattgcttgaacccaggaggcagaggctgcagtgagctcagatcacgccactgcactccagcctgggcgacagagagactgtctaaaaaaaaacatacacacacacacacacacacacattatgtatctggacatgtggtattttatgatgggcttctttaatttcatatgttttcaaggtttatacatattgtaatgtgttaggttttcattactctgtgtagctgagtatatgccacattgaatttatct

SEQ ID NO: 138731 - DNA, 426 bp, Homo sapiens
tcacaatgaaaataaaaataaaaataaaaagaaatacacttaacttttacttttttctttgaattttcattttgttttatatgtgttctagaatattcattcatagtgaatagcttgttatttgacagaaatgtttcatgttatattaactccctgacagaattaaacttgttttattggctctcaagtattgagtttaaagaaggggagaaaaggaaaaacctggacaacgagccattgcgaatatttgtgtctgtgtagggaacttttagaagggtttcttttgaaggggtggacctcttttgctccagccaccctgtggagttgagggatgtaacttgtaaccttcatcctagaccatgtggattgactggcacttctctttacagatttgcctgaaacaaaagtagttccaagcatctcttg

SEQ ID NO: 138732 - DNA, 902 bp, Homo sapiens
gggcattgtcattcaggattttgtgtcctatcttcatatctcattaactctgtggcagccccagggagatgagtggtgtcttatgatctttggttccagggccctgtctgtaaggaagaagtcgcagggcagaaaggtgcctgagtcaaggccaagcccagtgcccctgattccttgtctggggtggtttttcctgttccctggttaggccttcccactacaatttcaggacatttccagtcactgtgggactctgaaattatgtagctttcttttgtcccggatttgatacatggatctgcggggaacaagcgaacacctttgccccagctggtggtagggagaagacagaattgtttacttctgagtggctcagttgggtctcttgtttttcccagtaaccaagtctagcttggtcacttggagccccatgcagtcctttgttttttccctttgatttggggaaacacctgagttttttcccttgaggattctcaactccctgcccctggggtgagcctcagtatcttcatctgtaagatggggctaatggtgctgcactgcctgcctctgtcaccgggagcattgaagtgcctggcccaggtggggctggggtgtagacaggggccggggtgcacaggatgtaattctagtccgtagcttgccgccttgttgggggaatgggacgctcatgagagtgacattatgagacaggtcaactgatagagatgcacaaacaggctttttcttttataaaaaactcggtatgctacacactttccccagatactctcattcacctttagtggctctcattaccatctaaatgtgggactcctcaagtcattcccaccaggcctctattgggaggcagaaatggcagaacttggctggacctctcg

SEQ ID NO: 138733 - DNA, 379 bp, Homo sapiens
tgctggggccttgcaccctgatggagggcaggcagcgagatgtttaccaacataacaacaagccatggaccatctccaaggacatttagcattacatttttcctgagtgtgacgagatcaagggtcccaagtcctttaaatactctctatctgggaaaggtagtactgaacatctatgtgggaagatcatcagaaccagacagaggaagaggggaagacaagaaaaggcaaaatggggttcactaattgccaagtgcagcatctcctccttcagttcctgagggtttgggagttctgagaatggaagtgcagagaggccaatcctggagtcacaggaggtttccacccactcactcagtgggttatgtatatggagtaa

SEQ ID NO: 138734 - DNA, 436 bp, Homo sapiens
tttgaggtatctttgagataaaagaaaggcaaggccgggcgctgtggattacaggcttgagccaccacgcccagccagtgttgttattttatatatgttgcaaaatactaaatatatggttttccttttgctcttgttcacttaacattgatacacactgaaaggtaaaaagactaatcatactctaccttcctcagttattacttacaggtgtgtatcggcttccaaaatcgtaaaaagtaatattccagatccgatgattgaggccaactgcagagtccaagaaagcactctcttatttagtgttctgagttttcctgttcttttataaagccttctatatgctgtctgaccttggatttagcagtcttttcatttacctatctttcccttagaaggccaagatgggactcttactagctagggagcatcattg

SEQ ID NO: 138735 - DNA, 420 bp, Homo sapiens
tccccctgcctcggcctcccaaagtgctgggattacaggcttgagccaccacgcccagccagtgttgttattttatatatgttgcaaaatactaaatatatggttttccttttgctcttgttcacttaacattgatacacactgaaaggtaaaaagactaatcatactctaccttcctcagttattacttacaggtgtgtatcggcttccaaaatcgtaaaaagtaatattccagatccgatgattgaggccaactgcagagtccaagaaagcactctcttatttagtgttctgagttttcctgttcttttataaagccttctatatgctgtctgaccttggatttagcagtcttttcatttacctatctttcccttagaaggccaagatgggactcttactagctagggagcatcattg

SEQ ID NO: 138736 - DNA, 246 bp, Homo sapiens
gatggggtatgataccttattcatcttatctcttaccttgccttaataaatgttgttaattgaatgaaatccgatggcactcttatctgtatcttttaaaaagcacttgtcctggtctaataataacatctgccagttgtacattgcctaacaattcactgagtactttcacatgcattttctcatttcatccttgccagagcctcgtgaggtcagaacgattgttatcccagtatacagagaaga

SEQ ID NO: 138737 - DNA, 288 bp, Homo sapiens
gctgggattataggcatgagccaccacacctggccacttcttttatttttgagaatgacatttgtactttcaagtaaaaatgatattctgtgaaaaaaaaatggcttgtttagctcacaattaaatcacaagtgcttttccttaacacaactctacctcggtatgcagaattactttatgtgaactttctgcttactccagaatagtgaaaagaaaggtcaagatttaataataccattaatttttactgcttcagcaaggatattcatgagtgaagcaggtgttttt

SEQ ID NO: 138738 - DNA, 266 bp, Homo sapiens
ttcctttagctcatcaagcatatttaggacaagtgatttaatgtctctgactagtaattttaatgtctgagcttcctcaaggatagcttctgttaaatcctcttttcccctgtgaatgagccatatttttgtttctttgtaattttttgagaactgaacattgagtattataatgcagtgactctggaaatcagattgtctccctcctcaggaattgcttttttgcttattgaaggatgcagtcttctgtgtccatagtgactttt

SEQ ID NO: 138739 - DNA, 264 bp, Homo sapiens
cagacctggaggcacagagtgatgtagagaggacaatggatctgaagccatgtatctgggtgccagacacgctgggtgaagccgagcaaaccgctcctgcagatagattgagtatgcacacccagcactttgggaggccgaggcgggcggatcacgaggtcaggagaccgagaccatcctggctaatatggtgaaaccccgtctctactaatacaaaaaattagacgggcgtggtggcgggcgcctgtagtcccaggaggcgga

SEQ ID NO: 138740 - DNA, 500 bp, Homo sapiens
gcccaggtaaatgcaggcacaaacggaggccgctgatgcttgagggagctgggctttgtgctttgtaggctcttgctgagggaggggcaacagaggtaaactcctcgcttactccctcacctgtgcaccaaacacacccaccaacaaccaacgcagaacccaggaaggaggccacggggtgatcagctggctcttcaggccctgctgtctgtggtggccttacctggaggccctcagctcacctatacccatctggagatggctgaggagagaagaggggctgtgtaacgttccatgcttgcccttgtcaatgataaagatgtccccatctcctaaaccgggcagagggagctgggcagagggaggtggggacgcactgcctcagaggtcttctctcggtctctgctggcagtcacctgctcccggaagaccagcgccctcctccctcactgttactctgtttcatttctaagatgtgagccaagataggtggcctctga

SEQ ID NO: 138741 - DNA, 438 bp, Homo sapiens
ccaacaagaaaaaaatagctaaaacatgttaagtaaaagaaccaagacataatatgtattgtaggttccagtgcgtataacatatacatgtgtatttatatatatatgcacatgatataaactgtgtatgttacacatacttgtgtatatttagtatacacagagaacactgaaaaggatacatcaaactggtaataagtgttacacattgggaatgaactgaatgggggaaaggatatgggtctttcactttttccttcaaatacttctgtctaatttgattttttttaaacaagtatcttattactttcattttttaaagtgcaggacattaaagctgaaaggcgcccctaaagactagccagtctatctagaaacagtgactcacatatccaaggtcaaagaataggagtaaaagatttagaactcctgactgct

SEQ ID NO: 138742 - DNA, 726 bp, Homo sapiens
aacaggtgatatgcccaatttgacccttgagctatagtttgccaaccactattacagactaagaggattagaagaaactgagtcattttacagaaggcaaattgagagccatgcagagtgtaagggaggtgtgaaagtccccacagccagattctgcatccatacctgtttcctttctctgcaccctactgccatctgctgttagcagtgataatagcatttagtggagggagatgggaaatttgtattaaaatgcttccacagtcaggataatataattgagataagacagtagttcacccaaaatcgtgtaaaataattgccatgtcatagaatagaaaataatatagtagcctcaccagtgaaagttttgtaaccagtaacataaaactacagattgaaatgttattgcataaaacttgtacaacagtgtagaaatcttgtttttgtttagaagattggagaactcagagctgtgtgcctataatccttagaactggatatttagctttctaagaagcactttgctcagccagaagtctttaactcacagtgtcctataatcttgctagctaggtggcctaagtggttaatattctgagtgatttttgtagtttcccctttatatagacctcctggccagaatggttaccttcaccggtatttgtttgcgcgatctcgatgtaagttattaatatgtattagggtcagagtcggggggcctga

SEQ ID NO: 138743 - DNA, 164 bp, Homo sapiens
catcctgcaggggatggcgcagatctggggtccatgtctgtgagcggacaccattggaacatgtgtctagagaatctgggcgggatcactgcccacagcccttcaaggcccacaaacctacaacacatctctcctggaaacagcacgtgatcccatatgccccc

SEQ ID NO: 138744 - DNA, 550 bp, Homo sapiens
  misc_feature (1)..(1): n is a, c, g, or t
  misc_feature (10)..(10): n is a, c, g, or t
  misc_feature (12)..(12): n is a, c, g, or t
  misc_feature (14)..(14): n is a, c, g, or t
  misc_feature (17)..(17): n is a, c, g, or t
  misc_feature (28)..(28): n is a, c, g, or t
  misc_feature (45)..(45): n is a, c, g, or t
  misc_feature (48)..(48): n is a, c, g, or t
naaaaaaccngngnaangggggccgggnccttttctgggcccagncgnccggaagaaaccccccgaaaaactcaaaacaacctactggattttaaaagccatgtacaaaagggctcctgctgcatgatgtttatataaagtataaaagaggaaagtgacctatgctgttagagatcaatatagtgtccatccctgagaataagtgactgggatcacaaggtggtatctggtggtatctttgggctaaaaatgttccccaccccccgctttttttttttttaagatctaaaaagcctcagacaaaactgtccccaatatttaaaactatatggtgctatccacttaggacatgtgcatgtatctttaaatattttaaatacatgtaagaatttttgttttaagttgaaggatgctaaatagagtattgctgcccacagggcacaggtattaagttgcttgacactgcgacagtgtttaaaagtaagctacaatttctaggttaaaaacaaaaataaaacaaaatataaataaatataataaataactatat

SEQ ID NO: 138745 - DNA, 364 bp, Homo sapiens
gatccgcccgcctcggcctcccgaaagtgctgggattataggagtgagccaccgtgcctggccctggtttgcttgtgagctggtgactctgctacatgaagagcaaactttgaccaagttaatctggcacattgactaatttgcataaacatttttggtgcagcattgtcgtaaggtatatagattaggcagggagcaagagagccaaggacaaactgcacctgggccaccagcccaaagttgtcagcgtcatctcagctccatctggcaaagagttagtgagcaccaactgttctgcagtcagaatctagcctcaacctgttaggacctcccagggccctgagcagacaggtgtgcaggaact

SEQ ID NO: 138746 - DNA, 398 bp, Homo sapiens
gaacattctccatcctctgcttcctctcaggccttgtcacctagaaactccaactcacctttcatggcctagtacacttgtcccttcttctgtgatgttctccatgatttctcccccattcttgcccacagcttccctgcagttgcccccagcatttggataggctctatcatagaatttctcgaatcatgtgcccattgtacttacattagatccttgagggtgggcactgtggcttatctgacccctgtattccctgtagtttgggcagtgatttgcagaaataggcatttaataaacacttgccaaaaaaaaaaaaagcaggactaagattttagagcaaaaagaaaggtttgagaatgtctcatctaagccccctattttgtaggtaaagcctg

SEQ ID NO: 138747 - DNA, 424 bp, Homo sapiens
tgcaagcaggcataccacagcaaggtgtcctgcttcgtgctgcagcagatcgaggagccgtgctcgctgggggtccacgcagccgtggtcatcccgcccacctggatcctccgcgcccggaggccccagaatactctgaaagcaagcaagaagaagaagagggcatccttcaagaggaagtccagcaagaaagggcctgaggagggccgctggagacccttcatcatcaggcccacctccctccccgctcatgaagcccctgctggtgtttgtgaaccccaagagtgggggcaaccagggtgcaaagatcatccagtctttcctctggtatctcaatccccgacaagtcttcgacctgagccagggagggcccaaggaggcgctggagatgtaccgcaaagtgcacaacctgcggatcctggcg

SEQ ID NO: 138748 - DNA, 372 bp, Homo sapiens
aaaaaaatgtgtgagatgggggtgtgtatgtgcccaagccgtctcaaactcctggccaagcagtcctcctgcctcggctcccaaagtgctaggattataggcatgcaccaccgtgcccataatgtgagcatctttccatgtgcagataggcattccatcatcataggaggttctgtccaacagcactccagaggataggggtgaaaatggcaggacctgtgcagagcactatgggtggttgtcactgtattgaagggagttccttggaatgggctcctccccctggggggatgcaatgttccctactgtgtagggtttggtaactcaggccaagtcaggcagcctgtttcttgagtgtttaaaataatgaag

SEQ ID NO: 138749 - DNA, 427 bp, Homo sapiens
agggatatggcacagtctatttagtcaggaaattatgactgattgctcctatgggcaaattcaatcatactttgtagtaaacttcctataaatgtcacaagtaggattcaccaatggaagtcttcttcaaaatgctaccttataacaggcaaaatatttcctaattgaaattttgaattaatgtgctttgtattcaaagtaacaaattagccacaaaatatgcaggtagctcatgttcaaatctaaaaaagaaagggacattcatgagctaaataacagcatgctgacccccagaatctacacagtcctcatctcagatcacctcacagcacctaaaagaattagaaaagtatatgaaaagttactacatggggctgggcacggtggtctgagctgagaccatcgtgggggaacctcagaacgcaca

SEQ ID NO: 138750 - DNA, 747 bp, Homo sapiens
agggatatggcacagtctatttagtcaggaaattatgactgattgctcctatgggcaaattcaatcatactttgtagtaaacttcctataaatgtcacaagtaggattcaccaatggaagtcttcttcaaaatgctaccttataacaggcaaaatatttcctaattgaaattttgaattaatgtgctttgtattcaaagtaacaaattagccacaaaatatgcaggtagctcatgttcaaatctaaaaaagaaagggacattcatgagctaaataacagcatgctgacccccagaatctacacagtcctcatctcagatcacctcacagcacctaaaagaattagaaaagtatatgaaaagttactacatggggctgggcacggtggctcacgcctgtaatcccagcactttgggaggctgatatgggtagatcaactgaggtcaggagttcaagacctgcctggccatcatggtgaaacccactctctactaaaaaatataaaacctagctgggagtggtggcacgcgcctgtagtctcagctactcaggacgctaaggcgggagatcacttgaatccaggaagtagaggttgcagtgggccgagactgcgccactgcactccagcctgggcgacagagtgagactctgtctcaaaaaaaaaaaaagttagtacatgggtcgggtgcagtggttcacacctgtaatcccagcactttgggaggccaaggtgggtggatcacttgag

SEQ ID NO: 138751 - DNA, 349 bp, Homo sapiens
gcatttcagttactgcatcagcgagcatgctctgcaaatggcaaatcattctgatagccaggtaaaaggacaactgagaacagtcaactttctcccctgtcaacatggtatcctccgtggtctgcttcctggtactccagctacagttcccagagcatcgtgctcactcccacttccacacctttgggtgtgccatttctttctgcttgaaatgactctcctgactcgcctcccaaactcctcctattgactttccattctcagctcaaatactttctcttccacgaagcctcctttgacttttatagtcatattgagacatgcttcctatgttcccacggtgttttat

SEQ ID NO: 138752 - DNA, 473 bp, Homo sapiens
cctcttggatcatgattttcatcactttcttgcggattggcggacctgttggtgctgagagtaagaggtcttctgtacctgaccattgcgtttcttagtaaaaccaacacagaacagatgaagcaaataaccattagtggtcttgacattaacatgagcttctttcatgatctaccagtttttggccatggaactcattttgtcacaggtaagatccatgcaatggaagttaggtcgtttagcgcctcaacatcctcagtagtcagcttgaatttttaaaatgcaatttcatcattctgcagatcagaaaggttcacctcaaatatacacaacacttgaggccatcagatataattttggttccttgagtcctggtgactagtgtttctctccaatatttcttatactgaacacagcacgtgctttcatatcatatctatcttttttagaaagtagattaaccacttctttgc

SEQ ID NO: 138753 - DNA, 411 bp, Homo sapiens
  misc_feature (141)..(141): n is a, c, g, or t
taaggaggagcgagtggtgcttggacacaaggatgccactgttcttatctcctccaatttgggaagtgcccagcctagaaaggtgagggtcccatctgggagaccatggagtacccccaggtcacactgagcctaagaacnttcaaccatcctgcaggtcaaaacccactgataggtctcccaaaatgtttggggtagggggaagaaacatagggcattccaggtctgtaaccctgcaagagagagactcaaactaatatgtctaggtctggggtgaaggtggggggcctgtctggatacctcctccctcaattgaagggctcgttggaaacataggaacccactgctctctgggactctggaaagacaaattttctttggcaaacggaacagtgtcgcgctgtcgacaga

SEQ ID NO: 138754 - DNA, 388 bp, Homo sapiens
ggcagaagcaaaggaagtgtgggagggcaccttcccaacggaaggtaaaactgccattcaggcaaattagaacacattcaaaccacagaggataattcatcttctcctcattcagacctagagctcagagtgataagttccatttcattatcattactaatttttatttatttctttttgagacagagtcttgctctgtcgcctaggctggagtgcagtggcgcaatctcagctcactgcaacctctgtctcccaggttagattctcctgcctcagcctcctgagtagctggaactacaggtatgtgccaccacgcacagctaatttttgtaattttagtagagatggggtttcactgtgttggccaggctggtcttgaattcctgac

SEQ ID NO: 138755 - DNA, 418 bp, Homo sapiens
tagaatccatcagggaagacatgttaacaaatagttagaagtgaaatgagtgttacaaatatgcctgtataaattagggtgtccaatacctggtgggctctcaccattgcaggctctcactgtaatcccattgcatcttcctaattttctgcaacccctaagccgtacctcttttcctaggagttcttcctatttcagaaaaaaacagtcatgcatgaatgaactctctttgctttctcacctcctgctctgccttagaagaaaggcaccatgtctctgtttagggtgatccacccccttgggctgcacatgccatccctctttgctccaaggaggcctggcttcatcactttccttttctcttttcctgtgtcttcacctcttcaagtttgcccccagttctcctttcttcctaagt

SEQ ID NO: 138756 - DNA, 425 bp, Homo sapiens
gagcagaggagggagatgatctgactcagattttaacatgctctctctggctttcaggttgagaacagactgtgagcatgagggagcagctactgcagtagtgttgatggtgtctggtctagaggtgtggctgtggaggtgagagaagttggtaaattttctgttttttaaagtagggtgattggattttttgatgcgaaaggtgaaagagaggagagtcgtggatgaccctaaggttggtttgtttttgctgtagctggtaaaattatgaaaatgccatcaactgagatagagaagttggcagcaggtatgatttttagtggttatatcaggagttaggctttggtcatgtttaggttaagaggtctcagttgtcatcttagttgaggcctcaggaaaacacacaggtttttagttctggggaa

SEQ ID NO: 138757 - DNA, 185 bp, Homo sapiens
tctgatggtttcgttactatgcagaccttcccatgggtaatattaccatgatgagccttcaggctgagtaactgtagggccggccacatggggaaacccttgacttcaactggtgatgaattcaacaatgtcagtctcagcttgcccaactcaaagagatttgggctcaaacttattttgggatc

SEQ ID NO: 138758 - DNA, 170 bp, Homo sapiens
cacacattttcttggggccatattattaaacattcttgaagcgactggttctaggctgttttgttctgtgctgacaattgcaatcgctagaatgtgaagacgcaccgggagagccctttccaaaccctttggagcaaatgaggaagagaaaggaagggagatgcagagaa

SEQ ID NO: 138759 - DNA, 164 bp, Homo sapiens
gaagaaaaaaaattgagaattcagattaagtggatctgaatatgggaattcccatctaaaggtatgtgtaattaagttgaaatctattaagaataattaaataacagccttcttcatgataacaacatttgagttgcactttcaaactcaatttctcgttgtaa

SEQ ID NO: 138760 - DNA, 548 bp, Homo sapiens
tttgagaaagaaacaacagcatggcagacacccccaaaatgcgtttaacgtgcagtgaaatctcccatccccactccattcccaaaccatgaggtttcagcagcagataagcgtattattcatccatgaattctaagcaatcagggtggtgtctggcatgcagaaggtgctcagtatgcactattgaactgaactttcagatacctgatagttcactcattatagcaagtgataaattgcagtaaatttccaatgaatgcctgaacattgctattttaaattgttgatgagagaggaggactagagagagaggtgcatggagccaaaccactgttttgttgtgattatgttggcacctgacttgtgttcttgccattccacttattcagagaggctcagggaaactcgaagtaggtaaaaatatgcttaaggagagatgaacatttatatgaagtaaggggaaaagctggggttttggaggatacacattcattttgatgttgagctttatcattgactacatatataaacttcagaaagtcactaag

SEQ ID NO: 138761 - DNA, 689 bp, Homo sapiens
aaacaggtatacttggcatgtatagagaatattctcccaaatggtggcatttgcagtacaagtcagctaagattgctagtgctacttagaagtctcaagcaattcaagtgtaggattaatctcctaaagctggaattggatcaaaattaaaattgcaaagccacaggctaagcaatgtcaactctcaaactgtggggctgctgaggctcccaaattgccttccagagaaatcaaagagcattctttttcatctaatggttggaaatctctttcccaacaggtaggggtggggtaggtctccaaattaaggaatactggtaaataaatctcagccatctctttcagcatcagggggaaaatgcaaataggatttttatcattgtaaaatttatatttgtgaaagccttgttcaatcgactacaatttccacacacacaaaaaaccacatgtaagaatggctgccaaatagaaataaaaataacagctaacctctttattagtgctttgtaggtgccaagcacgatgataactgcaatatatgcactaagcattctctcatttaattatcaaaataatctcctaaagtaggtattttctttactccattttacaatgtggaagtagtacagcctaagagtggattatgtaatcactatgttaatgctgccttctcccatccagaagtgcca

SEQ ID NO: 138762 - DNA, 382 bp, Homo sapiens
agctcctgaaaaggggcattcagtacatactgttttgtatcttgcagtttccccttaaaaatatatcctgggggttgttctataccagtacagaaagatctactttggactgggtgggattttgacagatgggagataaggaagggtttctgacagagggcacagcctgggcaaaggcctagaagggagaccttggacttgtttacttatccccagaatgttcaaatttgagtcttccttgaaaccaaaaggaggcgatcttagaagaaaatctccccggagtggggagagagcaggcagaactcgccaagcccagaggaagcctcaagctatgccctgagttccatgtgccctggttctactgggcttggaggccggagct

SEQ ID NO: 138763 - DNA, 244 bp, Homo sapiens
taggaagtttaagaccagcctgggtaacatagtgagacctcgtctctaaagaaaaaaaaaagaaaagaaggtccagttatgaggcgtgtgcatttagaaaggtgcagtcctgagtctgatgctgtccaagcctgatatggcctagaagtgactctgattgaagaagacatgtctgaggactagagatggaaagcctgggagcattgcatttgacagtggaacatgtgcttgtcaataagaaaaa

SEQ ID NO: 138764 - DNA, 408 bp, Homo sapiens
ccacccccaccacctccataaagtgatcctgaaaaaaatagtaaaatccagcattgtgaacaccctaccattaattataaaagacgaacatgtgaaagaactctggggtgagcggaaaagaagctagcataatcagctttctaatgttcttgttatacttttacttagatctgtgtgtttctacagcaacatgtttctaaattgctacctcaattcactgaaaaataaacattcagcaagtctcttttttttctggagtgaaaaaacaacaacaatatttgtttaagatgtaagaaaatatccaaaatctatttagatatagttttgtcagaaagaatatcacaaaatagaagccaatattccatataaactggcttaatacaatatgctattctataaaacccaaaa

SEQ ID NO: 138765 - DNA, 453 bp, Homo sapiens
catttgtgctgctgacatttaaacatcagatttcatttaaattatttcaggcttttcttgaaaggtcaaagcctgggcaataccaaggccacagtacaggaaagctctagtgctggagctcagtagtgactgtccctgtacaagggcccacatgttccgatgaccagacatgccactgctccttttggtcttgtgtggtcctgggccacttcagtcgcatgtgtgtttagatggcttactgtacggaagcacttagcagagtgcttggtgcagtgtgttactgttatattagctgcgcggtccgtgtaggccctgcagtgggtgatatttggcttgatcctacagcctgacagtgttaggagtcttcacaagttccggcaaaacctggttgcatgctgcatgttaagttagagggaagaagccatatatattacacacgcagggtgatggagg

SEQ ID NO: 138766 - DNA, 343 bp, Homo sapiens
atatccatcttagggtctcttgctgagcctgccctggttactccacataaaacctcaatcaatatcggagaaaggaaaataaacagcaactttttcaacagaagcaagtttttcaatggaatacagtttcattggaatatggaatactccttttatctaaacaattaaaccttaaagccattaggcaaagcagagcaagacaaggacctacactagggcaggtcgccccagaggggatatcacagctggcatggaaagaggagtgggtcctggcatggcatgaggagaccaggcctgacagagagaaggcatggggtggaagagcccacaaagggtcaggagg

SEQ ID NO: 138767 - DNA, 123 bp, Homo sapiens
acagagggacttgcagatgcaaagatcccaaggctggtgtgggggactggggggagtgctccaggaacagtgggaggccagagcagagtgagccagggaggggcagatcaggtgggagctaga

SEQ ID NO: 138768 - DNA, 135 bp, Homo sapiens
caccaccacaggggaatccctcagcttctatggtaattttgaaactaagagaaaataagacagcatgagaaggcattatgctgctttaaatatgacttgggaatggtcttactttacaatcaaatataccacttg

SEQ ID NO: 138769 - DNA, 359 bp, Homo sapiens
cggacccaccggagggttgttactctggcctagacatacaaaattacttttatgacccactaaaggggctcaacccattatttgaaaaacattgctataaggatcccagactcacctctgtctcaagtatgggtgaggagaggatgaacaccagagaagttaaactatttccaagttaacagctgggttatctgttcttaaagccatgggacaattatggaggttcaataagtagctgttagaccatctaggcaatacctaatgtaacaggtctggaaactgctggcctgatcaccttgcgtaggaactatagctgaatattttgagtagcttctgctattaaaaagactgcagaataa

SEQ ID NO: 138770 - DNA, 764 bp, Homo sapiens
ctcagagcacctgaatgggtcatgcagtcccgtcagcatctcagggctggaggggccctctgaggctgtggcctctccctgcaacttcctgtaggtctctctgtagcaccagccaagaagtcacccgcccccgctggcacagctccagtgacatggagctcactcctcacatggcttgctctgtccttgcccagcccaggcgtttgggaagttctttctgaactctgtctccctgcagcttctaccctttggttccagttctactcattggaaccatatggaacaagttaagcctccctgagaattggtttcctcacttgtaaaatgggcatgattgtccctgccctcctgccacataacagaggctataatgtgggccctataacgtggccataaggtggaacgttatccagatcctcctgggcttcagctaggaatttctgtcctgggaaaccagtggggaccatcccttatatgacggagggcagagtttgctgagaggattggcttagagtggggactcaggctatagccagggcaagggctcaggctgtgatcgaaaccagggctcatctgtgaactttcgttcattctgggagagggcgaaggctcagtctgaagtcaagatcagggcttaggcttgagccaggttaagggttcggtgtagggttaggatcagggctatgtaggatttggaacagggctcagtttatagacagagtcagagatagggtaagcgttcattctggacttaggataatggt

SEQ ID NO: 138771 - DNA, 338 bp, Homo sapiens
aaaagctgtggtttgaagtaagaacatattatagttttgtaagacaatttccagttggtataatgagaacccatataatctaattgcttaaccagtaacattcatttttactattatataatcacctatgttctaagtacatttttattaaatacagttccaatacagatattaggaaacttattttatgctactgtaatactagaacattgtataagtgctcaaatagttttgtcagggcaattcccttccacgggaatttaaaaattatttgtgtcatagatgaatgagaaaactttaataataatccatgagacaataacacatacacacacaca

SEQ ID NO: 138772 - DNA, 361 bp, Homo sapiens
gttgaatcacttaacaccaactcctcctgttggaccttgcctacctacctgtgcctgatttaatttagctgtttgaaagcaaagaacttgttttatttttctgtatggtaaagaggataataacttacctaaggtcacacatataaatagcagaggaggctttgagtaaagatgtggctcattctgaagttcatgggaacggaagaaagcatgctctcctaagaggcaagaaacaaaatgtaggcactctactacttaccttgtcaccttgggaaaatacatttatcctctttcagggaaaggactacctttctgattcccaggccaatgccctttctgttgaccttcttgggtttcattt

SEQ ID NO: 138773 - DNA, 160 bp, Homo sapiens
cacggactcatttttatttttgtttctctgaataatacggccttttccttctggacacttgaagtttttctttttaccactgatttttagcactttggttatgatgtgccttgatgtggttttatgtatgtttcttttgtttggggctttttgagtttct

SEQ ID NO: 138774 - DNA, 376 bp, Homo sapiens
catcttgaacacaaaccctgtttgtgtgtcccctactccccagtttgatgtgccaggcactttgttctcaagcccagcagctgttgtgggatgaggggacattttgcatgcttagccagcagctgccagaaacatttctaatctggttttggcaggaaatagggcacaagtggaagccaagttaaaagaagctggaaaaataaacagaataactttagatgtcacttaatatatggtccattttcagccgaagatttgccctagtaatttgttaatatgactggactgtgatcccttccaaaggcagggttgaatatagtcacctttgagatccaggatgtagtccagtgcttggaatatgcttgtaggaggttat

SEQ ID NO: 138775 - DNA, 508 bp, Homo sapiens
tcagtagaaggcaccaatcaccaattacccaagcaggagacctgttagcccttcacttccaactgatgctcctaaatccaaaatgatcccaatgaagtgactgcctcagggatccttttgtctatcctgcccctccaaccccactgctgatttggggcactaacctctccctgactcccctgttccaggactccacgagcaatttaactggaatccctaacgccagtcttaagactttttaacgacagctccaaagtggtctttcaaacacacaaaaaagctaatcatgtttctgtttaatttcctcactgacaggataaaaaccaaatgactaagtgtggcataaaaagtcccacttgggaggccgaggcaggcgggtcacttgagagcaggagtttgagactagcccgagtaacatggcaaaaccctgtctctacaaaaaacaaaaattagctgggcatggtggtgcccgcctgtggtcccagctacccagtaggctgaggtggga

SEQ ID NO: 138776 - DNA, 148 bp, Homo sapiens
caaatgtgctctcctagcatactgtgtctccttcatgacacaaaccatgaagggttcttataaggattaaagtacttatttcacagaaaataatagcttatttattgagcccttatttgctagtcactgtatgggcagctttatgtat

SEQ ID NO: 138777 - DNA, 302 bp, Homo sapiens
aatgtcttatcagcaaacagtgctagggcaactagatatctatgtgaagaagaataaagtgagaactctaccttacatcatattaaaaaattaactcaagattgatcaaagacctagatgtaagagctaaaactataacaggcttagaagaaaacataggtgtaaattttcatgaccttgaattaggcaattatttctttaaaatatgacactaaaagcacgaaaaacaaaagaaacaataataatttggacatcatcaaactaaaaatgttgtggctcaaaggacaccatctataaagtga

SEQ ID NO: 138778 - DNA, 881 bp, Homo sapiens
aaactgaaactaaagacgtttttgaaaattcctagacggcaagtacagatcttagaattagacattgccagagctagaaggaaccacagtcatctcttgcctaccttcttaactttggaaacagtctgaggttgaagaagttcctgacttgcccaagattgtatatgtaactggctaatgacagaatttgggttagactctagtgacttggttcctaggtcagtgacaatcttagcatgcaactgcatgcagtcttatgtgacatttcatcctggtaacagtataaaattggtaagagtgaaatttgaaatttaaaagtttctggtacccatagttgattacatgttggcgcaatatgaaaatggaaaagatagctctatactatggcactattgcacatggagtctccattcgaagtggcagtcctgacactgagatgttttcattctcagtcctaaacttttctactagctgggtccttggtagttttaaaagacaagagagaaaaacttaaaagtacattttttaaacctttcttacagactgttgatttgagtttttgtttacaatgaggatattttagggaaagaatactaatctaggtagtgaattgccataagtataaaaactgttgacttggaagaaaagtggttatgttgtccttaatggtttctgtttaaggcttggagagaagtgcttttcttaatatgtactgcaccaggtaaaggtacaaaaatgtattcttgagtcttgagaagaaatgtggttgatgtaaacctaattgtttgtgaaacgaatggttattacctgttcttgcaaggaggtgatcccatgatggtcaaggaataattttggaggagacgtttaactttaaaaaaaaa

SEQ ID NO: 138779 - DNA, 326 bp, Homo sapiens
agaaattgctccagccacctcagggttctgcaaacaccacccttctcagtctgcacccatcaacatctaggcaaggatcctccaccagcaaaaggatttggacttgctgaagacccagatgattgttagcattttttagcagtaaaatatttttaattaaggtatgtatattgtttagacatagtgctattgcatatttaataaactgtagtacagtataaataataacattaatatgcttctgggaaaccaaacaattcatatgaatcattttattgctatggtctcaaaccaaacccacaatatctccaaggtatggctgtaca

SEQ ID NO: 138780 - DNA, 450 bp, Homo sapiens
tgccaccacctccctgaagtggctcacaagtcctcagcctccgccggagccccaagtgccagactcccccttcagccgcacagcctgggcactcggaccaagctgccaccttccctgtgcttgccggggccaggtaggacacgtctcacaacagagccttttccgggggcgcccttctgcagtgattcttgcagtcctgcactctgctgtgttctgctcacaccaggcaggggtgagagggagcgtggcccctctgggaagctcccaggacggcaggggtgggtgctgccctacagatacagtacctgctgcgcagggaatggacgcctcctggacggtggccccagcccaggaatggctgggacacccactccagtcttgcccacagtctgcttccagaggacacttgcccctgcctctccccacccccaccacgccctgcatctcgca

SEQ ID NO: 138781 - DNA, 276 bp, Homo sapiens
ttgtgacacatcggacaagacgtctaggatgcaggtgggtccgtacgtgtctgcggcatgagagagaagactagactgaagataaggatttgagagtcattcaaagtcatatttgaagtcatcagagtgattgagatattcccaagagtgaaaatctacagagcagaagacacagtctgaggaagttcagctgtcatgcatgttattgctgttgtctctcgcatcacggtttctgagctctgattcgttctctttggctctccgggttccggtgtc

SEQ ID NO: 138782 - DNA, 322 bp, Homo sapiens
ttgtgacacatcggacaagacgtctaggatgcaggtgggtccgtacgtgtctgcggcatgagagagaagactagactgaagataaggatttgagagtcattcaaagtcatatttgaagtcatcagagtgattgagatattcccaagagtgaaaatctacagagcagaagacacagtctgaggaagacaacatgtaaagcaaattactgccgttctcatcgtcaacctctctcctcccctgtatggaagttgataaaactagtttgtccatcagcagctgagcaagcagaatcacaaaaaacttttaacaaaatcaggaagct

SEQ ID NO: 138783 - DNA, 319 bp, Homo sapiens
gttgcccaggctggtctcaaactcctgggcttaaacgatctgcccacctcggcctcccaaagtgctgggattccaggcatgagccaccatgcccagtggagagccttcatctttcagaggcaaagcctggtgggttttgtgtagaaatgacgtgctgagatttgttgtgggacagttctgaaagtgggtggagactttggcaaaacaggattcaccttgagctgataattattgatccaagaggtagaatgtgtgggatttgttacatttttatctctattttatttgcatgttagaaattttccatagcaaaaacttt

SEQ ID NO: 138784 - DNA, 536 bp, Homo sapiens
accacaatgcaatataattagaactcaacaagaaaaacataaacctcccataggctgagaaactgaaaaacatactttgaaatcattcaagagttaaagaggaaattacactgaaatttatgaactatttagaactgaatgataaggaaaacacaagcagtttccaaatcatttcccctatgaagtcagccctgaccccacatggctcctcagatggctctccaccctctacccatttctacgccctaggaggctgacgtctatgggctgcagcaacaggttcccttgttcttagcttctgggaggattcagctagtgggggaaacctggccagagatcagacggagggagagagggaggagagtgaggcctcttacttgccccctgtccttccctgtatgattgctgtgagctgggtatgcccctccaccttaggccacagcagcgccctcctcatagctcccactttcaccattccttccccacactcctgcagcctggggttgacagcctctgctcttgtgagccctttggtg

SEQ ID NO: 138785 - DNA, 405 bp, Homo sapiens
gggacggcttcgaaaactgcctctgaacttgtctgacaagtacatactgtccgtttcatgggaaccaacatctcagagatcccacacaacgcttcctctttagagaagaaaaacacagcaaaacaacacaggcagcctctgtttaaacgcacgtggcccccccaccccgcctggaagcctctgcacgtggccttcatctggaagcctctgtatttaaacacatgtgggcctcctccatctggaagcctctgtatttaaacacacgtgggtccccatcccccgtccagaagtctctgcatttaaacacacatggccccccatcccccatccagaagcctgtgcatttaagcacacgtggtcccccgtctagaagcctgtgcatttaagcacacgtggtccccggtc

SEQ ID NO: 138786 - DNA, 350 bp, Homo sapiens
cctcaagctgttgtgtttgatgcttgcctagtcataccttgcagagacctacaaagtcaaaggcaactagcctcttcagaaaagtatctttgcccttggtactcaccccaccctcaatctgatccttgcaagattccctataattggctaccttgccattcctggtacgatattctctggaccactcagtcccaaggctggacttcttcagcaggctgcacctccctaaaaccttatatccattttactaaacaaaataactcctctaactgccaacacctccgatgtaacctggtgcatatttctattactacttcaacctccactaaccatattcccaccctaagtcg

SEQ ID NO: 138787 - DNA, 264 bp, Homo sapiens
tgcactgagctgcgaagtaccattcctaaagccccagtggcccaatttggatctctaaataataggcgtgtctaaatcagcttttaaaaaattagctcttgctcattccaataggtgctatgtggtgacataccagagacctgagtctgacccaggaatacagacattgaaagctgtctgtgttctttgaataggcttctttatcctgatttgttattgtattaactctttatagtatacactctaggcattttggcagcatcc

SEQ ID NO: 138788 - DNA, 251 bp, Homo sapiens
ggtctcgaactcctgagctccagtgatccgcctgtcttggcctcccaaagtgctgggattacaggcatgagccaccatgcctggcctaaaaagattttaaaagtaagaaaaaatgtcttttactttatatgttttccatttctggtgttctttattgcctatgagcggttccagattctcatctgccagattttcttcagttttttctcgtcagttcagattttctttctgccagaggacttcctttaatg

SEQ ID NO: 138789 - DNA, 221 bp, Homo sapiens
agtacccaagtacaaaatcactcaatttgtaacagaggaaacctttttgttctgcatcgagttgaatgcattgcctggcagaatattaaagtgcaagaaccagtttttcttgctctttacccctgcaaggattgatcagcacatgaaggtctccttgacttcaaaggcatttctggacttggatcagcctgattgagttcagaagagaaggaaacactagc

SEQ ID NO: 138790 - DNA, 176 bp, Homo sapiens
agcagttggtggagagcgcttctgctgttattttcccacattatcacttattaatggtagcctaagtgacacagcagaaagagcctgagtcaatagctaagccactcaccagctagctgtataatttgggcaaatcacttcacctcctttgtcttcagttctctcttcagtaatag

SEQ ID NO: 138791 - DNA, 342 bp, Homo sapiens
aggaaaaggaatacaaatcagtgagacggagaagcgctgagtgagagagacggatacgtggagagaagagggatgccggagcgggtgttaaaagagacaaatctggccgggtgctgtggctcctaatcccagcactttgggagactgaggcaggcagattgagctcaggagttccagaccagccaacatattgaaatcttgtctctaccaaaaatacaaaaattagccgggtgtggtggtgcacgcctgtagtcccggctactcaggaggctgaggtgaaaggatctcgcttgggcctgggagggtgaggctgcagtgacccgtgatggcaccactgcgctc

SEQ ID NO: 138792 - DNA, 796 bp, Homo sapiens
tccattgccttagtgagaattttaactcatctttctcagtaattgactgtatcagtttgcttttggtaagtaatacaccaccccaaaatttagatgcttaaaacagcaatcacttgttagctcattatattgtgggtcagaaatttaaactgggtttatctgggtaattcctctgttgatcttcactggggccgtgcatgtttgatggcattgctcacgtgtctatgagtttaccggagtgatagatatctggcccatatttatcccattatctattaagttaatggaccttgttcatgtgatggaagatcagaaaagtagcaaggaaacaaatgttaatgcacaagcactttgcaagcctttgcttgcatcacatttgctaatgtcccactggctgaaaaaggtcatatgaccaacctggatacaaggggtggaagaagagattccattttttttgatggacctgctatctcatttcaaggatatagattcaggtgggaaaatattttgtaaccatttttatagtctacatattgatagagcaagaagacaaaaaaattagtaaggctctaagaagttttgaactatacaaaaagttttgtatgctttatatataaaacttatactctacaattagaaaatacaaaatcttttaaaatggacataatacacctataaaaaataaataatatacaaagctaaaaaattattctcagcaaaaaaccaaagaactgctcttttataaaccccattttcaggccaaaactcagttaagctaggaattagttacaagata

SEQ ID NO: 138793 - DNA, 229 bp, Homo sapiens
gtatagtggtgcctgcctatagtcccagctactcagtatgctgaggtaggaggattgcttgggccctggaggtcaaggatgcagtgagccatgatcacacagctgcattccagcctgagcaacagagcgagaccctgcctaaaataaaatataaaaataaaaatcttaatctcttctttggacccatgtagtgatgccttatttttgtctctcagtgtcccttcaccca

SEQ ID NO: 138794 - DNA, 420 bp, Homo sapiens
tgatgtggactaaatgagataatccgggtgaagtgtttagaatgatctggcacagggcaagtactgtataaatgtcaggtactattattagagactatttaagaagtaataagaagccatctagaaggcaggaaataaaacaccaagttcctgtttcccacgactttactcaaacccctagaaaacacttcctcccaccttgttcaagtgagctcaaattcttgggaaaacaacaagtgggtataggaactccagggctacatctatctccttcttcagcagcctggcacctctccatggctttaatctctctctgcagctggtaatcgacatgttcatagcctccttatttttcagtctcactagctctgccggggtgtttgtatgtggtgcttcctatctcagttgagataaaagacg

SEQ ID NO: 138795 - DNA, 424 bp, Homo sapiens
gtttcctctctggagtattgtgtggttttccacagatagctctctattctggggtatgctggggtggcaatggacactcctacaggctgacagtgaccttcctgagccttctcatcacatcagactatctaggatgtaaaggacccactaagtcgggtactaagaattcaggttaataatctagaggactgaaagatcctctttagaaacattcatactttgtatatgattaaaaaggaaaactagtgatatgctttggctgtgtccccacccaaatctcatcttgaattgtagctcccataattcccacgtgtcgtgggagggacccagtgggaggtaattgaatcatgggggcggagctctcctgtactgttctcatgatagtgaataattctcactagatctgatggttttataaagggga

SEQ ID NO: 138796 - DNA, 471 bp, Homo sapiens
acaaaaaagaatcatatatatcccctatcctttagctcctagacaaacatttaaacagttgatacaatgatagaaatctatacagggtaactgcgagtccataaggatggtagagtagaacagtattgaaaacttgaaactctatccttgagctcaatcttgaaaatgagtagatggtttgtaagaaaagacacaaagaaaggtattcccagcataggaacaaaggaatactactggcctattggaggactgtgagtagttcaggctaactggaggttggtgggagtatagtaagagctgagactgggaagtcagcagaggccacattaaagaaccttggggacaggcacggtggctcacgcctgtaatccctgcaattttggaggccgaggcaggcagatcacaaagtcaggagttcgagaccagcctgaccaacatggcaaaaccctgtctctactaaaaatacaaaaa

SEQ ID NO: 138797 - DNA, 140 bp, Homo sapiens
cgtgtgacaagtgacatattccttgatatatcttctcaagacattttctatctgtttctgttggaatcttcctttgattacaagttggttattaccatctatagaaccacttgtacccaattcagccaacaaaaatgcac

SEQ ID NO: 138798 - DNA, 327 bp, Homo sapiens
cttgctcctatcactcaggaaattacaaaggtcttagacactatgtgtcaggaaatggggtcaaggaccaaatattagacctgaaaattatcccagtcgccgctttaggagctctggttcaaagactggggagactgtgtgtttgtgtgtgtgtgtgtgtgtgtgtgtgtgtgtgtgtatgcatatgcatatttcttatttcacacaagcaaagatttatataatttgaatgctttatgaagggtaaatgtgaatataaagtttgagggaaaacaaacatcttatttcaaattggccaatttttgtgtggtatacatgagagggaga

SEQ ID NO: 138799 - DNA, 387 bp, Homo sapiens
tcagagggtaggggcagggaaagaaagctattggttcctaacattacagcacacaccacaaattaatttcatttatgagaggcagcaacaaaaagaaatcaatatccagtctaatggggaactggactagaaaatgcaacactagatactgctggaatcctggcttctgcagacaaaattcactttaaatgctgctcttctcacaacaaaccaagttagttccctctccagaccctaggaaatccacttacaaaactgcaaaatagcaccagattggttattagaaaaattgggttctgaacctgccctggtagaaaattgtgggcaagtagtttaatttctttagtactctccataccagagtttgttaagttatggctgggcacc

SEQ ID NO: 138800 - DNA, 362 bp, Homo sapiens
gttcaatttctagtccagttccccattagactggaaattaatttcatttatgagaggcagcaacaaaaagaaatcaatatccagtctaatggggaactggactagaaaatgcaacactagatactgctggaatcctggcttctgcagacaaaattcactttaaatgctgctcttctcacaacaaaccaagttagttccctctccagaccctaggaaatccacttacaaaactgcaaaatagcaccagattggttattagaaaaattgggttctgaacctgccctggtagaaaattgtgggcaagtagtttaatttctttagtactctccataccagagtttgttaagttatggctgggcacc

SEQ ID NO: 138801 - DNA, 553 bp, Homo sapiens
atttgtatttaagaaaaataacaaagaaatcaataaaaataatcaaactccagatttgtctaacagcttgctttgttaagaatgtaatgagatcccttcaaatcacgacaaaaaaaatgctacattttttaaatagtgtaaaatctgtctaaaatagatgtctgacattttttcaaatttcgtatcttcatagaaaccaagctcaaaggcactgactcatttcctttacacctaaacatattattaagggcatccacagtaatgtaaattgttttaaattaatgctatccaaaatacgcaaatgcatgttcttactcaacagctcctttcctaatcagcaagcattttcttccagctactgaaactcaataaatttgaatttgggtttcagtcttatacaaaagaacttcatatcaatccatctccagaattaacagtgttgcagttagatgagaagtatacatttggctttgggacccagaatgcacaaacactgactaactgaattaacaggttgattttcatccacaaatgaaagtgttttatgctcaat

SEQ ID NO: 138802 - DNA, 293 bp, Homo sapiens
tttacttgaagcaatggtgagatgctgagccagaaggtcatagtcaacctgcagtaacccctcatctaataagtcactttaccaggagttccatccacttacaacacagctttgactctggtattaatcaaataaagtttctagctgtcccccaaatgttgagacttaatgcagtgatgctgatagtgtccccagccctccactttcactgtcttcctttctttaaagcagcaaatggaaggagggagggaaggtggagacaaactacagctgatcaacaccctgtccatacg

SEQ ID NO: 138803 - DNA, 389 bp, Homo sapiens
aaacatcctcagaacgcattttcataatgtattatttgaacttttatcgtttgtaagaacagagtcaggtggcaagccgtgaaatgaggcagtcacaatgacggactcttaaaagatatcaattcctgtaagcacatgacgccctgcactgcttaacctttctgaatatgtttgtctttaaataccagaaagtaaatctgtcaatgtgtgagatcatcagttttgatcaaaaaatttatcttggactaaatattcatatttatttaaacataaattagaaatgtagagaatgctggctgaattggggtgatggtggtggttgacattggaaaaatacctacattttagctgtttctaggtaccgcttattaataagttacattggttgt

SEQ ID NO: 138804 - DNA, 296 bp, Homo sapiens
aattgggatctgctgacagttgactaggaataaggtcctgcaaatgttggagggagtaggaactggaaaggaaagggacagcaggttggaaagctgctgatcagactagctcaccgtctcgtgttgcacaggccatattctgccttcttgtttcagttctcatactgtaaacaaatgttcttttcctttttctttttttttgttctttttttagggggtggggaaacagggttttgctctgtcgcccaggctggagggcagtggctccatcatagctcattgcagcctcgatccct

SEQ ID NO: 138805 - DNA, 474 bp, Homo sapiens
ctgaaaatttagtaaggaaaacagtgctacctgtcatctataatattatcctagttgcctataattttaccactatcattgtttggggaaatccttctggtctcttgtctgtccagatgcacataagtccttatggtcttttatctatataaatatacacaatttttgtatgaaaatggaatcattctgtacataccattttgctgctcttttcactcagtgatgcctggaacatttttttttttttttaagacggtctctagctgttgcctgggctggagttgcagtgagccgagatttcttagaaggaattgttacttattgttctgaagtgaaagtctggtctgattcagaagaaatgttacaacaacttaaacactgatgctttcagaacgggcagcaattctcagcgtaaattctgatcacagggaccagcaaaattggtgagttgcatagctacaacattctgtgcca

SEQ ID NO: 138806 - DNA, 359 bp, Homo sapiens
ccccttgttatgcccattatttcagattgtatgctttttttcccacagcacttaggtgtaatcatgtattttatgcagtttctttatagtctgtcactcccattgaaggacacagactgtgtctctttagttcactatcgtatatctaacacctgtaattgtatgtgccacatagtagacattcgttaaatattttttagtgaattaatgtgcagtgattttaagcaagtattagttgaataacgttttacatgtttaatgatgctgcatacgcattttccgatagtgtctaccacggtttatcacagaggccagtgtgggctctcacatgtaataaagctaatctgaagttaatttgc

SEQ ID NO: 138807 - DNA, 144 bp, Homo sapiens
gcaatgcaggtctgtaaactggaattgtaaaagtgaagtggcccaggtcccatttgttgtagtggtgcacagagagacagtcttgagaggtgaggagacatttcccagaggaagtaacatccaagttgagacttagaagacagc

SEQ ID NO: 138808 - DNA, 258 bp, Homo sapiens
acaggagacagcttgttgcctcttccacgggcccagtggccaggcgtgaggctcagcaccctacccacatcttcctgccttcctgaggtcaggagaagccccagcaatgtgtgcttcagcatgggcaccactcccaggcctggcccctgaagcccccatgccaatctcatgctctctttcccctcaaaggtagagcagcccggagataaaactctccgtgcaggccgggcacggtggctcatgcctgtaatcccagca

SEQ ID NO: 138809 - DNA, 693 bp, Homo sapiens
agtctcgacggagactctcacacagaaaggaatggaacatgtggaatcacattattttgaggcaggatgggctgcggagttcttttgatccggcctgccttcaatcatttctgattatcaaaataagaaagttcgacggagactctccactcaaaataattgagtggagagatcaaggtacaagacactctgcctttaccttcaaagtctgagcaaatatgattttatatcgttttaatcagagattcttttaaagaccaagttactgcagtcctgtcttgttcttctcctattttatactgatgtgctcagtaccttggtgtctttgtctgtcttttagggggaagggaacccacgttttggactagagtagcacagatgccattcttacctcactgtaggtttctttaaagaatgtttagtcctgacaatgcgatgcagatttctttctctccccactctatcttctcttgcagagctttatccctttttcattgttcagcatgactgggaacctgccagctcgccacaatgaaacataatgtttttgcgaagtgtgtgtcaaatgtcgtgagcttagaagagattcatcgtagagactgctgcttaatgagtgtaaattaactgatcatttgctaaatctgatgtgcccagtggtgtggacgggagaatgctggataggatgtaggagat

SEQ ID NO: 138810 - DNA, 321 bp, Homo sapiens
tttcctacacatagagaagggtaagacaagacctcaagtaaatgaagtcagtgagtaagcatatgatagtatgcttatacttactgtcacggtttctttagacctgtttaaaccattgagcaccctggcatttggaccaatatgtgattttatagctggtttacttagcaagtgaaaaacagattagactaactacggtttactgaacgatatactggttaattacactctagtggttctgcagacaagtaggctttctaaaacttggcatgtttcttcttccagtatgttccttccttctccaaaataaagatgttttta

SEQ ID NO: 138811 - DNA, 158 bp, Homo sapiens
cccctgactgccacacagtagccaagaaagcctttgaacataaagcttcatattatgttgctcacttcctaatagctcatcctccaataacttcatgttgcccttaaaacaaaatctcaactcttttttttttgagacggtgttccgctcttgttgcc

SEQ ID NO: 138812 - DNA, 556 bp, Homo sapiens
aagtgtgttgagctccttatagagggaaaaacgtgtcatgttaagggagttcatttacaaatataagtgtgaatggatgtgcttagaaaagttcaaagtaccacacaaattcattgcattgagaacttatgatcctaggcactgtgtaaaaacccttattttcaggatggttttacgatgtaggaaagggaagaaaggtaaatgttctttatgcaaatgcttacaatataaagtcaaaagtaacagacttaataaaatacaaaatggtgaaggagaccagaaattttccatggaggaaaatatatttcaatggaatatttaagaactatagaaatggaagaaaagaaaaaccattgttttaaatagactttctaaattactgtctttaattttttttcagttttcatataacaaaaataatttgtaaatggtaatgttaaataacaattacagggagtcattgttttggactaagctcctgcactaggtcctcaatagatcagactaaaaataaaaatgaagtcaccaatgctcaccaaaccaaaagtaagttgtt

SEQ ID NO: 138813 - DNA, 192 bp, Homo sapiens
ggccaaggtcctggcacatgtcatcatgtggacatctgtcttcatttctcttgggagcagagtggctggctcacagggaggtgcacgtttaactttctaaggaactgcagccgtcttccacagtggctgtgctgtataccctcccactggcgatgtgggtgcacgcagggtgtccgtgcatgtgcaggagta

SEQ ID NO: 138814 - DNA, 259 bp, Homo sapiens
aaaatattgatgacttttgtgtagtaattgagattttcccccgttttcagttcgattttaatggtaaattttgtctctagtggactctgcacatagatataaagagtatcattatttgataaaacaaaagattgtatgtattaatggtagaccatgatacatcgtttggatttaattacttactaaaaactcaagtttaagtaatatttcagtgtaaatttacttagcaatgcttacaaataaaaaacaattatgtact

SEQ ID NO: 138815 - DNA, 534 bp, Homo sapiens
cccatgtgcagctgtggtatgaggggcacagttctgtggggtgacagatgcatccatgccttgaaccacatgatctagattcaagtctgtttggggctgactgaatgtcaggcacattaggcaacctccctgaagctgagttttccctattaataaatgggatctcaaaatctccacaaaatcatttcacatattaaatgtaagatgtgatacatttgctcatgtaaacataggggaaaattgtgcaatatttagaccctgatagagtttggattttttctagtgtcaggatttgccattgaagcccacaggaggggactaacaggatctggattctattttaaaagagttagtaaatattttaggcttgtgggtcattgcaattactcacctctgctactgtagcagaaagctgtgcggggagagggaaggaggtggatatgggacttatcgtagccatcgagacaagagatggggccgccagcctaggagaagtagcggggatgcagtgcaggcctggcgtgagtcctggag

SEQ ID NO: 138816 - DNA, 355 bp, Homo sapiens
gttgtctatatatacaaaatgtctgatgatagctgagaaaaggatttaagttgacaaaatctttgaggagctatccacaaaaacacagtgataagaagtgtgtacaagaggaatgaagtgaatgcatccaagttgaaagtcagttatgttaaaatgattaaaccagctagtgaagaaacctatgccaactacattaacagctcaccgttgatatgggaaatgggtgactggaaaactccttttcgtgtggtaccaacaaaaacagctggtctgaagaaaataaaataaaacaacaaacaatttatcagccagcagaaaaaaaattaactctagaagtaggaagatatagtcagga

SEQ ID NO: 138817 - DNA, 342 bp, Homo sapiens
attatacaacctcgatcagcctcagacgcctaatggcggggttggaccctgttctgcccacccacgtgacgatgcccgcagaaccgcgcgctgttccagttcctcctgtcacgacagtggcctcgggggtgctgggcctatttccccatccctgagcagggtcatgagtggtccccacaggagggagctggccccagccccagcccagctgccaggagggggccgggagacgctaatggcggtgacagtgatgatggcgaccggtgacggcagcacgccccagccccagggaacactccgcacacggtctcaccacgggacaatagccacgcgaggtccagc

SEQ ID NO: 138818 - DNA, 228 bp, Homo sapiens
agaaatctgaatatttggctcttcttggaaaaccaggagatatgggaaatctgtactgactccaccatattgtctccccaccccttaagagggacagacctgcttggtggccaccagaagtggaattatgaaggccacggccatatgattctcaagaaaccctggctactcacataagccactccagaccatgatttctgtcttctctgtcttgaggtgcctacctgt

SEQ ID NO: 138819 - DNA, 199 bp, Homo sapiens
accctctttccctacaccataaaggtatctctattgatttctttatctccgtagtgatccacgtccccctctgcactccccacatcaaatcccagccaaacgtccatgatggtcacccaacaggtgttctagaggtatcatgaaaaacaatacattaactctttgtaaccaggaagtcagggcttccatctgggaggga

SEQ ID NO: 138820 - DNA, 216 bp, Homo sapiens
aaaaaatcaaagaaagtcactctcttagctcaggatggtgtatttgcaagtgtttaggccaaacatgtgttgagaaattgcacatatactgtgtacaactcatgtcatcaggaacttatgttaccaaacctcttgtttcacccactatcttatcatctgtattgagcagactaagacctagcaaaccagatgagccttcaggagatctgcagactg

SEQ ID NO: 138821 - DNA, 679 bp, Homo sapiens
ttttgggaacgcgggacgggcgatctgcggcgccaggagctgggccgaggcgcggcggcgcggctgccggctgccctgtgaatgggaagttacgcgaagtccacccagcgtttctgaggcaatctgaaggcaaatcctgtttagacccaggcgaaggttcccggtgacccgggctctcaccagccaattgtcccttgccgtcctcctgagggtgcctggagcttaagcactgtgtgctcttggcctccacactggggatgccgctgactcccactgtccagggcttccagtggattctccgaggccctgatgtagaaacttccccattgggtgcaccaagagcagcctcacatggtgtgggctgacatcaagagctgccagatccaacaggtaaaaatcccgaggcattgccagctcagtggggtcagagagtcctctttgtattatgactcagatgtgaagggaagatgtcaaggtccctaaacatcacagggccttgcttggcatgcaacagatattaaataaatatttgttaaatgaatgaacaaatatccacagcatgtgctgcccatgagctgcagtgccgtggtcaggtagaagtgattttacttcaggagaggacagtgttctctccaggacttttccttactagctagatctgcgtcccgaaactgagaca

SEQ ID NO: 138822 - DNA, 401 bp, Homo sapiens
catcatagagcatcccccctccggcaggttgtactccaggagcttacagggattcagactgacaagaccgcactgctcatgaggggtaaactggagagactgtgaaaggtggcatgtcttgtgccaaggagctcaggttttatcccaaagacagtaggaatcctgtgatcagattaaagggaaggggaagggttcatacagtctaataacttttaaaaagtcacttagttgcccacactagggaatgtactagaaaagatagaagcaaactggttaccaactgcctccaaggagacatggagcccaaacttcaaaaacacctttgcatttcccaattcaatactatagaatcattaaaaagctggtggttaaaagttaaacagtgttgcattcaagcttca

SEQ ID NO: 138823 - DNA, 223 bp, Homo sapiens
tggaagtgacgttttaagagatttgatggcatagctggggaggaaatgtataggaaatgattggatcattttctcgggtttgatttaatacattgaggccccagggaaaagagctgcttgtttcactccgcgtctgtagctaagttcccccaggaaatttagagaccttctgcagggtttttggaagtgttaatctaacatacagtaatggtgggaattgagc

SEQ ID NO: 138824 - DNA, 231 bp, Homo sapiens
tgatggacaggaggtgcctggctgtgacaagtacccactggggataaggggtaagggctcccccaggctggaagggaaacttgaggggtcactctggtgagcccctgtctccatgcaggctggactgctggaatggaaagtggtctagggagaccgtcaccatccttggggagaccctcaccccctgcccgtctgtgtacaggcagagtgctgccagcccagggacatccg

SEQ ID NO: 138825 - DNA, 128 bp, Homo sapiens
ggcattttttctttgattttttttcattatcaatcatatttgattagtaagagagaaaagatgttggaactttaatctgcaattaaagataccattttttaaatgaaaaatactgttttaaaataaat

SEQ ID NO: 138826 - DNA, 494 bp, Homo sapiens
caggccatccagatcactatgaaccttatcagaaacttcagtccattttctccgttcccttccctgggacttgcatgctataatctccatacccctccttccccactctccaggcttagtgggtgaggcagagagtgagagccaggcttacctgccttttctcctcagtgggaagaagctcagtaactgagctcagacgctagtggcatacctaccaagaggatgacataaatgcctcctgtggccctgagataggcagagctctgctggcagcccaaccatatgttcactcgttcattaacaaacatccacagaggcaggctgctctggcctggagggggatgtcctacactagacgactcaggttcatagagccaggcctcattccacccccactggctcaagtgactttctggtgaccagaaactggagagctcttttttttttttttagacggggtcttgctctctcgcccaggctggagtatactgaca

SEQ ID NO: 138827 - DNA, 512 bp, Homo sapiens
tattaatattaccttatcactgttatgatgataatgttatagcattgaagctgacttaatgaatcgatcatatctatatacttgcaggggaataattggatggagaggtggggagcaggaatctgtagtgggaagacactttcttcccatggaagtaaaaagaaaattcttttatagaaaatggaattttcaaccttcagagatcatgtgatcaaatgacattttactaataaactgaggcttagttacttgacttgtataaggtgacatggctagttcatgtcaaagctggaactagaagctaatccgtgttctacgctttgatccagggtatcatggtgcagttgaaagaacagttgatttggaatcaggagaccagggttcgttgcctcacttcattatatactacttcaagcaggtctcttaaccttgaaaatgatgctctaaaatatccacaagataaagaagctttctttcctatctaccatgtatggtagggggatcaaatatgt

SEQ ID NO: 138828 - DNA, 450 bp, Homo sapiens
tattaatattaccttatcactgttatgatgataatgttatagcattgaagctgacttaatgatggcaaggatattatttacttcaatgatttatcttagttattaaataatagctaaatcattatgctgccttccaccctgagtgatactaagatgagtaagccaagtgggttagatttctctgggttataacctgtcatgctgacactaagtgttgtcacttaaactttttattttcaccaaagggcttcagtcccatcacaggatacctcttttgctcttaggtaagtggattcttgagggaagctgaagttgtaggggattttattttatttttttattacagaccacaacctgttaatcttaagacctgaaagttgctggagtcacaggaaagcatttgagctgaaatgtttaatttgcttatgattcaagttagtggtacttaat

SEQ ID NO: 138829 - DNA, 287 bp, Homo sapiens
gggcgcaggctgtcttggcggctgtggctgagccccgggcgtcggtgtggctcttggagccctgctccccatcgcgcatcctggcagggtctccataacctgtcatcctcgtttcatcttgatttatgatcagacctaatgagtttttggagcagctgtctcccagggatgtggcgatcaatctaggagatggctgttgaactttgctcctcccttcctcccttccttcctcctttccttccttttctcccttccctccctttcctccatctcccagggaaacgagc

SEQ ID NO: 138830 - DNA, 417 bp, Homo sapiens
ggctacttgtttcggctctacttgtctctcggctctagcttgtctctcggctctaccttgtctgtgtcctgccttcctgggacacagactggagagagactatgaactcgagatcagaatttgtatggactcttgggatcttgagagaaaaaaagagagccttcaggcaacctcctaagagccacaaaggaagctgcagctgtgagtcctggttggctgagaccagcgtgctgccttctctggatctgagtcttgcctgcatcatgaagcggggccaggaacttgtgttcacttcactctttttcatgtctagttctttttcagcccatatcttccccttcatctcctggggtttggatttgctggtttgggggctctttttttcccttcctcactcatgaaacatggtagaaagat

SEQ ID NO: 138831 - DNA, 348 bp, Homo sapiens
ccccttctgcctcctaggcagaggcatggaagaaatgaggggttgctgggagaggccattgttccatggcagaggctgcaggacccccagctccccattcttccccactagctgaggatgaccatcagatgcagagcaggatgacccaggcctgggggtgtttctctgtccatggtctctgggctgggctgggttgcaggcactgattcacaggcggttggtcagagagggaaagaccttagcaaccatttattcccaaccttcttttttcccacctgaggaaactgatctatccagaaaggttaagtgatctccccaaggtcacatagccagtgtagggccaggact

SEQ ID NO: 138832 - DNA, 321 bp, Homo sapiens
ggagtaagggagtgatctggggcctcagttcccttctgcttggcagttgtggggcttggggcagctagctagagtcagcccctcaaagtccttgccctttctggttcgggagctaacatcattgtgtgtttgggattgagggagagagtcaccttgttcagtccttaggacccacactcttaggaagggctgcttattcttcccgcctggggcagttactcccacctttcctgatgcctctggttgccaggccttgggctgggcaccacagactcacagatgtattggacacggttcttggccttcaggagtccatcttgg

SEQ ID NO: 138833 - DNA, 278 bp, Homo sapiens
aaagatggaaactttctaatactggggttccttatccagggctaatttatcctttaggcatagtaaacgtgtgccttggaccaagatacatataggggtccacagaaatattttcatttttatttcttttaaatcagaagtagtaatgtatatacatgtatgtaatagcaaacctatacagtattttattcgtgtttatacagatgtacagaaaatatagtcataaatgtatagaaaatataatatttaatagtttttgtggagtaagtgccttacaa

SEQ ID NO: 138834 - DNA, 185 bp, Homo sapiens
tgtgtgtgtctgatcacagatgtgctccattgtcccagcacacttcacttaaaaaacacaggttcaaaggccagactgttaagaatttcaagatggcgacagcagagcggctgtcacaccctgaagctgattctgcctgtgccatagcaggacgcatgctctcaaattccatctcgtaccatctg

SEQ ID NO: 138835 - DNA, 485 bp, Homo sapiens
gagctccatttcccatcactgtagaagatccccatcaacactgacaccttgcatctcaatatctcagctctcttagcttccactggttcttccattgtgcctgcctcatttcctttgtataaaactcaagtttcagtttacagtggttgggaagacacagatggactctgcatagaatcaccacatctctcagacactagcccatggttcctgaaacagacttttccctctgaaatgtgcatttcacctctttgtctgagataaaattatccaaattcccttagttccttccaataaaacaggcctataaggggcccacccaccagccctccagccattcctgatacaggtttacgctagaacacctattcaagaatatgccaaggctcaaccatatgcctcctcttcttttctttatttttaatgagtaccacttgtctatgccacagtagtccccagcttcagttagcctccacagcaccaca

SEQ ID NO: 138836 - DNA, 280 bp, Homo sapiens
tggtgtagtgtaaactgagtaagcactttgcagacttgaagaagccagtgattatttactatttgcactaggcgaaatccagccttgggtgtgccctctgcagtccctgccgtgtccgtgcatgttagatcagaacaacttcctcaagtgtattagaattagaatgttaagaaatcaagaaagctctcaaggggtgatgtggccccctttttaattttaatcacagattaaaatgctatcgagaagaggaatttgctccaagagaagagggatttcacag

SEQ ID NO: 138837 - DNA, 546 bp, Homo sapiens
ctagattggggattttaattgagacagatgatgtttatcgggcatcccaccacctgagagttttagcaacagagtcacatgtgagtccatcagaacttacggcattgattcaagtgctgtcataaataaccaggactgctgtttttggttacttttaaagacagtttcatctggactttctgggcatatcctccttcagcaaaaccacattaggctgggaaaactattctgcctggaagtaatgacaacttgcaaccaacaagcttataaaaatacaaagaattctggagcctatggcttccattacattattcttttatagccttttatgttcattaccgcatcccagaggtgagagtcagacacaaatatgaaaataggtttcaatgttggagaggtaaatcctaacaggaaaggggtaggaaaagatataatcccccaatattaaaataaagatattgaagaagaaggatgggagagactagggctgtgtccttccttttactcaccaaaagagaaagtaagctcctatttgagtcaatagat

SEQ ID NO: 138838 - DNA, 400 bp, Homo sapiens
ttttgtgcaggggggtgccgcccatatggctggtcgttatgagagcgtatacaataaaggagggtgaaagtttttatttatttatttatttattttttgagacggagtctccctctgtcgcccaggctggagtgtagtggcaccgtctggcttattgcaagctccgcctcccgggttcacgccattctcctgcctcagcctcccaagtagctgggactacaggcgcccgccaccgcgcccggctaattttgtttttgtatttttagtagagacggcgtttcactgtggtatcgatctcctgacctcgtgatccacccgcctcggcctcccaaagtgctgggattacaggcgtgagccaccttgcccggccaaaagcttttagttttgacgtaaatcttgt

SEQ ID NO: 138839 - DNA, 363 bp, Homo sapiens
aaatgcatttatatagtcttactttgtttctttcattgcactctataatgatttttaaattaagaattttttatcttaggcaaagtgtgtctctttcaattcattaacttattaattttataatgcagttttatttttggaaacatataaatatcagactgtccttaattgaaattttgtctttggtttccaacaccatgatgaagctcttgctttttaaaaagtagttagtaaattctgcatgaattttagtaaactttaaaaaatagattttttccctaagaaagaatgtttgtagaatttaaagtggacagatgcctgttggagtaaaatcaactgcaactttttgatgttaattttttt

SEQ ID NO: 138840 - DNA, 300 bp, Homo sapiens
gctaaaactatcagtgaatctacagccacattcaattaagggagaaagttccccgagcagcatccatgaaaacctagtggatttgacagttacaggccagtagtacattaagactgactcattccccagcataagactaagttcacaacctcatgaggacattgctctcccctgaaactatattcaccaagcagcaatcatttttagttatatctacctatacttaaaatactggaaacagctattttggaaatgggcataaatattttattatttactgctaacttaaaaatcagttgt

SEQ ID NO: 138841 - DNA, 143 bp, Homo sapiens
atttttttcacaacttgattccaatctgtgtatgtagattcacataaattttctgaactgtccaaagtctgctcaaatatgcaagattggtttatcattagaatatcagttaatttaatccatcacattaacaaatttaaaag

SEQ ID NO: 138842 - DNA, 414 bp, Homo sapiens
agttcgacggagactctcatctggtcagtatctctttcttagcagtattggcatttgaccattccctccccttcttgaaacactctcttactgtggcttccaaaacactgaaaaccttattggttttcttccttttcacctatttcttctctgtcccctttgcaggtttaccccttcctactagctattaaataataagcttggttgcaggccatcttattattttgtctatgtaacatcccttaggtgacctatttcatatgtatggctcatacatacatccccacctccctacttgacatcttcacttggaaaactatagccagatttatgatctttcccacccaattccattctctcttaacattccctttcttaatgtagggaatgttaagagagtctccgtcgaactgg

SEQ ID NO: 138843 - DNA, 342 bp, Homo sapiens
ctcaagtcttggtctatgaaaagaaactgactctggaaccagaaaatttactatcgtcctgtccctgttgttatatattggctacatgacctcatcttcttctatttctttagttatcaaatactagatttgaatgatgatagccaagaccccttctagttgtaaaatctgcatggtgctatgccctagcactgacttcccttccttcctttttataaagcacaggagaaaattaatctcatcacattttagattatcttggcatatttggcagttgagaaactagtcggctataccaaggctggtggtttgtcagtaaagctgatctgcatgggtggacaa

SEQ ID NO: 138844 - DNA, 577 bp, Homo sapiens
gcaccttggaacgcagtagaatttactcactcagaccccatgaaaccctgaatgtggccctcagttcagaatgaatgaataccaggcattcccaacaacctaaagaaacaattgcacatagccagtttgagagctgtgattgtatagaaagtttccatgggcaataagataaatgggtcaccctcatggataacttctttctttatctgataaactggtaaaattaatatgattactgaaagaaacactatcagtagtacatggaagagtaggagaaacataattttacatatgcgacagcttaaattctcttacctttctaaagctgttggttttcaagttccatatgcaattgtagctttttatggttagtatactttttaatcttcagtaagttatttcacaaacatggtatataatgtgtttcatatacttgaagcataacaaattaatacaacttgtttcaccatttagtgtaaacagatgatcaaattaagctgagtcatgggtataagggtattaatcatattgtcttatttcatttgcatgtttacagtatttcacaagttgaaaatga

SEQ ID NO: 138845 - DNA, 188 bp, Homo sapiens
ttgtggacagtgggcatgtgtttctatttctcttggataaatacccagaaatagaattactggatcacaaggtaagtgtatatttgactatataagaaactagaaaacatgtctaaaatggttgtacccggttgcatctcaacctcatcaagagttctagttgctgcctctcctcagcagctttgcag

SEQ ID NO: 138846 - DNA, 321 bp, Homo sapiens
gactacaggtgtgcgtcaccatacaaatattttctatttcatattttttgtagagatggggttcaccatgttgcccaggctggtcttgaactcctgggctcaagagatcctcccacctcggcctcccacagtgttgagattacaggcctgagccaccacacctggctcctccttcttatttgaaggctgtattcgctttccctcatttatttcaccagtcccctgtttactgatggacagttaggtggactctcatctttgctcttacaaaccaggctggaatgaataaacttgatcacaggcatattgcatgtatctatg

SEQ ID NO: 138847 - DNA, 208 bp, Homo sapiens
tggctgtctagaggatccctatcacaatgtcgtattgaaattttgtcttgggtttttctcttcaaagtaaaggggaaaaggaaaaaatactctgacaaatcctagctttagagtactctttcaaaacgtatgtttccccctataattatgtccatggtaaaatatagtccagtactcccctgactcgtgcatcgtttttgatttggtc

SEQ ID NO: 138848 - DNA, 488 bp, Homo sapiens
gatccgcttgcctcggcctcccaaagtgctgggattacaggcgtgagccactgcacccggccaggaatgattcttcataaaacagaaatcagatcatgtcattccttggctcagaaccctccagtggccttccatctccatgctcaattgaagtcaaagcctggctgccatggcttgtgaggccccagatcccactaccgcaccactcccaccacaccttctgtgcctctgggaccacattccctactaaccccccggctcaccaccttccagcccactgacctcaaacatcaactacatgaagctccccctcctcggggcctttgcacttactgttgtttctccctggaatctcttcccagatattcctgtgactttctcccctcaccttcttcaaggttttaatcaatgtcactttaccaatggggccctccctgattatcagatcaaaacttctaagtccctgccattccctttctgcacgaaga

SEQ ID NO: 138849 - DNA, 244 bp, Homo sapiens
gagcatctagacccaacgtttttgtcaattgatcagttaataacctttttaaatgtgtgtttctgtttaaaaacaccttagttaatatatattgtcaattcattgacattgaactcatggccatggatactgtaattcatgccttagcgaagcttatcaaggacatgttttctctgaggcacatcacagccttctgtgcttggggacactaggcaagcacttcagtgctagggagcattttaaa

SEQ ID NO: 138850 - DNA, 396 bp, Homo sapiens
gtgatgctggatgtttcctgttagcactcaggaaagctcagagcctttgatgagcatcttttgatccattagttaaaaccacgctgggttctttatagtggttagttagctctgggctatgggattgtggaagacatttatttcttctttggattcacctggattttctgcaacggacatgtatcgataaaatacatggtgcttttcagaaattgccccatcatcatgttgctgtagttgttattgatattgttgtttctgatggatagagatctaggcctgacactccaagcagtgtgaacagcatttaccttgataagcattcttacatcttaaccctcgggaattttaaatagaagtgttccgtgtgattaaattaacaggtttagagatggg

SEQ ID NO: 138851 - DNA, 201 bp, Homo sapiens
ttaattataagtattttacttaatgatgattttaattagacttctaatcattgctcataaaaaaaggaatttttagtgaatgtgtatttaaaacttcctttaatcccgtccttatcattctttgaaatattttatctctgtgtataccagcaggggtattattggcgtttggggagggagaattcttcactgagcataact

SEQ ID NO: 138852 - DNA, 367 bp, Homo sapiens
cagaagacattgggacatcaggctaaagtgagagcaggctcttacccagcaagacaaagccagagctggctcctatacaaagggaatttaaagcttagtaaggaagcagggctgactgctaatgtggaggatggatgaggaagatgtctctgtggcttgatataccaaactccacagagctcatccagagagattctggagagacagagtcctttgagtattctctgccagacctctgccaaaaactgagaccaagtcaccatatgctgcctattacaggggtaattcacatgaatgccatgtgaactaatttcttgccatctcttcttgaccttgggcaagtcaccaggtctccatgggttttgtg

SEQ ID NO: 138853 - DNA, 99 bp, Homo sapiens
aacagttcagggataacaacaaaggaaaacatgcttttatgaaaccagattttctcatttcctacaacattacaggcactcgtttaaatatttattgct

SEQ ID NO: 138854 - DNA, 437 bp, Homo sapiens
ttttccagctcgggaactaacaattgtgagcacttcctttcccccccaacagaagaatccagtgtatgcacgtgtgtattcaatctgccttatgcttaaatttctattaaccatttgattaccaaacagattttgcataaaccccatgaggcaggactagggttcagattgctgcagcccttatggtgcaatggtaggttccaggattcactttccaaaaataaattcaggatcaagttctacagcacagccctggccaaagccctgccccatacaggcctgactctgcacaaaccagggaacattactcgagggtagggcattctccagtacactgtgggtaccacctgcttgcccatgattactgcaaatgagggtagtccatgtccactcccatcaggttttgctgggtggtgccatattgtcccctgtagaga

SEQ ID NO: 138855 - DNA, 243 bp, Homo sapiens
aatatcatactgttaatataagaggtcatctgttttgtattagttctagaaagctttctgcacctgaaaattacagtgttcatttcagttagttcatgatctgtttttagaatctcattatgttcatgtttgagaatatatatgattaaatatgtcagagatagggagcaaatgtttcagtatctagaagtccttaaatcctgagtcttagtgatgtggaagttcttccactaaaaaaggtgg

SEQ ID NO: 138856 - DNA, 457 bp, Homo sapiens
ttaaccgcagccatgggttggtatgtcccatcctgggttatctatacagcacaggtgaaagccaaaatgttcctaggatgaccaaacgtacaagagtagcttgggaatgggaaggagagaaggagagaggaagaacaaacaacatagatggagaattctgtggcatagggcgcaaagacagcaggaacaaccaccgagacccccacctctgcccagagccatgggctacatgaatgtcttctggaaactggagacggcatgcatatcaatctctcaccagtctaaggataaaaaggcttaggccaggcacggtggctcacacttgtaatcccaacactttgggaggccaaggtgggcagatcacaaggtcaggagttcgagaccagcctcgactaccctgtctctactaaaattacaaaaattcgccaggcgtggtggtgcatgcccataatcccag

SEQ ID NO: 138857 - DNA, 692 bp, Homo sapiens
gtttaacttttattttagtttttctcgattgttgaatgaacattctttctcccagtttccaattatgttatctacattgaatcactgcttgactccatttccatatttgtagtgttagtccctggtaagacaataaacttccttataagcaaatttagaagcaattatttaattcaagcttgcacaattttctcgagtccagcacgagttgttgccacatctaacaatagcaaagtaaaggttgcaatgcttactagtgatgatttcttgaggaagaaaaataagtcttacttaacaatagaaaccttttttgtcttgctgcccaagtcaccaattttatataggggaagtagttaaaattaactaattatgacaattccagggtaaattaatttcttagaaatgtttcagagaataatactttctgcctcaaaagtatgcatttattatgtatcaaataaaattttaaatttagagaacattgaagaaatatgagatcagagaaatcaaagattattattaaattacatttcttttggtatctcctgagatttctcaattatgcattacttgtattcattcatttattcatcaaatacaatatttatctaaaacctgctatgaccaagactgggtgaggaactggagacatagctattaaaaaaatagtatttatatttataagtgatgaa

SEQ ID NO: 138858 - DNA, 391 bp, Homo sapiens
  misc_feature (11)..(11): n is a, c, g, or t
acggggccggngcttctggaccaggcgcacttctaacttgttttttcattaattcattcagcaactgtttattgagcacctactgtgtgccaggggctggggcacatcggtgaatgagaacacgaccaccctgggagctgactggcgagggagatcagctcaggggtgcacagtgctgtgtctgatggtggcaaggactaggaagaacctaggacagggtggcagggacatgacagtggggcacagtgtacagggcagagtgagccatgggaggctttggggaggaaatgttcctggcagagggaatggcacatgccaggttcatgagaaatacacggtgtgtgtcagcacagtgaagaggccagtgaggctggagaagtgcgcctgggtg

SEQ ID NO: 138859 - DNA, 433 bp, Homo sapiens
attttattgtgtatcgtgaactaacaaaaatattgttctaattgtggtaaaatacacatcaaatttaccatcataaccatttttaagagtatagttctgtgacatgaaatatattcatattgtttagcaaccatcaacactatcatttctccagagttttttaaatattcaaaactaaaacattgcaaaaattaaacaattactcaacattccttcctcctccaagcccctagtaaccaccattctactttctggttttgactactctaggtacctcagaaaagtgaaattacacagtatttgtctttttgtaactgatttattttgcacagcataatgtcctcaagcttcattcatgctgtagcgtgagtcagaattttcttcctttttaaggcttggtgaaacctcatcacacgtacataccacattttgt

SEQ ID NO: 138860 - DNA, 380 bp, Homo sapiens
ctgactcgggggtgggggcccctctgcctgtcctcccctgagccccaggctgggctcactctgcacagacacatcagtgggccaggggtcaggcaggctgcctggatgagctggaaacattctagaaagaactttgagctgcactgggtctagtggttagccagctgttgacactggagcccttccttcctatagaatctagagactccctaactgttggggttgaggcaaggctgggggcttctgagcgaggaccactagggttggccctgggggtccctcctgaaccctcgtacccccgggggacagtttgaaagctgctggtcttctccacccttcatgactcctatggggagactgagacccagaggggcagggcc

SEQ ID NO: 138861 - DNA, 449 bp, Homo sapiens
tcataaataggcatttcaaaagagggaatttactgacatgagggtctgaatgttcttaacatgtaggaaattgaatctgctttctaaagccaggacggtactattacattatctgtgcagcaggaaactaagcaatgaagtgtccccgggtgggaacatcggggcctaggttggtggggtttgcacctcctttgtgctggtgccaagtcagagtcctgcatgtaacatttacgccggaaggacccaactgaagccggcacggggtctcttgccctcttttagacaggactgcaattaacagctctcactcttgcaaagtgatattcactttatttactatattagtgggaattaaaaacttttacaaacattctctgcttttgtgttacttttcggtggaagagagaatagggtgaggctcattcaccgagccctcggtggagaaggtt

SEQ ID NO: 138862 - DNA, 362 bp, Homo sapiens
tagccggccagattttctatgggtttggaggatagcattaatttaccaggtaaagaaaatctgaccttagcagtaaagtcatggaccattcagggaatggtaaataagtcatgcacctggaattgtgggagatgagcctagaaaaacagttatcctaaaacagttatccattaaggaccttgtattatctatttaatgaggaaccatcaaaagttctcatatagaggactgaagtgatcttctttatttttttacccatccagaatagtttacttggcacaaatggactagtatatgacatggagaacagtattaggctttagttagctttttgattaaaatctactcatagaaaatatctg

SEQ ID NO: 138863 - DNA, 130 bp, Homo sapiens
ggcggccagatattctatgcactaatatatatcatgcagcgaggaaagcagagtacagaacagtatctgctgttctgagtacagtatagaatggtatttataagccatacagatgtattacacagatgta

SEQ ID NO: 138864 - DNA, 418 bp, Homo sapiens
tgtggcaggagctgtctcctggtttgctgggtcagggccctttccaggaacagtttactgtgtcttatttagtgcttgtcctccacatctctagctgatggtagtgtcttcctgaattctaggcaactctaccaaattccaattgggtgatactagcatagataccctggctgaatttttctgggatttaccttcacttgctcatgtagccatggagatatttaaaataacgataatactcactggtagtctggtgcattatttaatttctaagattaaaaacaaaaaacaaaacaaaacaaaacacttgccttaaaatggccagagtcatacagtttgatccatgtgtgaggcagagaaattcctgatgacttgggcaccagacccggcccgctgtgtgattcagatctgtggaaac

SEQ ID NO: 138865 - DNA, 559 bp, Homo sapiens
atccctgtgaggtgctgcccaggtatccaacctgcagtgcacatgctcgccactggcactggggatggtgagtgcagcagagagatgggattcttaatttattcaattttaattaaaaaacacagttcagttgttaaaaacctatttaagtgtgtttggaatagcttggatatgtgaatttaccttttcaactgtgaattttatgaactctaaatacagatcaagtatttccagcaaaaatttagtgtcggatttgaaatgtgctctaatggaaactagacaccagatttcgaagacttagtatgaaaaaaacataaaatacctcagtaattatctgtattgactatacattgaaagaatattttggccacattgagttaggtgtcctatgttatttagatgcattttacccatctcttgtttttcatgtagctaccagaaaatgttaaattacctatggggctccccttatatttctgtgggacagtgcgagtctagacagtgccttacgggatccatcagaagcattattggactttctagggaaagttgctggact

SEQ ID NO: 138866 - DNA, 454 bp, Homo sapiens
cccttttctccctgcccaaccactagagggccaggtcatttaaaaaaaaaaacaaaacaaaaaaacaggctggacgcagtggctagggtttgagagtactgactctaattttgaaaggtctatggcagagagaaatgttatcaaacagtatcacattacagagaaatctgtggtgaaaggaagaatcaattgatgtggcaaatttcataggttgttactgccaccccagacaatcaccaccctgatcagtctcagcagccatcaacatcaaggtaagaccctccaccagcaaagattacagctcaccaaatggcaatttttcacaataaggatttcttaattaagatatgtacttttggctgggcatggtgaaactcttgagctcagcagtttgagaccagcctgggcaacatagtgagaccctgtctcaagacacagggaaacaccgggtacc

SEQ ID NO: 138867 - DNA, 435 bp, Homo sapiens
taaacttagttgataaagcagtggcagggtttgagagtactgactctaattttgaaaggtctatggcagagagaaatgttatcaaacagtatcacattacagagaaatctgtggtgaaaggaagaatcaattgatgtggcaaatttcataggttgttactgccaccccagacaatcaccaccctgatcagtctcagcagccatcaacatcaaggtaagaccctccaccagcaaagattacagctcaccaaatggcaatttttcacaataaggatttcttaattaagatatgtacttttggctgggcatggtggctcatgcatgcctataatcccagcactttgggaggctgaggcaggcagatcatgaggtcaggagttcaagaccagcctgtccaacatggtaaaactccgtctctactaaaaatacaaaaatt

SEQ ID NO: 138868 - DNA, 170 bp, Homo sapiens
ttgctgcttagcccatctttatctccaataacttctctttaatctagtttctgtaagagtttatttatctttcagatttagcaattaatgtgtgccagcatgcctcttctatcccatggccgttatcattagtcaatgaggcactcatttctgctgagtcaagaaatctt

SEQ ID NO: 138869 - DNA, 445 bp, Homo sapiens
ggcggacatagcgcgtcgggttattatccatgcccgttgcaattgaccgcttttttggccctacaaacatgaagcacagataattaaacacgcaggagacaaaaagaaaagcttaatctgaaatttgcctgtgtcatttgatttttcatgccttatttactttcataattatgtttgcctaagaagctagagactcatactgccatttactacaagcatttttcgagcgacctttgagtaaagggtgaggtggagagcagggaagttgcctgtgttgctttagaaaaaatattaacatctagacctccctctggaggttctgactgatggtgtccatggtacggcctaggtacttttaaaaaagttcccgtaaggactctgacgttcagccaaggtcagtgaccattgattgaaggctacctataactcgcttttgtttagttac

SEQ ID NO: 138870 - DNA, 426 bp, Homo sapiens
aggtcgacctagaggcccccccatcggcggttgtactccaccggcaggttgtactgtcttaagtattttacttgtattaactcatttgattttcatggtaacccagtgagatagatgggttatttattttagggatgaggaaactgaggcatagagaagttatttacccagtgtcacacagctagtaaatgccaaaactagggtttaaatccaggcagttcgactccagactggtctgtattgcttctttttcatgggagagttaacatgattctagttagtgttgaagtctacagtttctctattactgtgtccttagctctttaacttttacctcttatgacctttcaccacttgatctgatgctctcctgctttttaaattcttcctccttggacacatggtaatgtctgatagattgcatag

SEQ ID NO: 138871 - DNA, 473 bp, Homo sapiens
gcccaacttccatgttgcaggttctttatgtgtattgcctctgagccttacagcaaccccatgttaggataccttcatggtaacttcataaagttacccaaattttacagccgatggcagtgagactttgtgaggtgaagtgacttgctcaggttcacacagagaataagtagctaagctgggattcaagcaggttcccaaagcacctgccactctgtcttccttgtttcctgacgtttgcttctcactggcaaccgtaagggcagaaatctcccggtggaggattgaggaggactgtagttaacgatcgtcccctgggcctgtgtggacctacagcatttggtatacgggaacagggagggtgggaacacagtgagctttgaatgtggccagagggaagactgattctaaagttaacttgaacatgaacaacaaacttaggctctgttttccctttcagttaaaaacaaaca

SEQ ID NO: 138872 - DNA, 247 bp, Homo sapiens
acctagtagggatagaaatcacaatctaagtaaatctactcaattttaatttttaaagtcatgttgtaaatttctaacaaaaagatttcaaattcacattatcttattaatactggcatttaaaacattaagttgctaccttgaacccatctcacctcccaaataattttcattatagccataagttcatcaatacaatgctttcaacctaaagctaaaactacaaaggtcaacccttcttactcgt

SEQ ID NO: 138873 - DNA, 432 bp, Homo sapiens
cccttgtgcccagcagtcctgctgcaggtgagaccccggcctaggcactgataggcaggtgctggcctgacccctgagggtgggctgagtaaagtgtggaagaccccctggctggctgcagcccttgggccttgcccagctttcagtcctgcagtctgagatgccggcaggagaaaggaccgtttcaactaaaaggggcttgagggaccatctcatccaatccccgtcttgttcagcagagaaaagtgaggctcagagagtgccgggacatgggcaaggcacacatgtggcagggctgcctctgagatggaaattctgctgacttctgggatatccagcacctcctggggctcaccactacagcgcctcttcatttactattgcccatgaggagctggggcctagggagttttcactggcttgtccaaggcc

SEQ ID NO: 138874 - DNA, 262 bp, Homo sapiens
caagtccctgcttcagttcctttatgtacatacccagaagtagcattgctggctcacatggtaattctgtttaacttattttgaggaaccaccaaaccgtttttcacagtggttgcaccattttgcatacccaccaacggtgtacaagggttctaatttctccacatccctgacaacacttgttattttctgtttttttccttgatagtagccatcctaatggatgtgtgttcttagtcatgtatgttatgaagtacactca

SEQ ID NO: 138875 - DNA, 528 bp, Homo sapiens
tttgtccctttcagtaataacctctttggtcattttatgggataagggaaaacacacttttagctataaaccaccttctcttatgtcctcccactaagctcatctttttactcaactttcctccttccagccaaacatagcaccccttcttccaaaacggttctcttgcgctttggatcccacgcattaaaccatctagaatccctcacatccctctagctgccctttttcttctcctccccttcgaacatctttaacaagttgtaaacacttgttaccccccatttcctcaccccttggatcactccagtccaagctgcaaatccaaggtctgccttgcagtcctcacttaagttgatggcagcagcattccgcgtcagtcaatactttctgaaatacttttacattggcttctataatatatcacttctctggtttcccttaagctgctctagctgctcctactgaatttccttttctagtttcttcctcttctccccctccattagtattgaaagttcttttttt

SEQ ID NO: 138876 - DNA, 439 bp, Homo sapiens
gcctgggtccaaaagtatcaccagactccctaacattataaaggggaagaagcaaccaagatacttgtattaggaacttttcttgtgtgtttttaagctttttgccaataaatgcactgagtgccataaaaggttctgcaaattctcttaaaactcacacatgtcaaagctactggatcgtatttaacatgttactgtttgctccatattttgaaattcacagcacatgcattttaagaacatcccaccttggaacacccttgtacattttgaataaagaatagaatcagctcatgtcaggccatgaggtcttatctctcatctacataaacgttgagcttcaacggatatcctatttttacattcgttaaacttaaatcttgtgttaaaaagggaattaactgaggaggctgccacaggtgtcatcttaaatcttgac

SEQ ID NO: 138877 - DNA, 528 bp, Homo sapiens
gtctgagcggagcccctggaggtgggggaatggccttattctttgaacctcgcatccggcccagggtctggctcagacagagtgcacagagtgtgtgctgaggagggcgcaggtgcggcagccccttacctatgagccaggcctctgtaggtctgcccaagggccaccaccaggccccaggaccaaagaggaaggagactgcccgggtcctgacatctcctgagaagacagatgaccctggctgccagggcgcctgccaggtggcccctctgcccatccttcctccagctcccagcaggttcccagttgcagtggcatatggggggaggggcacaggtgatgagggcaggggacttacccggggggaactaggacattggccagagacaggctgctccttggccccacttgtggccctaattcactgtgtgatctccacaagtcactttgcatctctggtcctgtttcctaccctgtgcaatgtgctgttgcactccagcctggatgacagagcaagattctctctct

SEQ ID NO: 138878 - DNA, 118 bp, Homo sapiens
ggttgctaaatactgaaaattgataaacttttgtacctgccttcttaaaaaatacccacaggtcatggttcaggcatgatggagaaaggcacagaggaggcagaggacctgtgtttta

SEQ ID NO: 138879 - DNA, 1104 bp, Homo sapiens
cggcattcaaaggctgaagggccacctgacactccagaggctgctggaaatgcagggctgtttcatcctgggaaagcaaaagattcttcaaaatcaaactgtgtccggaattggtgggttcttggtctcactgacttcaagaatgaagccacggaccctggcagtgagtgttacagctcttaaggtggcgtttctggagtctgtctcttctgatgttcagatgtgttcggagtttcttccttctggtgggttcgtggtctcgctggctcaggagtgaagctgcagatcttcacggttgctagtaacacaataataaagctgctttattttccagtgaagatgtatgtgatagggagtggaggaagaaaaaggccagaaaattccatagttagcaaatatacctttcttacttaaaattctttttccaatgtgagccttctaaagagttactgagaaattaggtgagctcacctcatttaatgcaatagatatgtttctgaaaaataagcaatacataggacattggccaattaagaattttgatgaagaagaattttcacatccgaaagagtaaaaatgaaaaacggtacaaatgtagtggcttttaaatttcaaaacaaattattttgataagataaatattcctctcataaagtgaaaatggaagagactgcttgctgggtgttcgtcaaaatggagttagatggtctgtcccagactcccctgttgttagttctgagaacagaagtaatggtgcttcttcaggactggctcatagaaacctgccgtgttcagcccccacaatcctctcccttctgctggctggaaacaaatgacaacgaagcctcacgtcttggagaaaccacactgctgaggaactcaagtcctagaagaaccatttgaagagacccatctcactaaagaaaatcacacaagcaagaagtaaacttcattgtatctatgtatttaattgtcataacagtctaccttaactgatacagcaaaaattcgctccttttctggacacccagtttcaaaatctcagtgtcattttttacttctctcttttcaggttgtttaatataataaaatttgtgtgtgtgt

SEQ ID NO: 138880 - DNA, 821 bp, Homo sapiens
cggcattcaaaggctgaagggccacctgacactccagaggctgctggaaatgcagggctgtttcatcctgggtattttccagagagaagtactgagaagcttaaagtatttgaatgggaggaggagaagcaaactacagctacttcagaggataacactaaacacctagtccactctgtatacactagaggtgctgttaattttcttgtggagaaggaactgtctttagaaaaatatctcaaaaagccactgaagtagaaagtttcagcatgctgaagatggaacttgagaagatagaaagttctgggtccttagtggcatgactgagtcgctggaccactgttggaaccaccctatgtcttagtttttaaatctctttactgtctaagacatttttagtggaagtatttatctctggcatccaataagacctttaaggatttgcagttctaaaaaaaaaaaacaaaaaaaaaaaaaaaaaatttggggggggcccgggcccagaaaagtttttaaaccccttcggtgggggggggggcccctggttttattgaccactggcccaagaggggccccaagaaatccggccaggaacaaggggtggtttcccccaaaaaaagcggcggggaccgggggtctcggacataccaaaggggtgcggaggcttaccgggtcctacaaaggtccagggaccgatacgccgccgcggggggggggcaaacacacaacaacacaccacacacaaacgagcacaccacaacaacccaaaaaagcaacaacaacagagaaaccaaacaaccaagagacacacgcaagaacga

SEQ ID NO: 138881 - DNA, 861 bp, Homo sapiens
gagagatgagaagactttcgggacagattgtgtggaggctgtcattctcctcgtgacattgctgtgggagaagaaggaggcattccatgttggcttcagtgaagaacttcagtattttccagagagaagtactgagaagcttaaagtatttgaatgggaggaggagaagcaaactacagctacttcagaggataacactaaacacctagtccactctgtatacactagaggtgctgttaattttcttgtggagaaggaactgtctttagaaaaatatctcaaaaagccactgaagtagaaagtttcagcatgctgaagatggaacttgagaagatagaaagttctgggtccttagtggcatgactgagtcgctggaccactgttggaaccaccctatgtcttagtttttaaatctctttactgtctaagacatttttagtggaagtatttatctctggcatccaataagacctttaaggatttgcagttctaaaaaaaaaaaacaaaaaaaaaaaaaaaaaatttggggggggcccgggcccagaaaagtttttaaaccccttcggtgggggggggggcccctggttttattgaccactggcccaagaggggccccaagaaatccggccaggaacaaggggtggtttcccccaaaaaaagcggcggggaccgggggtctcggacataccaaaggggtgcggaggcttaccgggtcctacaaaggtccagggaccgatacgccgccgcggggggggggcaaacacacaacaacacaccacacacaaacgagcacaccacaacaacccaaaaaagcaacaacaacagagaaaccaaacaaccaagagacacacgcaagaacga

SEQ ID NO: 138882 - DNA, 527 bp, Homo sapiens
acttgaccatacccattcttgcatttgttaacatgtgtgttctgccctgcaaccacagccaagttgtagcttaattctaaagtcgaaaataacattatttacattattacacatgtgagtattgttcttggcgagaccaaataatgaatgtgcccaggattacatttccttctttacagatctggaccactcaaaggagaatgaccaatcaaggtcaaatggattcccttttcttagactctgtcacctgcttaaaatccttgctaggatttaatctacttcatattcaaaccttggcttgcttatatagctctttgttttgcccaccatttctagttgcctttttattttgtttactattcctccttgattatgttgtaaaatgctattagcagtgctgtttattcacgtactcctacaccccagtccccttctgtgagttggccccctcgaccacactcctgggccacatccagtcaacgccacaattcctctcccacccgggtacactctaggaacagctatga

SEQ ID NO: 138883 - DNA, 585 bp, Homo sapiens
acttgaccatacccattcttgcatttgttaacatgtgtgttctgccctgcaaccacagccaagttgtagcttaattctaaagtcgaaaataacattatttacattattacacatgtgagtattgttcttggcgagaccaaataatgaatgtgcccaggattacatttccttctttacagatctggaccactcaaaggagaatgaccaatcaaggtcaaatggattcccttttcttagactctgtcacctgcttaaaatccttgctaggatttaatctacttcatattcaaaccttggcttgcttatatagctctttgttttgcccaccatttctagttgcctttttattttgtttactattcctccttgattatgttgtaaaatgctattagcagtgctgtttatttcgtacgattcggctttttccccactgaagacctttctcttggaaggcctctgcccttctgcaatctgggcaagtatctgctctttgatttaaggttgcatatacagctgtacctggaccttctcctcactgggctcttgggttggagcccgtgtcttaaaacccatatcttcctttca

SEQ ID NO: 138884 - DNA, 770 bp, Homo sapiens
ataatttgtaagtttcaaattgcatgccattctgagtaatgtaatacgatctaatcttccaccatcctactccatcccacctaagatgtgaaccctctttgtccagtggatccagactgtatctgctacttgcgtgttagtaatcaaccaaagataacaaggcaactcttaacgtaggagtgcttttctgtgtaactcccttctttccagatctctgcccaacataggcagccacctcagcctctctgaattctgctccttttcctcaactcactgttatcacagttctctacctgggtttttccttcctaccctgcagccaaatgtagggtgggaaggaaggtttttctttcccaccccgcagccactttcttccaggcagaaagccagaatgatggtatagagttgaccttactggttgctttatatattttgtccagttttttagttgtacagtgggagggcaagcccattaacagttagtggcagtataagtcttgaagctaggattctaacctaaggccctggtttccatgtgtgaatcagtgttttatgccattctttaaaaatctatgattttatgtttcatataaattaaaattttgttcatgggatttgtagttgtgcagtatacatcacaacagaaacttgtagttttaagtgctgttttacactctgagatttatcagaattgagtaatagtacattaaatattatttccaaattatagcacttaatcacaaaacacattccttaaaaagtaaaacaaa

SEQ ID NO: 138885 - DNA, 158 bp, Homo sapiens
tcagaaccgagcaacacagccacatctagttgtaagagaagctgagaaaacagggaacacaggagtctaagtggcttagaccaatcatggttcattcattgcctggggctagacacattgctgcctcagaccagggtattttagcaagaaggataaat

SEQ ID NO: 138886 - DNA, 279 bp, Homo sapiens
tataaacttcaaaggaaagtcatgtggaaggggaaatgcacctctgtttaagtcttttcttaatctcttatgattaatttcttcttccatctgatgaaagaaaatgcaaacgaaatctcttatttggttcacagttgaagatgagttccagaaagccgcctttagaaagggaatctgttttgaacatatgaaaaccatctgagtcaagatgtattacatggtgattacagtctgacagatgttttgaagttgtaatgtgttcatcagaaagcacacaga

SEQ ID NO: 138887 - DNA, 459 bp, Homo sapiens
gtgtgaccaagctattcggttaacataaccacaagaatgggaacacttttatcagaacagatctagtttccaatatctacccacccactggggagagaaaaaaagtatggatctctagtacatcatgactctggcaggagcacccctctatgaaacagaactcttgggtcttttgaacccaaaccaagcatttcaagggaataattctgagtcagaacaaagctgaccaagaggctgccccgagccacggctcttgcttgacaagttcatgctcagcctacctgcgatgagctttgtagttgccacatcatggtctcctgcaggagccaactgcactaggaacagctcttgttacataaccctcggccataccccatgactgtgcacgaggacatggctttgccctgcacaaaggcacacaggattttagacatggcatcttgtttttcagggagcaca

SEQ ID NO: 138888 - DNA, 183 bp, Homo sapiens
cacaagtcatgatgacacctacctcagctataatattgtttttattacaaattgagggaatgatctagatttgtgtacagagtcaaaatgtagcttaaatccagaggcctgacaactgaggcctctaagtcttttgctaagagaatccttcttcatcaatgcttccttaccaggaataccctt

SEQ ID NO: 138889 - DNA, 406 bp, Homo sapiens
acacctggccagactgtacttgaataggcatgaagttaatcagttgattctgtggttcaaataaaatttcaactaccaataaaatattcttactaccgacatacactatgcgaaaaaaatactacatcctgtcaaactttacttggaaacttaagtcagctgggaatgggggatgatatcccaaagaacaaacttaaacagtaacagatgttgctagtgtcttctaaggcagcttactcttattagaagtagtgcttctgtattgctaaacataatcagcaggagagcaagtttggtgttggaagatgaactgctcatggtgatacaaaaaacacatcacataatgatgtctcaccacctccatagtacatcttggtccaagccaccatcttcatctcttggttgg

SEQ ID NO: 138890 - DNA, 509 bp, Homo sapiens
cccaaagtgctgggattacaggcgtgagccaccgtgcctggcctggatttgtcctgtttctgagtgccataggggtcagccacagagctgtccatctgtaccacaagaagaagaaaagcagacttggcaatttactggatagggctcccatgatttcagtcttttgatatcacgggtaaaatgggatgactgagaaacagctacggataggagactgaggataggggtgccctctacagaggtcctcttagccgtctgcaccaaaacagtcagatagtcacccccataaagcctggggctttaatgacctcagagtccttccacctctgggttctgtaaggaagaatcagtagagtgtttcacggcttggtcacatggagaccgtgagcatcagcaaccaattcagaacttcatctgggacccaagaggggcactgacaagtcagaactcagaaattagcctaagaaggaaaggtgggtctctgaacacacctaggcttgcctgaaagt

SEQ ID NO: 138891 - DNA, 146 bp, Homo sapiens
aaaataaccaatttttatgtacatatacctgacaagtctgcagtgtggcattcagttggcagatgtggttatgtctagacacttagaaaagagcaagcaaagctaaggcagatgaggtaacttcaagaacaaaacacttcctttga

SEQ ID NO: 138892 - DNA, 214 bp, Homo sapiens
acagatatttaacaaaaaaagaaaagtcttagtcaagattttgctggcaagacttcaaaaccaaattgaagtgttacagctcttttagaatgtgtctagcaggctttctggctttcactgtgaaacccttcacggatggcagggggtggtggacaattgaacaggcggtatttctagtgagacagcaaataccattccccccccttttgagtct

SEQ ID NO: 138893 - DNA, 217 bp, Homo sapiens
tctcaaactcttgacctcaggtgatctacccacctcagcctcccacagtgctgagattacagacatgagccaccatgcccggccccgtaatcattacttaccaccaagaatgcctctcattccacactcatgaaccacatttgtctatcagttttaagtgttatgatggttaccctgcttgttattaaagcctgccaataacagagctgaaatatcg

SEQ ID NO: 138894 - DNA, 208 bp, Homo sapiens
gtgacgcatgtttcccgaaggctgttctgtagcaagcagtcacaacaatgctcaaggaaactaaaaatgataatgactgctgtgaacagttgtcagagagggagctgaagttttgggggatgcctgaggcacagtgcccaaccctgctggtctgggatgaatttgtggcccccacaaggaatgtagagtgtcctggttgtgctgggtg

SEQ ID NO: 138895 - DNA, 529 bp, Homo sapiens
tcccgggggcttaaccctattacctattatctatcatctacctctatttacttattatctgtctattgatatctatctatcatctatctctatttacctatcatttatgtctatctatcatctatctatatctatctctatttaccaattatctatctagctaggtagctatcatctatctattactatttatctatgatctatctgtctacctatgtattgatctaatctatctatcactatcatttatctctattgacctgtgatccaaatatctatgtatctatttccactatgtatctatatctatctatccatccatctatcaatcatgtcactatttatctataatctatctatctctatttacctattatctatctatcatctacctctattaatctatctatctatcaaatatctatctacctacctacctgtctatccaacacctccctctctctctctctctcttcccatatacagggtgaagggcccccgggggtaccgcgcccgagctcgcaaccag

SEQ ID NO: 138896 - DNA, 266 bp, Homo sapiens
ggttgcactgagacacactggccctataaaagctgcactaaagaaaaataaactgatgtccaaggtgcatcagaagaaagtctgtaaggcatttcagaaagcactacaggaagccttttaaggaaaactctgaacagaaattactgtcataagataattctcccttcagccttctgcactctggagtcttcttccttcccattcatcatgccaatagcctgcaacctgcatgacccaaatccagaatgaccattccagaccagaac

SEQ ID NO: 138897 - DNA, 185 bp, Homo sapiens
actcctgggctcgagatcctcctgcctcagcctcccatagtgctgggattacaggcgcaagccaccatgtctggccttaattaaatctaaggtaccaatcttttatcatgagtactgcctgcttcctgtttaaggaagaggttaaagttcattttttccacagggacaaccagttgatccagaat

SEQ ID NO: 138898 - DNA, 268 bp, Homo sapiens
gggagccttagcctggagagagaagaactgggaggaagggagagaatagaaacagacaagtgtgggtggagataggaacttcagggcaactgggataagtgagaacaaagaggatacctatgccccttccaggatttatggaatgtgggagataaagccattcccatttgagaagacttcaagggaaaaagagtaatcaggtactacctaggtttcaatttacacaagaaggtgaagggaacatccagatggaagaatgagggcagaa

SEQ ID NO: 138899 - DNA, 194 bp, Homo sapiens
agtgttagatgacaaccaggcatggccccagtaaaagacatagttaattctgttctaaatcactctgcccgtcacgctccatgaccttgcatattacttaattaaactatatctgaattggctcatagcattataatgctatttctccctcataggacacatttcaaggctatttaactataagatgtgggact

SEQ ID NO: 138900 - DNA, 219 bp, Homo sapiens
ctactataccatgcagccatcatattcattttcagctcttgaaaacatgttttaaattaagaagcatttaaatgctgagaagacatcccagaccccagcctctgtctggttagagacagaagaaaaataaagttaaagggcatgtacataacctcacacatggaagcattctcttaattttactttatcaatctaactttttttttttttttttttttt

SEQ ID NO: 138901 - DNA, 352 bp, Homo sapiens
aaatgagataacaatgcactgaatatattagcaatccatgaatccatacggatataaacacaaacaaataacaaaatggagtccaagagaaagctcttctttacaatggaactccaactaataaaatgtggaagtaacggtaaatttagaaaatcacaatcatattgcaactgcaatagtaataactgtttcaggaaagaatcaaattagtgagtcaaagttttatgagaaacaagatatttacaatgtcatggctaggcacagttgctcatgactctaattccagtgattttggaggcccaaggtggaaggaccacttgaggccaggagttcaagacagcctaggcaacat

SEQ ID NO: 138902 - DNA, 255 bp, Homo sapiens
agattctcaggcctggccccagacctacccagtcagaatctgcatttgaccgggaccccccggggactggtgtgcgttcagagttgaaaagcctgctgcatgttctctcctgagccggggctgatggcctaactatccacgccgtaggccctcagccccgctgtctccgcaggcatgtgtgcccgtggcactctcctctgcaccttggcacctattgccctaggtgccgtccatgcccttccccagtcaggcccc

SEQ ID NO: 138903 - DNA, 327 bp, Homo sapiens
cacattctgaggtactggggattacgactccaacatatctttttgcggggaggagaacacagctcaggccataacgagccatttgtagagattagctcactatctgtttctgactcttctttccatacctgcctacccatttctctccacactgtctcttgacagaacctgtggtctggaaaacatctggtcaacttagtcacactgaggagtaagtggccaaagctgcctttgtctatctgtagtatacagtggttcaaaaggataaaaataatgataggaaactgttaaattttatatgttatccctcctcgaaatactgcattt

SEQ ID NO: 138904 - DNA, 224 bp, Homo sapiens
tcccaaagtgctgggattacaggtgtgagccaccacacccagccaaattttttttttaagtgaataaaaaatggctaggcataagccaccatgcccagccaaaaaatcaattcttgtgatcatatcatcacacaaactcttccctcctagcacataggtttggagtactaggttcccttacttacttgaacagaatgatttttttttttttttttttttttttt

SEQ ID NO: 138905 - DNA, 448 bp, Homo sapiens
tcacacagaaaatgtttgaggcaggtcttctttaattgcatgcctatcgtacagaatagtgattataagccctggacacatggatttgagtcctaactctgtctcttagatttttgtatgcagttttaggtcttatggccagagagatttgaagatatttaatatctctaagctgcaatctttatctgcaaactggggttagtaatccaatcaaccttattgcggatattgtaagaaaaaatgagatgacaagtgtaaaaactcagaactatacttacaaggtaagcagacaaaatatgctattgttgtgattgttttctctctgaataaataaactctgctgaagaatttattagattatgtttctcgaatcgagaattcagttccagctctcatttctggcactgacatattggccaaatatgattcttatacaataatcagctgc

SEQ ID NO: 138906 - DNA, 190 bp, Homo sapiens
tccctgtcctggatctatgcctgtctgttctatatcagcctcttgctttgaccataagaataacttcagacctttaagcatagaggaaataggatttctgtctcccttccccacctttgtgataatctcagcttctgcttttaaagtctatctcccaagtagtttgcctactatgttcctcccaaggtca

SEQ ID NO: 138907 - DNA, 166 bp, Homo sapiens
cgtagaccatgtgtagaatcagggctgtgaaggaaagcagctttaattgtttgcacaacaaatatagaattggaccttaaagtctctctagatccttaaaccacatcatcctaaggctgctagacacatacagtgttctcagtacagcttggggttagttggaact

SEQ ID NO: 138908 - DNA, 385 bp, Homo sapiens
ccttgaaattcccaccattcttgaatcccctgacgctggactccagcctgaggttccactggggaacagaaactggccccctgccagcggggagcatggactctgggccctgggctctgtaactagcagctggcagcatgaatgggaacggagtgagcagggtgcacgggaacggcctgcatgaggccagcgagttttactatgaggctgtggaaggggcccacaaccccgggggcctcctgctttcaccagctgctttcatcaaccctgctcagtatgccagcgtgctggaaggacgcttcaaacagctgcaaggtgaggcccgggggccccctgtggggacgactgtgcctgggcgagagggacctgggtgtggggagagtgg

SEQ ID NO: 138909 - DNA, 802 bp, Homo sapiens
actccccctcagcttccaccccgttggccttttcagtgaagcccacactccccgatacccagggacacagaagccttaggacaccctccctgaatcccccagctgtgcccagcccagtgactgctgcgggatgacagcacagtccagccttgcgggccaggggaagggagggggccccacggccaccgtgaccacatgcaaggttaggggtcagatgtgctttcctggggaaatgacttcctttcctggatccaatctaaaggcccgaattttgaaaagaaagcggcaggcgggctctgaagtgattccgactcccgtgcttaagccgcgtgaggctctcccaggcctgctggggccccgcccaccgctgggctgtccacagccaccctcctgccagcttcacgatgtccccatgactgtgcagcccctacataacgtcaccccaacaaaaacacgctgcttgaccggttccacctgcttccgagccttccagcccagcctctctccagccaacaggacggaggaagcccagggccccgaccttcctgtggctcctgactaggggcacagtcactgctggggacactggtggggaagggaaccagccacaaaagggatgtggcctcccaaggcagtatttatacgttcctggcctcaagcgggccagatgcttctcagaagcttagttctgacacagaatggggcggggggttcctgacccatttttgcaactcttctttacgtttgaaattctgtcaaagcaaaatcagctcagaattaaaggttacgcggacactcacaa

SEQ ID NO: 138910 - DNA, 131 bp, Homo sapiens
cgagttcagggggaggagggagggtgagatgaacgtccggggaaagagttcggtgtccacgcctaagactccctcagaatggacaaaaatgtccggtcagcaggtcaggttcccagccctgtgcacgcgcg

SEQ ID NO: 138911 - DNA, 183 bp, Homo sapiens
ggactgggagaccctggcgaatatgagagaaaatcatgctgttttacaaacgcctctggcaaataaaaagacccgtgcatgtcaagattagaaatgaagtcttacgtggtttcggcccctttttaatggccttttcctcttctgagtataaacacttcttacaaagggaaagtccaaggagct

SEQ ID NO: 138912 - DNA, 127 bp, Homo sapiens
cacgtacctgcacgcacgtgtacacacacacacgcacaggcactcatgcacagatgcacgcatacacagggcatgtaccttcacacacgtgtaaacacacgcacaggcactcatgcagatgcacgca

SEQ ID NO: 138913 - DNA, 291 bp, Homo sapiens
gttccctcgtggagaggagatacattctgaaaatggctgtaaataacaatgcatcagcagacctttatttccttatctgttccattaattgaggtggctcagctcacaggtgcacaccaaacttcacttattcatggacacaaatctctgcctttgtatcataaatcttacattttaacagaagagataaagactcaggaaatttaaaaatgtgtatgtatttggaaaatcagaaagttaataatgctataggaaaaagaaaaaatactaagtaaaaaaggacgatatccc

SEQ ID NO: 138914 - DNA, 541 bp, Homo sapiens
ggaggctgaggcagacgaattgcttgaacccaggaggcagaggttgcagtgagccgaggtcacaccactgcactccagcctgggcgacagagcgagactccatctcaaaacaaacaaacaaacaaacaaacaaacacttatatgccttagtttctgaagtcagtaatttggacttaagaaaaagaaaagataatactttgtttttattattttattttggaatctaccacatttccagcaatactatatttacgtattaaaggtctagttcaaaagtacgtggaaaggtcccttttttcagttccttcattcttctactctccaggggtctacccttcacttccattgtgcatgggcagttctcatattgaagtaaagtttaatctgagcagaactgcgtttttaccaacctgctggctttagtgatgtttagagccccagctaagtgacaagttttgtggaaatacgagtaaaagaggaggcagtgatagcaacaaacagtggaagtagcttctgttgttcacattaattgtcacgagga

SEQ ID NO: 138915 - DNA, 298 bp, Homo sapiens
tcagttttctatgcttttagaactgagcatgaatacttcaaataaataaaaaccagcaggctccgttcattctctcttactgctgtaacaaattaccactattatttggctttaaacaacgtgaacgtgttatcttacggttttggaggccagaggtccaacaggaccctcactgagctaaattcaaggtgtccacaggactgtcctcccttctgggatctccagtgggggctgtttccgggcttctccaagcttccagaggccgcctcaatcccttgcaccatggcttctccctcca

SEQ ID NO: 138916 - DNA, 116 bp, Homo sapiens
ggtggtggcagtggtaggaggcccaggttgagacatgaggggaagaacagtgtctagggcaacggtccctgaacttgtttgcacaaggtactcacccagaagcctcgaaaacacgg

SEQ ID NO: 138917 - DNA, 522 bp, Homo sapiens
accaagaaaagattttcctttttgtaatggctttgttgttttgtaaaggtgcacatactgaagcgttcacagaagttcaaagaaaagagtaaaactttgttgaaacctcggcacccagagaagtatctgaggttaatggtttgacagatgtcatgtccttccagaaagagctctgtgcagatctcacacacacctggcttcctggatagttgacgccacctgcacagggaggcatgtagctgaggagctgggatggacggctttgagtcagacctggcttccagtcccagctccaccatttttctagccagagttaaataccttgacatgaggccttgacattcagttttctcatctgcgaacagggtgtaatgataggtcctatctctggaggttggggagcaggatcagtaaggcccacaggtaccctgtgcccagcttagcgcctggctcagagaagtgggaacagctggtagctattgctcagagaagcagccttctgtcttaaggatgtgacataat

SEQ ID NO: 138918 - DNA, 551 bp, Homo sapiens
gtaactcagctgggcgtatcaggaagccctagcagctgcttctcacctttctgcccacggagtactccactgaaggaggccagtgagagatgccccagccaggcacagagcaggtgccggccaggcttgagtctttcctgttcccagaggtgcatttggccagtttaatcagtagatttaagccaacaagcctccctcaccctgtgcccggcttgatccccgtgaaatggaaagtacagccctctcccaccgtagcccgctttgagagactcagataaccgggaggaggaagcatcttcaaggacaggtggtcacccccttatttaatcagtgctgggcagctgggcagctgggcagcggcagacgcacaactagacccaggtccctgactccaggactaggcgtctgcaattgcatgggactgtaacagcctcctttctccccaaaggaaggagtggacctcccttgaatatgtcactgcaccagcatgcaaactcacacacacacacaaatgctccaatgctcacatggacactcaataccgggtaccg

SEQ ID NO: 138919 - DNA, 174 bp, Homo sapiens
cctttccctgccagacagtagcctcttagtgatcaaacattatgtcttcaaaagtcttttaggccctacccagcacccaatactgtgctgagaacatggaagatataccctagagagtaaattttgagattgggaaccattctgttttatttactgctcctccccagcaactaa

SEQ ID NO: 138920 - DNA, 326 bp, Homo sapiens
atccttttgtgatgcgcgagccctggtgggaggtgccggtggggagcccgctgactgtgtctggcactgggctcgtgggaacaccgtgcatcccgggtgggcgaggggctcgtgggaacgccgggcatcccaggtgggctcggggctcgtgggaacaccgtgcattgtgggtgagcacggcgagggcctaggtgggcaaggggctcgtggaagcgccatgcatcctgggtgagcgagggtactgggtgagactgggcggatgcaggcacagggctcgtgggatcaccgtgcacgtctctggaaggtgcccaggctggtgcacgctg

SEQ ID NO: 138921 - DNA, 477 bp, Homo sapiens
aagcacttagggttgtttagggagttgtgacatcctatgagaagtggaactagatggcagttgaggtccctttaattccagtgaatttaaatctagactgctttgtatagtaaccagacatgattaagtggtcgttcaaagtgtgatgttgtggggcaatggagcaacggtgcttatgagaatgacccctggtcagatggatctgggttgaggcacagctgcataacttaatgattgtgtgcttctgggcacgtctcctaacctttctgtgcctcagtttcttcatctgtaaaatgaggacagcaatagtacctattaaggttgtagtgagaatcaatgagataacacatatgataacacacgtggtaagtgctcagtcaatgttgctggtggttgttaaggctgttattcttattgaaggatgcagttttaaacacttgggtactcagatgaaccatctggctctatggagtcatc

SEQ ID NO: 138922 - DNA, 579 bp, Homo sapiens
gtcttttgtggccacatggacggaactggaggccattattttaagtgaaatgacttacaaacagaaagtcaaatatcacatgttctctcttataagtgggagctcaataatgtgtacacatggatgtacagagtggaataatataattggagacttggaaaggtgggagggttggagggagagggatgagaaattacttaatgggtacaatgtgcgttattcaggtaatggttacactaaaagcccaactttaccactacacaatatatccatgtaacaaaactatactagtaccctctaaaatttatattttaaacaaggttacttgcttctccttgcctgcaggtgtcccagggcaactcctttcatatcacagtaatgtcatcctctttgtctgtgcttgtcaccctcatagatacagagccatagatggctctcatatttagaaagagtttgggctacgagatcaagatgcaacagtcaagaatccagtgggtcacttaggaagagtaactgatgaaagagcaatgctagtgaggatgctgctgagactggccaggtgcactctgtgcagaacac

SEQ ID NO: 138923 - DNA, 421 bp, Homo sapiens
gcacagctcaggatacccacgctatgtaatgggagaccccacaaagttagtggagtcacagcacggctgttagaggaagggcttccagcctttccttgcactgacccttcatgattactgggcctattggtgctacaggtttttgtacagagcaaggaaagatagctactgataagctagataaaaggttggggagagggggagacaactggatagccctaaaatagtccttgccaataacatattgccaggaacagtcctgaaagagccacggaagcagtttgctgtcaaaatgccagtgcctggagaagctcttccgataccgggcctccagatccctcacctatgacccacatcaccctctctgatggtggagctgtgtgccacggggcagaggcctctccagtctaccacttggtca

SEQ ID NO: 138924 - DNA, 474 bp, Homo sapiens
taattcagtctcagataggatagattcatcagtcatttctattttgattccttgacatattaaatggatcttgggtgttttctgttactgggaagctttggacaaatttcaattaagatatctgcagacttacaatctcctagagatgtttatcttaaatattattgagacagaattttattaatgaaaaaaattgtttactaaaagtaaactgagataaagtaaaaaaacaaaaggaaatcccaataggattttagctttctgaggttcaactatttgtgcttcaggtcatatgtgaaacgataacaaggtaaatattctaataatgacactatttgtcaagaacctgtcagttttcatgggtgagtgtttatgcatctttgtcatttatcctaatattcttatttttccttgagagagatattataatccaaccaagtaacagatgaaggaaactgttccctttcatgttgc

SEQ ID NO: 138925 - DNA, 562 bp, Homo sapiens
agggtgtgaatggagaccgactgagaagagacatgaggcaactccaaagtgatgcttatagtctgtaccctgctgcaggctgcgtacaaacgtgaatgaaggcttctatcaaaagtcactgatgggtgctcacttcagtagcacatacactaaaatcggaacaatgcacagacgattagcatggcctctgtgcaaggatgatgcacacattcgtgaagcagtcattaaatttttttttaaaaagtcactgactggtaccctcaagattgtacatttcactgtatgtaaacttcaccgaaaaacccaaccaacctataaacaaatactgaattctaagtgttcagaggtgaagtatatcgatatttgtaacttgcctcaaagaattcaggcaaactgggtggacagaaggatggacagatatatagatacataatagagcaaatacaattaaaagttaattgtaggatctaagtagtgggtatacgggtgttcactgtacaattctccaaattttctatatgcctcaatatattcttaataaaatgttgggaaaaatgcctga

SEQ ID NO: 138926 - DNA, 443 bp, Homo sapiens
gtcatgaggcacctttgatctgggagagcttccgcctctgcagcaaggagctctgagaagtgatgttgaagggtgatccttaacccaggtggctgctgacgtggccacacagaggctctgagactccagaagaaggatgcgttagggcctggggtagaggtagtcatctccactgagatgccccatgccaagggtggggggctggaatctcccaccttggaaagtctacaccagagaagtctctggtcccagggacagggtctacagtggagtctcccgcttgagactcaggtatcttacatccacacagccaggaaactatgccttaccccatacagtgacaaatcaagagggggttttggaagcatgagccgggggcacctgcatccgagaggggtcctcagccttacggtggggacacatgcagaggcgtggacacctca

SEQ ID NO: 138927 - DNA, 354 bp, Homo sapiens
gggggaactggtccccagggaggaacaactgctggagaactcactaaagaaaataacgggagcagctaggcgcagtggctcacacctgtaatcccagcactttgggaggccgaggtaggtggatcatctgaggtcaggagtttgagatgagcctggctaatgtggtgaaaattttgtacttttgtactaaaaatgcaaaaattagctgggtgtggtggcggcgtctctaatcccagctactagggaggctgaggcaggagaatcgcttgaacccgggaggcagaggttgcagtgagccgagattgcaccactgcactctagcctaggtgacaagaacaaaactcggtctcaaaa

SEQ ID NO: 138928 - DNA, 361 bp, Homo sapiens
gacactgcctggcatgatcaatagtggttgaatgaatgaatgcttttctaccttgagctcaagctattcatttcacctcattccccgttgctctctggctgttttcagaagcctgccaactgttcaagggccagcttaaatgtcttgtctataagccccataattgaatatgacaatcccatcttttgcttctctcgctcttttgtttctacctctgtttggcactttccacactctaccccatggtaagatatttgtgtgtctgttttaaccccagcattgaaacaccctgtatagggcagggaccatggctttctgttctcattttatgtcatttctcctcccttccaccccgctacac

SEQ ID NO: 138929 - DNA, 742 bp, Homo sapiens
gaatgatatctttaaaaatgtccatgattcattgttaaggggaaaatacactacaaaatattagtagcctaatatttgtgtgtgcctatgtgtatgtgtgtgtgtttatgagtgtgtgtgtgtctgtgtgtgtgtgtaggcacatgcacacagctttaaaggaacgactgtatgcccatatattaactgtggccatttctgggtagtggggttaaaggtgatgttttctttctcttccatgttctctgttttctgaataatgcactataaatgcatattgcttttaaaatcagagaacacgtcttgacatggatgtctcacagacatctcaaattcaaatgagcccttttctcaccttaaatcatcaccaatatttccttctctcaatagatagcaaaataaccagttgctgaattcagaaacttgggagtcagcttgactctttcctccctctctcccctcatatgcaattaattacttagctttatcaatgcatttcccttaacatctcttcaatctgtttccttctttctatcaccacagccactaatgcattccagatcaccattatctcttgcttgcttcttgtttcctggaaacctccttgcattccttctagctctcttccaactccttccccagtctgtagtcagaatgattcttctaaaatgcaaatctcattgaattaaggttctccagagaaacagaaccaataggatctatatgtctatatctagctagc

SEQ ID NO: 138930 - DNA, 323 bp, Homo sapiens
ttttctatcatagaggtggcgattgccttctcatcgcctgcaccctgaggctgatgggtgggagaggtctcaccatcctactttcccctggtcctccagtgtaccttctgcacttcttaaaggtgaccctgacgtcctccttggcttgaagcaagggtagctaatgagagaaggcagaaccaccgtggtcggaggccgtgggagaagcagttaccctctcattcttgaactcagctccgctcgcctgctctctgaaatacacactcaacctgctctttgcagaagtgtcaagtctttggcctccttaagaaaggaagcatata

SEQ ID NO: 138931 - DNA, 441 bp, Homo sapiens
ataaccattcccagggacatactgccgttaggatagggggcacagtggtggttctttcccagctaccccactcctcgtcctccctgcacaccagatccttggggaggtgggcaaatgcgatgccacagccttcagctgtcattgattacctcacaaggagcgctgtgaacatctgggaacatgagcctgcctggcaaaatagtcttctgccttccacacccctcttgaattgagcgttgtcactcttgaaaatgtgcccagatcttaggaacctcacagagggcttaattaaaggcaatggagagatcacacaatcaggacagtattgttcctcatccacctgcggttctaggccttcaaagtcttcatctcatccaatttctttctcaactcatttgacttattacaataaagaaaccactcatcaggtcaaagaatgta

SEQ ID NO: 138932 - DNA, 595 bp, Homo sapiens
ctatacacagtccttgttccagacccaactctttactgttccccagatacttctcttctttttaaaagggtttaaccaactattttaacagaaaagttgagaatatagtacatggaagtcccatatcccaccttattattatcatcttctatgaacatggtactttttatttacaacgaatgaactaatattgatacattattattaaagtccatactttatccagatttcttcagtttttacctaatggcctttttctttgttaaaatatatttaattgatttgtaacaattatacatatgttggggtacatacgtagtggtacatgcatacaatttgtaataatcaaatcaggataattaagatatccatcaccacaaatatttctcatcctattgtgttagaaacattacagttcttctcttctagctattttgaaatatacaataaattactgttaactataatttccctactgcgctatccaatgttagaacttagtccttctatctaactgtatttttgttcccttttgaccagcttctgttcatctcctgaccctctcccctttccagcctctggtaaccaccattct

SEQ ID NO: 138933 - DNA, 637 bp, Homo sapiens
ctgcactccagcctggcgacacagcgagactccgtctcaaataaataaataaagaaagaaagaaaagaaaaactgtgtgtgtctatttgtagaaagaaaaagatctcttcattaatcccatcagccatttattgagttcctactatagtccaggcacaggtgctaaggatacaaagatgaataaaacccaggaccttccctggagggacttgcaatgcagaagcaaggaaagactaggtaagctgagtgatagaagttaatcagggtacatttagaaggctccaaataggagtaatggtactacctgggcaagggatcaggaaaggtttcatccaggaagagaccttccacctaaccaagactagatgaagactttaaaggttctaaactctgaaaagattgtggtgtcccatttttcatatgtaatcagaatgaaaatattaagccatgaaacatttaaagttcaacatgattatacttaaaacatatattgtatatagattaactatcaaattctgtttctaattttttcttttatttttcagttccccagttttgctggtgtctaagcactggcgtggggtgtcccttgagtaatgcagcactaatgactctatccattcttccatgagcagtg

SEQ ID NO: 138934 - DNA, 462 bp, Homo sapiens
tggtggggcttggttggcttactgtacagagcctttcttgacccctgaagaaagagatccgtctgcagtgggcaaaagcctgcctggacttcctggccaccagaaatatgagcatggtggtggtccccagttccctattcatgcttgggctcaagagactgggagtctaggttcactgactccctgagaaagactaagaccctgcattttagaaagaggtttggggatctctgccctgcgcaagggtagaaggatcagctgttcctctgagcaccttaacccggaaccccggtccgaagccgagacaggagactggatgcgaggccctcccagagctggtttctctcaaacaacttccaaaactcctagatcctaggggtacgccgaaatcccccaaagcagtccaaagaacacaacgagagtcctaacatcccaggtggcggcgcgctggctccctggagc

SEQ ID NO: 138935 - DNA, 358 bp, Homo sapiens
agctagaacaggggcaaggacagagttctacagcatgtcaatagaggcttccctcttggcttacaacagtccattcatcaccacttcttgttcagctagttacatatctgtcttcagaccatgtttctgttctttatccatggagacacaaaagacttgactatgtgactccaaaaagttagaggtgtgaggcagcaagaaggaatgggtgggacattgactctagagtcctacagacctgtaatagaaacctgtctcctcctactcttgactatgtgactatggcaaatagttaaacttctctggacttcagttttttcttctataaaatgaggagaatgatatctaccttgctggg

SEQ ID NO: 138936 - DNA, 477 bp, Homo sapiens
tgttgcataagcgggtctgcgtctgagctcaggcaatccacccacctcggcctcccaaagtgctgagattacaggtgtgagccaccgtgcccggtctgacctgtgcctttcaccttctctgcacacctgtggtgccctttctacatggggcctcaactccagaccccgcaaacaacaactaacatgaggacaactgctgggaagaggctgaagcaattgcagcatgatcacacaaggttgggatagatttctttcccatctctcatacacaccccttgcaaaaaaataggtgggcagaaaagtctggggctaagcttgccctgtttcatcaatgtacagttggcattactgaacagactagaacaatgtgtcaatgtaaaaacatttatatctggcttaaatgacaacagtttatctgccctccctccccaaaatacaaagcagtacctatcttacctctgatgtaattaaagtgtc

SEQ ID NO: 138937 - DNA, 269 bp, Homo sapiens
ccagctactcgggaggctgaggcaggagaatggtgtgaacccgggaggcagagcttgcagtgagctgagtgcgccactgcactccagcctgggcgacagagcgagactccgtctcaaaacaacaacaacaaaaaagaaagttcagaggattagaggtaatgataatttttttccttaaagagaaacttatcggtaaagctgagttatgggctttgtcagatgtaattactttttggacgtttagtttttgactttttttttttattttt

SEQ ID NO: 138938 - DNA, 327 bp, Homo sapiens
ccctaggagtcgaccatgcggacatgctgggcttgtgaccctggccgtcaggtatgacgacgccggtggcgtgtgcctaccctgtcgtaaaactgaaatttagatagtcacgaagatactagccctatagcacttaggtgtgagctgcacgcattttaaatctgaaacaatacttgcagattttccacagcctccatacacagtggtggccattatcatttccacagcttccatacacagtggtggccattatctctaagctaataagattcagaaatttcctgtttcatattcataaatgtgtatctcacttagcaaaatgaatgt

SEQ ID NO: 138939 - DNA, 346 bp, Homo sapiens
ttttgaggccaacaatgctctggtaccaaaaccaaaaaaaaaaaaaaaattctaaaataataagaactacagaccaatgtaatctggtaaagacagacaaaaaggcctttgcaaaattttagcataaaaaatgcaaaatatataaaaaaggacaatgaccaaaatggggtctatcccagtaaaacactttgtttaaccttcaaatcagtgattcatcatctttacaaaggagaaaaatatataatcaccaatacattagtaaaaagcatgacacaaacataaaccctcatgccaataaaacccacaaaaaaattcttagcaaacttagaagagaatagccttaatc

SEQ ID NO: 138940 - DNA, 288 bp, Homo sapiens
cttctctttttcccacccctacctttgggccctccttccttaacctccgctggccccccattccatgatccgtccacctgacacgctgggtttcatgcctctctttcccaggctgtgggttgtgcccttcactccttgccctcctccattccctgtcctgatctgaactcctctccttgccacgctccctcacccttatccctctgcacactccaaaatttttaaagaaaaaggagagagagaaaaaaaagtaaaagaaacccaaaagggaaaatatagctaaggtga

SEQ ID NO: 138941 - DNA, 351 bp, Homo sapiens
ccacttgggtacaaaggcactcattgtgaactgtggtggcaggggcctcaggcctgtgccccacctgcctgtgtggtgttgcccacaggaatgctggtggacttggctcatgtgcctgcgctcctggccataatgatgtgggatcccccacagctcagcgccaaccacagcctcttctcggtttacaaatccccttcccaccaaaaaagaagggctggggaagcagcccttgacagggagatcacaggctcaagtttccagtgcccacccagcctttctgaactgtggtgccttaagcaaatcaggttacctctcaatgtatccttttgctcatccatacagtcgggtcaa

SEQ ID NO: 138942 - DNA, 125 bp, Homo sapiens
tatcttttcatgtgctaatggccatctgtttatattttttttgagaaacatctatctaaatccccatttaaattattatatttttaaactattgagttatttatatattctggacacaagtatgt

SEQ ID NO: 138943 - DNA, 275 bp, Homo sapiens
cctgctgttaaagaggttacaattgaatagtgaggaaaggcaagaacacacatctaataaaatatcagtcaaatatattgattatcctagaagaggacaataggggttatgggaaccttaaatctcatcaaacagaaagatgaagaaagtcttcatgagattagagatgtgtgagaagcaattgaaaaaaatgagcaagttttttgccatgtgaaggtagaagggaaggcgctccaggttagaaaataacatgagcacaaaagtgggaacttcag

SEQ ID NO: 138944 - DNA, 355 bp, Homo sapiens
tcacaataccagtttgtataccgttccttcatctccttccacgtcaagaaactccctcatggtcaaaacgcaaacccagtgaaaagttcagagatcaaccattttactttgggcctggtggtttatgcggaagagctaacctccttcctttttcccatccacctgagaactacaacttcccttctggagccctgaagccgcgtgataatgtagcctttctctacctcagtggctgtaatgcacaccttggaaatcactgggatttacccaggcagactgaagttgtctttggttgctgtttatttatatggactgtgatctcttaattggagatggtgcctctcccagggttcgc

SEQ ID NO: 138945 - DNA, 168 bp, Homo sapiens
agatgagctgcatgtatcaagatcaggtgctgagtatggctcaggcctccaccacatgccagcttgacacaatcttatttgaatctcatattggttttacaattccatatttgacctctcaccaactccctgccaaggatgtagcatggttcaattagactgcttttt

SEQ ID NO: 138946 - DNA, 315 bp, Homo sapiens
ctagcaaccaagtcactattcctagtagaatgggctatcatgccttttctttcaggaaacatcatgtagagtttaaagcgagtttaaaggtccaaacatctatattctcttatccagtctgtcagttgtgtttattagtcatgaactgtgtctctaggcttttgcattaactgccccccttcctcaaatatcttttggcttctctagtacttctttacttcctttccctaagagactgggttaaataccctttaagtgtgctacattattctgttattgcctgcatttcaggcttgctttctcactagatgcaat

SEQ ID NO: 138947 - DNA, 256 bp, Homo sapiens
ctggctctcttcccctaccctttcagcctcttggtaagaccacaaatggtctacagttccctgaaaccagtgagcctttttctctgctcaaaatgaaactctattgttgacatacactttcctttgaacttctatgattgtcacatttggctacctttgatagcaacaggagacagacaaatttctaggcagatagggatgagtccctggtgaaacccaaccttcaagccaaggacagtttaaagcctgaaaacca

SEQ ID NO: 138948 - DNA, 532 bp, Homo sapiens
ggaatccagctaagaacaacctcataaccagtctccagaggtccgtccaggagacggcgtggccagtggtgggcgccctgggctgtatgtccccatctgtgtctgcctttgtgccactcatttacaccagcaattgcaggagactgggaccccctctcttcaaaattactacccctctttatgtagaggcacactgcctaaaaaaacaagttggaaaattttccaaatagctttgactcaataattatccgacagcatgtggactatctcttgggtcttttataccatcaaaccaaattggcagcatgaatcttataatcctatttacacatgttttgggttaggaaggagtggtacagattttgttctaaacagcatccattagttactacttgtacaatacattctatatgcgggccctgtgataaatgtcaaggctacaaagaatgtggctcttgccctccaggactacaaattcattgtggaagactgggaaataaagcaatgacagttgggtgcaatcaatgcttta

SEQ ID NO: 138949 - DNA, 633 bp, Homo sapiens
ggagacgacacagagagcacaggttggagcacaggtgggtcgctaggcatatccagggtcctgggctgatacagtatctaaaacagaaaacatccagtgcttacggggtactggctctttcctcagactccacatttgagatgcagaggaactaaaactccatctttgtgtatgtagcaagttttcccctttcagctttgaaaatgaaagtttgttttaggtcaggttcagcctggggaaatgagaaaatcacccactgggatgagcccttcccccttcaacactgtaaatagctttttccacttggcgcggtctcctcgccacggtaataaggagctcttgctggctgctccgacccgtgcgacagccaggccttcaggaggtctggtgtccctgcactttgtggtctctgagcagtccagctctgcctgccatcagtttgggcacttgacatttcaggaaatcctgagcccagattgcaggccctctttttccgtgatgatacccactacattgaaatgatggatctgtgatagcaacaggagcgatgatatacatctttgtatatccctgccctccccagaccccaagtcctatataaaaacttcacttcctgggcttcctttaccccac

SEQ ID NO: 138950 - DNA, 427 bp, Homo sapiens
gcgcacacctgtaccgggtcacagtcacgatcacacattaaccacagccacacacacagatagaaacatgcagttactcgcaggtatccccacctgaactctgccgcacacagtcacacagcatatagtcgcacaccactacggggacaaacgcagtaacactcaaccaggcacaagctccccacagccgcacacacaatgccgcacgtggtcctgctccctctcacacacacaccagcagccacagtctccgaggccgtgctgcacacggtgtgagcgttggaaacacactcatcacaagggcagcctgtcacaatcgcgcgatcattcaccacacacctccacacagacgcaagcgcacgctttcaatctcacctccaccgccgcacaaagccgaggcttggcccccggccccgccctctcccgg

SEQ ID NO: 138951 - DNA, 467 bp, Homo sapiens
ttaatattttactctatattatgaaagttctaagctgggaaatagtaagcagcttttctaaatggtttagatcacataccctttcccatccgtggagtgcccctcccatgaagttctatggaagtactttttaggggactttccgaaaccttgagtaggtccttcttgtggtctggtgccagctttctcctcagtcctcaactgtctgttgctatattttctcaactaccaggtttcctagctttaccctctttcttctttcttctaaattataagctgctgtcagatttatatttctaaaccttggctctgaacactttaccctgctgctcgtgagtgaacctgaatttccttccctcttcgtattaaagtaattccagatgagccaaaggcttaagtggtgtaaaaaaagaaaagaatataaaatcagtggaagaaaacatagctgaattaatttaaaattttgt

SEQ ID NO: 138952 - DNA, 467 bp, Homo sapiens
ctcccaaagtgctgggattacaggcgcgagccactacacccaactacttgtatttatttactgctcctccctgcctcctacaaacagaccccaggtctgttttcttaaatgctaaactacatgaatccttaaaatgctaaactgctaaggtcctccagcctcagtgttcttttcagaaacatggggctaagaaccacacttcagtgggtagctttgttcctgccatcttctttctcatccccatatcactgtgcggcttttgctctgcaacgacccttggtcttacctctgcccagcaggtgataagatctgggaacagagaggaaacagaggggaaacagagaggggaggtcatctccccgggctcacacagccagtgagtggccagacagggcctgaggcaagtctcccaatctgagcacttactggcagaggtgattcttcatctgtgcaacgggtacagcatc

SEQ ID NO: 138953 - DNA, 401 bp, Homo sapiens
  misc_feature (53)..(53): n is a, c, g, or t
taagacggcagtgcagctgcatagctgcggtcgactctaaggtatccccccgngcaaatagtgaaaccccatctctactaaaaatacaaaacaattagccgggcgtggtggcaggcgcctgtaatcccagctactcgggaggctgagacaggagaatagcttgaacccaggaagtggaggttgtggtgagctgagatcgtgccactgcactccagcctgggtgatagagtgaaactcggtgtcaaaaaaaaaggatagaattttcacacctatgttcctagcagcaagtccatagtgagccaaagggccagaaccacccaagtgttcatccagggatgaatggataagcaaaatatggcacgtagacacaatggaacattacttagacttaaaaaggcagg

SEQ ID NO: 138954 - DNA, 315 bp, Homo sapiens
gtcctctttccctcctgtcacctgcagtggcattcttcttccagcctgtgggatgttgctttatgctggacagagctggattctgtcttggctctgctggtgctgaaagttccccaggcccaggaccaccatccacacacctccgatatctggtgaagcaccaggcatcgtaggcattgctgagtatttgggtgactgacttctgagcatgaaggcagggagggtcccctctgtctggatggtaccccacccttcgcccctaggcaccttggccagaccctcctcattcttcaagattcagcagcccttgccttc

SEQ ID NO: 138955 - DNA, 218 bp, Homo sapiens
aagagagaaagaaaaaaagatttctagaccctgagacaaactcatacatctgtccataaatctgctcatttcattttatagaaacaaagaaatatgcttagtgggtagatttaaatactcagacaattaaagtatacgatactttgcatggcaacaattagtggtgagaagagtagggagaggtcctgattctgcattccccaagagcctgatctgat

SEQ ID NO: 138956 - DNA, 428 bp, Homo sapiens
gcgacctagaggaccccaagtagtcgggatcgcctttacaccgaaatgatactgaccacttcatcactgtatttcaatcattaattccctcagtcatacccaagaactggcttagaaacttctctccccaaaatcttacatgcacttattttactttctcacatttttttctaaccagttcctgcatagactcatgtccactctaccagccctccaacctcagagactccagacccatctctccttactagtctagtctattggctgtcttttggtatcttatttttttttctccttccctacaagcttaaattcatgactgatcattcaaaacagcataagcaccttttagattcctgatgtacatataattttatctcagcccagcaaatcccaaccccaaagcaatgccaaagtgtatttgttcc

SEQ ID NO: 138957 - DNA, 226 bp, Homo sapiens
gtgggtacacagtacgtgtatatatttctggagtaggtgagaaactttgatacaggcaggcacttatatttgtaaaaattaaatgccaatgttaaaataatcaattgcattttcaattttagactctaagaaatttttgtagacaagctataactgaataaatgtatatttgagaaaattaagttaatgtctggcagaccattaatactcaagtctatatttaatg

SEQ ID NO: 138958 - DNA, 453 bp, Homo sapiens
acattacatacatgtctgatgacatgcactagactaagtggaagtccttctttggctatgaaatttcagtagtctctgactttctttaatgacgtgacatgactgacttcccatttctcctcttaccattattttcaactcaaatccagcttttatgcctctatgtcctccaggtaagagagactgaaaatcagtaggtcttgacaactgattaaatgtgaacattgagagaaagaccaaagatgtctttaggatagatgtctttagccaggcgtggtggcgcacggggatgcatgttttcaaacctgcctgattctctgaacctcctgggacatttgttaaatatgcaaattcacaggttccactctagacccacgaatcaatctccagaggtgggcctggttgggcatttttatcaagtttctaagtgattcttgtcatcagacaatgtat

SEQ ID NO: 138959 - DNA, 331 bp, Homo sapiens
caaaaaacaaacctgcccagtaattctctcttggcaataagaaaatgtcccagcttcttactgctgaatatcagcttcttcatggcatggcttgtagctacttctgcagactcatttttcaccagtcgctctcacatcctaatgctctaggcacacttgaggctcttaccagaaacacgcaggaactgctcccatgctttactcgggagtgtcgtccacctggaatacctccttcccttcttcctctgctatctcctgctcatccttcaaaacctagctcagatgttacctcttttgagaagccttctctacctgccccaggagaataagc

SEQ ID NO: 138960 - DNA, 372 bp, Homo sapiens
atagctgttcctgagtgtacaccaacgtctataagctgagaaattatgcctgctgaagatataaatagactcaagaagtagttggagacatttagacatgagagagccctaatgaactcataaggggacataggcagtaaattgctaaagttttctgggttcaaggaagtaatagccatgctcaatgaaggccattgccatgttgatgccattggcagaaattaccactgccctcagtgtacctatcttgtaggctgctgtgatatttcctgccctcctctgatccaccttgagtcttccaattcttccctatgtctctactacatgcagtttctggtttacttcttggattaccagaacattcttcttgcc

SEQ ID NO: 138961 - DNA, 258 bp, Homo sapiens
agttcgacggagactactctttttctcttaatcaacttcactttgattaaaaatgttttgttttgttgtgcttatttcttatgatgttctttcagtctgaggactcattgctatgtagtggtgaattctttgctatttttatttaattattgctctccctcccctttattttctaattctggaacttctagctatgtgttagaacttttaggtctagcttttgtaaaataaaggggagggagagtctccgtcgaactg

SEQ ID NO: 138962 - DNA, 295 bp, Homo sapiens
gttttgagatacaagacatctgaaattatatgaaagaaaaatgaaaggcttggatgacagcattgcatattgcagaccattaatatcaataatatttagggagctcctacttatcaataagaaaaaataatctcattgaaaatgagcagtgaaataagttcacatgtgaacaaatgtctgaaaagatgcttggctttgctaataattagaaaaatgctaattgaaaaattagatatttatttgtgctattgagattatcaaacattaaggcaattaagaacctcctctgttgaga

SEQ ID NO: 138963 - DNA, 509 bp, Homo sapiens
tcattacccaattgttcatttgagaaacaaactccacatgtatcagcaatgtgctcatttcctaaacaagcctattggctgcattactagatatagaatgaaatattttgattctaggtgccccattttaagaaagattgatattgacactgtccagggacatgtagtcagaacatgtaaggatctccagatttttgtgtcctgaaggttttcaaagacttggaggagagggcaatggtttgtagggtacagaatactcttattctgtgtggttcccaaagagagaactagaaccaatgatggagttttaggatgatttctctcacaatgcaggatatttaatcagcaattagagactttcataaatcaaacataagccagatgacatctatgaagaatattgtaaatattttttgcttagcatgggagattggtctgggtagtctctgcggcctcttttttaaatctggaattttgtatcatgaatgtcaaatgaatatttctttttc

SEQ ID NO: 138964 - DNA, 431 bp, Homo sapiens
gctctgtgtactcttgtccaaatgtaaaaatgctgcagcataaacaaataattcatggcataaaatacaatacaataaaatgaaaataactcattagttaagttcagcaaaacagagaagtaaaagatagagaaaggaagaaaactaagtgcccttgctggtgttagctggcaatgtcttttgtcttgaaagttctgggtgaatgtttttgggtttttggagagaatgtactcccactgaaatgagtaatccattgtgtctagcatcatactgggatttggaatgccattgtgttttagtatgaagtgcttgacaatgcattcacacccagaggtcagtttcaaaactgccctttagtttaaccctatagttgtgatttagtagaaggattcgaataactgcataatttgtttaccacacattattctgct

SEQ ID NO: 138965 - DNA, 984 bp, Homo sapiens
ctcatctccccttcccttgccagctgcctggctccatagagcaggaggtgtgtggcaaggacaggggcagttttccagcttccacctatccacgcctgggggagtttttggactgtcctgataattaattccagaggcagttttcagtcctgggtgggcggaggacatctcactaggcaggatcttcagcagaaagtgattctccatccgtcaactcatgcaggaagatgaagaaagcccagataatctccaacttgcattcgtttaggttttggtataccacccacctcactgtcagctgcagggcttggggctctgcctagaatcagaaatttgagccaaactgggaccctcagatggcagtgagccatcccatcagataactcccaagaggaagccaactcaaatatgaattttattattctggactatgaccctgatcagagttctcccaccccgaaaacctctgatagtctggtttgaaccagagtcaaataaaacagacaagatttttttttcctctgcacaaaagcaaaaaaacaaaacaaaaaaaagtctgccagtagtttcctgggtttgatgcccagataagcaaacactgttgcctatggctgttgctgttttcatcaagaaagaggttatatagtttgcatttccatccactctccctgattttatcttaacctagaatttctcctgaactaccccaaatgccaacttgaatttgggtagggctctgttaatcgagggaaccctcatcttcacttataaacctaattctctgttcctccctccaaagatcctgaaaagatctcctaaaggctggccaggatggggtggagtggggcagtgcacctgaagaaaaaaacttagctgccagctggctgtatgcaagttctccgaaaatttctattgtatgaaagggatggggtcaattgcagctcaaattaaggaagccctcctaacaggctgggttgtctgacc

SEQ ID NO: 138966 - DNA, 300 bp, Homo sapiens
cctggaagtcgcaagtactctcccctacttcccttaaactcacttgtatttctgaagaacagtaataaccctcatcttcacttataaacctaattctctgttcctccctccaaagatcctgaaaagatctcctaaaggctggccaggatggggtggagtggggcagtgcacctgaagaaaaaaacttagctgccagctggctgtatgcaagttctccgaaaatttctattgtatgaaagggatggggtcaattgcagctcaaattaaggaagccctcctaacaggctgggttgtctgacc

SEQ ID NO: 138967 - DNA, 250 bp, Homo sapiens
ctatgattgccagaaagctcagaaggctacatgaatattatccctaatacctgccaccccactcttaatcagtggtggcgttctggtaaaaagctggaagatgggcctaaattcttgaaggattcagtggtggcatgccaagggccactcatgctcacctggcaggcagctctgccctgcagcatgggtcatttgatggtggtgactctgccttttaaaaacaagggctcagctgggcacggtaactcac

SEQ ID NO: 138968 - DNA, 415 bp, Homo sapiens
accatgattatttgttgagggaatggagaaatactgtacatacacatatgttgtcaggtttatcattccagccctgggtttagtacagcatatgcataacacacactacacctaaataattagtttggtgaataagtaaatgttaaacattttagtctaagagccaaagaagctctattaaatagaaggctacaagacaactttaaaaaaagatatatatttccactgccttgaagtttccttctaaatctgactctttggtttacaaagttagggttttttgtttttcagagagaatctcattctgtctcccaggctggagtgcatctggtatgaacacagctcacagcagtgtcaaccttcttggctcaagtgatgctcctgcctcaggcctctgagtagctgggactacagg

SEQ ID NO: 138969 - DNA, 971 bp, Homo sapiens
ccagggaaagccatcctcacactccctggatccagggaacccacgcccaggtccccccagcttgttccctcagtgcccagctcttggctatttctttcacttcattccatcgcccagacaccattaccacatacacattccatccatacccccaggtctcagcctgccctaccttcccaggctccagtccctgttcctcagcatcccccaccacatcctgagtaagctttgtccccagataacctcttcagcatgatccttaaatctccctaagcctcagtttctcccctgtggaatgggggtaagaatctctttctctgaatgcccctgtgttaggaaataatttagaatacttcggaaacaaaaagctctgttcacacctaagcaatcagggcagtggccctggccttgccaggaacttaggcttttatctggatcctctttccaggcctctcaattaattccccaggtccttaacctttgggaaattagaaattaggaagagtgtcccacttctgacactgtgttccctcttggaacctgaccgtcaatgctagaagaacccttggaaaacatgctggcccagccctctagttttacaaataagggagtgcacagccctgagaggttacatggcctgcccaagatcacgcagtcaatggcagagtaaagagcatagcctaggcctccccactcctctagtaatgctctttcatcttctccaacctggctctaagccttgtccatcctgagccccatatctagcccaacctagtccctgaaaacaagaagtggcccttagaaatctctctccagtcccactatcagaggccaactgctgtcttccagtctccttcagcctgtgctcctctccctccctgactgacaggcagaaggtaccgtgcctctggatatccccacagtgccctgagctgcatctcttgccgactgctttaatacatcacagtgac

SEQ ID NO: 138970 - DNA, 422 bp, Homo sapiens
ttttgttatcttgtcaaagaaccaacttatttactttattctgctagctttgggtttactctgctccttttttcctagctcttatgggtatgatgttaggttattgattcaggcatgtgatttttttttttttctattttaatgtaggcatttatatctagaaattttactctgagaactgctttcactgcatcccctaggttttgggatattttgttttcattttcagtcatctctaagtattttgtaattttccttgtgatttattctttgatccattggtttaacagtgtgttaattttcatgtatttgtgagttttctagttttccttctgatattgatttctagtttcattcaattgtggtcagagagaacgtactttatatgactgcagccatttgaaatttattgagacttttca

SEQ ID NO: 138971 - DNA, 592 bp, Homo sapiens
ttctcccattccagaggaggaggtgttgaaggatttgttgttcacttagatcattaatgagggtctggaacagtcatctgaagtttgggggaaacgtcacgtctcctatgatgcgcctggctttagggaataatccttgtatccattttgggaacctgctctgggattccagatctgtggttttctgagcacgtctgtgtggaagctgctgcactgagacctatttagccaattattgagaagatgaggtccctttcgtgagtctgcacggagccgccgtacaccatgaaagcgctcacttgtttaaagtttgctctaactttgtacattttttcctttttagttttggctcttggtgctctgagagctaccacttcctgccagctggttcgttaccgcagggaaaatgagggacttttgggggcagatgtgtttccattccactatcataatgcccctaaaaatccttattgctcttgcagtattcctcgggggtccctgggccagaaagacatcagctcggagttcctccagcaactcaaagaagagagaaagctgttccccaaactcttccgctgtagcgccttctggg

SEQ ID NO: 138972 - DNA, 182 bp, Homo sapiens
agaagctgctctgcctcccattccatcttccataccaaccacgatgcactgactcctggcccaatcccatcaagcaggcttccagaagtatggagagagtcggcagcaactctctgcactgttcaatatgacttggaaagttaaattaaataacacaaaaaatgcagttcctccattacagt

SEQ ID NO: 138973 - DNA, 258 bp, Homo sapiens
ccagttaatctgtattgtgctttgtcatgtattgttactaaacagctcaagatcaaggggaagaaatgtatatgaggctcagttcatgttcagtttttttttttcagcattgcaacattgccactcatcatcatgagtgtagccctgtgtcaggtactgaaggtaatggaaaaggtatataaggttgatccctgtactcttgttgggaacttgagtggtatgaatagagaaggtgagttcttggggacagaggctaca

SEQ ID NO: 138974 - DNA, 385 bp, Homo sapiens
gctccctgacgccttctcccctgccttcatcttgtgctctttattggagaaaagtgtgaggtgaacgcacagaaaggtgctccccactgtggcaggttgaacgtttgtttttgttaattaatgtccatgcattctgctctttcagtaactagatttaggtaacctgggcctgtttcccatcacttcctggccttgtgactgggcaaataactttgtctccctgggcctcagtttccttaaccctgaaatgaaggggttagattccagcgctttgcattctctggccagctcttgagcacctgcgactccttcctgctcttcagttcttcctccatcctggctgacttttgcttggctcccgctgcccccattggcccccttaact

SEQ ID NO: 138975 - DNA, 499 bp, Homo sapiens
  misc_feature (499)..(499): n is a, c, g, or t
aaagagcacaggagagggaaccttctggagtgatataaatatcctgttttcatctgggtagtatttacaaaggcacatacatatttatatatatagaaaaactcatctgagtcatattccatcttaccacttccaactgccttacctccattaagttatttaacctatctaaacctatttttttttccagtacaagatgggaataatgactttgacacaggatatgaagattataaaacactcaataaatgatgatgatgatgatgataatgatgatgatgatgatgatgatctggtttcttatttgcttcaaataaggaacacagtggaataatgtatgagctcggtacggtggctcatgcctgtaatcccaacactttggaaggccaacgcagagggatcccttgaggccaggaattcaagacatcctcccaactggacctcccaaaatgctagcattacaggtgtgagcccacatgcctcagacaagactcagccn

SEQ ID NO: 138976 - DNA, 460 bp, Homo sapiens
aacctggcaagggagtgggcaccagaatctcaagggagcagagccagctgctgcacggccttaagctcagaaacctcagaaccagactctgccaccactcatgcacccacctagcgtttcattcttttgctcctcaaatatttactaaggtccagtggttggcaagggccaggcctgcatggcgtgcaggagaggccaggccctgccatcatggaagctgcgtgctggtcgggccagacacgctgagggagggaagggtgtgtggtgcagggcgccaggcagacctgctttaatccaggtggagtggggagggcctctgctgacactcatccaagctggggcccgactgagggtctgtgaatactccaggcagaggcccagaagtgggaccagtctagcttttttggggaactgaaagggcattgtgactagggtgttatgaggggcagacacggtcaca

SEQ ID NO: 138977 - DNA, 377 bp, Homo sapiens
  misc_feature (18)..(18): n is a, c, g, or t
attttttggcattcggcnttctttttactcactcaacattaaattgctgagatttggccaatcactgaagagttttaatcaggaagtgacacaattggaatttaattttgaaaaggccacactgtacttgccacgtgcagtacggactacagtggggccacggtggaagtaggattattcagattactggtgaactagaaaatgtaagttagggtagtgagtttcaaattaatcttgaatcaagcctaaatacataagatctttaatgtagtcttatttactatagaaaacataaggctaaaataattctttcacagattctagtcaactcccagcaggtcccaccgtgaggctcatccctagatggcattctgtaa

SEQ ID NO: 138978 - DNA, 239 bp, Homo sapiens
aaaagttttacttcactaataatcattgtagttaaaattaaaataatgagacactattgttctcatacaaattgtcaaattttcaaatttgccaatgatggcaaaaacactttgaaataggaaatatgccacttaatattagaaaagcaaaacttggaggtgaaatcccaagtttcaaaattatttaatgaccattgacccagtaagtcctaagattccattctagggactatgtatag

SEQ ID NO: 138979 - DNA, 352 bp, Homo sapiens
taggacaatgcagtatgggcattgctctgataaagtagagagtgtgtggaaacatgaagaaggatccccagtccagcctggtagtggtattcagagaaaactgtgaggaaagtggtactaagcagagaactgaactggccatggtggaaaagatggtgcttgtatttcattttattcatttgggactgtctgttgtttgctgtgaccttctaaaggcgtattttgctttgccatatacaaaaatttctttacctataaataggacaaatattctttcaagtgttgttaagaattttagcattgtgtacaatgggggcattctaagcaacctacataaatattttattggtag

SEQ ID NO: 138980 - DNA, 283 bp, Homo sapiens
  misc_feature (66)..(66): n is a, c, g, or t
gagtgctgattcatttatgctgtatatagttgaattatatataattaccttcttctggccaccccngctcccatcttagtattttgcaagatctaatcagttgtacaccatgatgcagctcagtgtcgaatatttccctgcagttctatcaggctttacttcacatattttcatgctctattgtcaggtgcatacatgttaaggattgttgtctccttagagaattcaccctcctatcattatgtattgctccattatgtaattatccctgataatttccatt

SEQ ID NO: 138981 - DNA, 457 bp, Homo sapiens
tatacccatttctcactataagtcacaaaacttggagttatgagtaaaaacttgctaagcaacccttgattttcattgtaattaacagaaaaactgcattgtctattaacagaaagataaaattgagtctcagattggtgatacaatgatacgcactcataagtctctacttaagatgaccataaaccaggtgcagtggttcatgcctgtaatttcagcactttgggaggccaaagtaggaggattgcttgagcccagaagtttgagaccagcctggaaaacatagtaagaccctgtctctataaaacataaaaaaatgagctgggtgtggtgatgcctgtgtgggggccctagttactggggaggctacagtaggagagcctgggagatccaggctgcagtaaaccgtgatcaagccgctgtaatccagcctaggcgacagagtgagactctatct

SEQ ID NO: 138982 - DNA, 189 bp, Homo sapiens
tctccaatctctcccccaaaggtgtctactcctgcaggcttacctgtaacctttgtcactcactcttctgattctgcaaacatataaaccacggagccacagccaagagaatctggacttgttcgtttttcctgaaataggatatcttaaataatccgtggctcagcactgcgcccttttttttctttt

SEQ ID NO: 138983 - DNA, 129 bp, Homo sapiens
agttctgtcctcagagggtttgggggtaaattacttaaagcactaaacatttagaacagtttggcacatggtaagtgcctgaattctatgagttttgtttctttattctttcaagtagattcctctaat

SEQ ID NO: 138984 - DNA, 328 bp, Homo sapiens
ctcatccctctgctgctctcttttctggtcagtagatgtgagagccccaacaagtcccaagaggatgggctaccaggcccaccccagactgtgttgctgggaaacacagacgagggaccatcagcccttttcaagcttctatccaccaaaggccttgcctctgagggctgcctgaaagcccagctgcttccctgcattggtcctgcaaggacaaggattatgctgctagtgtggtttgcagggagtgaccattagcttccctagggtctctaatctgcaacccctggctgcagttgtggcccaaagaggtgacggcagcacgtctgtg

SEQ ID NO: 138985 - DNA, 485 bp, Homo sapiens
ggggagcaaccacaggcttttcttttggtgtgttatagagaccctcatccatctggcatggttaggaaatgaaaaaattggttaggtaaaaattacaactaaattgtttgagtgccaaaacattttaatctcaaattttactttcttttctgaggaaaaatgttctgaaaacttctatacctccatgccttaatcaacagactagattgatagtgatttttttcctgatattttaggatcctcattgtgcacatttgtactgaagtcttcgggctcctcacttcactgtgtactgagtatctgctccccaagctgctgggcttttatataagttttttttttttctttttccccttccccttcacctctataaaatgttgagagctgtttctgcatggactgcatcttcagcggtcacactcacgctcctggacgcactgctggcctcagcactgcctgttagagctgtccgcagtggccacctc

SEQ ID NO: 138986 - DNA, 138 bp, Homo sapiens
tctaaagcattcctgcaaggtgctttcaagttgttggaaaaggataatccttagtcaggattgtggcaaagcctaaaataatctttgaccacaaagataatcgtagcatcccatgtgctcctgctcctgcaggtgcac

SEQ ID NO: 138987 - DNA, 244 bp, Homo sapiens
ctcttcgctgttccctctgcctggattgcgctcctccaagatgctttcgtggctggctccttctcgacttgcaggcctctgctctgagagaccctcctgaagggtctagctgaagtggacctccagcgtctcttcccatgacccagaaacatcccattctctgaaggcagctgtttgtgcggtctcatctgatcccttgtagattgagctgagattatgttcgcctttcccaaagaggccaggg

SEQ ID NO: 138988 - DNA, 398 bp, Homo sapiens
tagataaacagggtttgattcaactgaaaggggagctgtagccattatacaacctcagatgaggattgctgagagagatctagggatggtaaatggcgactcaaagactcctcaatgagtctaagcctagggaaggtgctgagtttgtggttcttaaagcaaaggactcgaggtcaccatcgctcagagatgagacaatctctcagctccatttcatgctgatatatttcctcagatccattacatgcgagcttaatttttttaaggtgaaggtttctgcaacctggaaaacaaagcaataatcttacaatacagtagaattgggcagaagtccccaactatctctgcacatcagaatcgctgagcacacttaataaaaacactacgtcttgggctcc

SEQ ID NO: 138989 - DNA, 645 bp, Homo sapiens
taaaagttatccaggcatggtggtgcactcctgtagcccctgcttctcgggagttcaaggatgcagtaagctatgatcacaccactgcactccagcctggatgacagagcaagagaccctgtctcaaaaaaataaagaaaatagccctcatcctttctgcttcattccgttggtccagatgatcacaatggtctgcccaggttcaaggggaggagccatgggaggtgtgtcagtgtcacaagaaaagcttcgttcttcttgtgggataagatacaccacagcagctgcctttgaaaagatggtctgccacacagccacatgggtttctgtggatgctgagaaaaacgtgtgtgttgtttctttacagattaagaaaagtctgtgcattgtctcattaaattaaatgcagccattagtatgtggctctggggatattgtgggaataggctatgccttgggtgattttttttcttctaaatgttcttcctggagtttgtgttgccagcctgaccatttctctttgctaatatgatatcacataaaaacatcatcatcattaatatggcagagtcagcagggtgggatacagaccgtgatccaggaaggcaggctggttcctggctcagcagctcctggggaggaggt

SEQ ID NO: 138990 - DNA, 321 bp, Homo sapiens
atgaatgttggaaaatgttcttattttatatacttgattgatggtttgactgtgtacattgttagttataaatcatttccctcagaattgatccactttcttttagcttcaagcattgctcttaaaaaagctagaagccattatatgtattacccccagccctccagctgttagaagtttttgaaggtcttcatccctgctattttgaaatttcacgttggggtttataactcctttttcacttattttactgagtagcttcttttgacagtctggttatgcactttttagccctgagaaactgtcttgtattctttcttt

SEQ ID NO: 138991 - DNA, 421 bp, Homo sapiens
ttgctcatgtccagaacttagctacatagcctgagctagctgcaagagagaactgaatatgtcatctgtagctgtatggctatgtgtatacataaactccagccaccctgatacacaatgagagggtgaatattggaggacagtcaggagtctgccacaagacccaagaaataagtagttaccctatggcctactgacagtgtcttcaaagcaaggacctggtagcttttccatcacacaataaaaatccagagtcatcacagacttcagggttcctacttattaaccctgtctgccccatctgaagtagcacccctgccccactctgctgtcttactatgcattctttttcttcataacctttgtctctacttaaccatgatatattttgtcttctccattaaaatataagttctctgaa

SEQ ID NO: 138992 - DNA, 500 bp, Homo sapiens
tctactatgtactgctttcaggaaagcactctcaggaaagcactttggaaatgatgtgaatgagtaatattaatatctgtcccaagacctcagggaaaggctgtcctgactacttctgataatagccctgggacattcagggagagacccactgatctggcctcccatgaccctctccaaccctattctcttaccagctggaatgagcctaatgaccctgatccagcaaagcctcagctcactcagccttaacccactaattctctcttactaggggagggaaccctcaaggcgtagagggttttccaagaaacaggctctgtgccacctactagctgacagtcttctaaaactggtaaagtcagcctggcccaaccctcacttgacagagggacagggcagaaggggagatataaggaagcaggggtattgggggcagaggcaggcagatcatgaggtcaggagattgagaccatcctggctgacatggtgaaaccccg

SEQ ID NO: 138993 - DNA, 434 bp, Homo sapiens
aggggagagagaacgagggaacattagctagaaagaatgagacccattccaacccttgcaaagggggaagaaatgagacccaatatgaacgtcaagagatgaaactacatttaaattaactgcctctaggagcaggaagagaacacctaccctagaaaactgagatgccagttcttaaatggaagaaatctctcagaggaatttcaggccagcagctctcaactgggctgggggaggagtttgtgtgcatcttactacccaagggttttttccttcccccagttctcactttcccttcccaagcccatcagaatggtggcttggaggcaaggctgccagggcaattccctaaaacacaactcccttcccaattccaagcatgagcatccaaacccagaaagttatgtagacaaccctggccttctctctccact

SEQ ID NO: 138994 - DNA, 302 bp, Homo sapiens
ctagtatttaaattaggttattgtaaaagctcctttgcacctgttgaaaatgctggcacagtttctccattagtaaaccctagaaatctgagctctctttcactgaagtttcttatttcaactggaacattcttcttgaatgtgtgtgataggatcagtgtacggttttcaaatggttcagtctttctgcaaccacaaagtttcttattcaggggagtgcttgcagttctcttcattcccctcctccacttgtagatgaagaaaagaaaggcttatattatttttgaggcagctgctaacaa

SEQ ID NO: 138995 - DNA, 660 bp, Homo sapiens
gtaccggtccgcagtcgtatggacccacacattgaggggcgcttacatctgagcagcttgccggtgctttatatatcgtttgtccacgttgcctagcaacgccatcctctccctgccatcctttttcctacccttcctaagactgcatttaaagcaacttctgctaaatacccatgttcagagggttagcaggcccagccctgcaggtccaactggcttctccctgctatcccctggttttagtgtattctcaaaatttttaatgagaacattaattttaactttttattttttattttattttttgtgacagagtgcgactctgtctcaaaaaaaaaaaaaagaaaaaaaaagaaaaaaagaaaaatgaacatgctcatggtgacctctgggcaactttgaaatagcctcagtttctcaacagccgtgccagggggcgggggtggggtgtggagagtgttagagttgagtttcagcaccagtccttgaaagtgcctttcagaagaacaggttttatcccccaaacagagagacagtggtcagttcaccgtacttcggtgcacgtttgcagacctggtgggaagaggggcatcttagagccgagacccattcactcttggcactccaggtggagctgggcctttggggcctggatatatc

SEQ ID NO: 138996 - DNA, 669 bp, Homo sapiens
cagcgaggagaccgcagccatcgccccacgagcccacacattgaggggcgcttacatctgagcagcttgccggtgctttatatatcgtttgtccacgttgcctagcaacgccatcctctccctgccatcctttttcctacccttcctaagactgcatttaaagcaacttctgctaaatacccatgttcagagggttagcaggcccagccctgcaggtccaactggcttctccctgctatcccctggttttagtgtattctcaaaatttttaatgagaacattaattttaactttttattttttattttattttttgtgacagagtgcgactctgtctcaaaaaaaaaaaaaagaaaaaaaaagaaaaaaagaaaaatgaacatgctcatggtgacctctgggcaactttgaaatagcctcagtttctcaacagccgtgccagggggcgggggtggggtgtggagagtgttagagttgagtttcagcaccagtccttgaaagtgcctttcagaagaacaggttttatcccccaaacagagagacagtggtcagttcaccgtacttcggtgcacgtttgcagacctggtgggaagaggggcatcttagagccgagacccattcactcttggcactccaggtggagctgggcctttggggcctggatatatc

SEQ ID NO: 138997 - DNA, 295 bp, Homo sapiens
ttttctgtctgactcggtaatttgacttatatgaaaacagccggcctgttctgtcccgtgttctgaagcctgttctttcccgtgtgtgacaagcgcgcaggattaaaaagcacagccttttctcttcagctcctgcatgtcccttccctgcactgcccagttgcatccctttccagcatcgtttctgctgctcttgaacctgtggagtgggaagcaagacagggatctctcattttatatatcagtaaggtgtggcgtggacagacccgtgtcgctccctggacaccactggtgg

SEQ ID NO: 138998 - DNA, 725 bp, Homo sapiens
caaaaagtatgtgctttcactgtctatctcctttaaattgcttgtggttttaggacatgaggcttttacacactttgttccctagtccccgcccccaaagagagagagtaatggttttggagagaggggaaaatatcccattgtctgccaaaacaagattataaagatcctgtcaggagcggctctttgggtctctctctgtggttgactcctgactcctcttaaggtgcggctttgcctgaacagttgggtggatctctgggaatagacattgctccacggtctttcttctgtagtggcatatctcatcctcagttctgagatagcccactttgaaacacagcttcatgggcctggaagttgcttcaaacttgcattaaccgtctcatctgagtcaaagtggcaaagaagacaagacagcgtgtttattgttttcctgggaatggagagagaatggagtataagctgtttgtagtcaggcctggagtaatgagggtacctaaatactgaaggcatttttatgcagattgactgaaacctgaatcaaattggaaggagagggctgaattttgatagactggaagtattagagaattttctatactttgactcaaggaatggtcaacttttaggaaaagcaactatattatgtctgttaagatcatagaatcttaacctgaaagggaccttggagactatttagtacaactctcttaaaaaaaaaa

SEQ ID NO: 138999 - DNA, 503 bp, Homo sapiens
  misc_feature (48)..(48): n is a, c, g, or t
  misc_feature (55)..(55): n is a, c, g, or t
  misc_feature (58)..(58): n is a, c, g, or t
  misc_feature (99)..(99): n is a, c, g, or t
acaagcattacaaaaattagccaggatgtggtagtacgtacctgtggncccagtnatnccagaggctgaggatttggcttgagcccaggaggtcaaganctcaatgagccaccgtgcccggccagtttcctacttctaacccttaggtaacttaagtatcctggatgttagtgactattttttctaaatgatttccaaattgctttattggcaagaatccacctctaggatgtccttcccgtattttgcttcatccttgaactaacatcctaggagcaacacatgctgcctctttttaaaggggcctggaggcgtggggcagacccttgaaggaaggaaggagttggtgagctgagatggtgaatgagttgacattgtgggcttctttcagaatccgtttctgaatctatgtagctacttgattacagtttgggcttctcaccatgatcagagcagtcttggcctatttttctcttcatttaaaggtacagaccgtcgtgagc

SEQ ID NO: 139000 - DNA, 1382 bp, Homo sapiens
agagcaaaactctgtctcaaaaaaaaaaaaaaagatttatttagagaaatgtgggagacttcttcggtaaagtcagtacttctgaaagagtattttctctcttaaaagactgcatccactctggagaagcacccagctgttccttttgaaactaagcatggactcatcctatgatccagcaagggcactcgtggtgtcactcatggtgtaccagagaaaatgaagactgactcccagcaccttcattcataacagcccaacactaggaactacccaaatgtcctgtaatggtgaatggttaaagaacctatgggacatccataccatggaatacgatccagccataaaatggaacaaacctttcacaccaggcaacaacttggaagaacctcaaggaaattatgctgagtgaaaaaaaaaaaaaagccagtctcaaaaatggtgcataagacatagttctatttatgtaacatccaaaaaaataacataattacagagatgaagaacagattagggattgtcagaggttagagatatggagagaggatgaatgtggctgtagagggatagctctagggagtcttgtggtgatggtagtatagtctcttgattgtggtggtggttatgcaaggctatggatgtggtaaaagtgtataaagttacacacacacacacacacaagtgcatatgtaactggtgaaatctgattaaactgtatggattggaccagtgtcaatttcttggttttgatattattttacagttgtgtatgatgctaatatttaggaggctgagaaaaaggtacatgagaatttcctggacatttctttgcaacctcctataaatctatcattatttcataagaaaagaaaaaaagcccacgtacacacattaaatctttatatttaaggtgacttgtttgaagatacaaagacgagcaggggagcaggggagggaattgctagctgtttggcatgtatggtggccactccctatgtattgccatagcaatatggcagtatttcctatgaacagcgtatttttaatatattaaccaggaagataaaaatgtgttctgcattcagtgctagccacagagtttcaaagacctgatggaaccaaagtgtgttaaggccttagctctgtgttatacttgccaaccttctaagggtatgggtatcacatagaagaaatctaaggacaggtttcagggcccttgatcattcctcaacctgtcagatcctgagtgtttatcacagaatgtttcagtaaatcagttatattacttgcccaccattttcactcctccagaagattatttctcaaacaataacaactttttctaggttccaaatattatatccattgtttggccttagttt

SEQ ID NO: 139001 - DNA, 1036 bp, Homo sapiens
ggctttcagagcccaagcgttgcaaggaggccatccacgacggagaactgcctggaaaggagagtgagagccaagcaggaaaacatgggcatctgggccggagtgggtgtggtagcagaaattggagattgtttccatagaagattgatcaaactagtaattatcttaaggaaaatgaaagacaaggttttcactgttggagaaggaagttacaaatacagcagaggaaaaaacaaggatgacccccgtggtgttgaattggaattcggcatattgttgtaaactcacggttttcaagatagagataatagattaataaatacacacacacacaagtgcatatgtaactggtgaaatctgattaaactgtatggattggaccagtgtcaatttcttggttttgatattattttacagttgtgtatgatgctaatatttaggaggctgagaaaaaggtacatgagaatttcctggacatttctttgcaacctcctataaatctatcattatttcataagaaaagaaaaaaagcccacgtacacacattaaatctttatatttaaggtgacttgtttgaagatacaaagacgagcaggggagcaggggagggaattgctagctgtttggcatgtatggtggccactccctatgtattgccatagcaatatggcagtatttcctatgaacagcgtatttttaatatattaaccaggaagataaaaatgtgttctgcattcagtgctagccacagagtttcaaagacctgatggaaccaaagtgtgttaaggccttagctctgtgttatacttgccaaccttctaagggtatgggtatcacatagaagaaatctaaggacaggtttcagggcccttgatcattcctcaacctgtcagatcctgagtgtttatcacagaatgtttcagtaaatcagttatattacttgcccaccattttcactcctccagaagattatttctcaaacaataacaactttttctaggttccaaatattatatccattgtttggccttagttt

SEQ ID NO: 139002 - DNA, 858 bp, Homo sapiens
ggctttcagagcccaagcgttgcaaggaggccatccacgacggagaactgcctggaaaggagagtgagagccaagcaggaaaacatgggcatctgggccggagtgggtgtggtagcagaaattggagattgtttccatagaagattgatcaaactagtaattatcttaaggaaaatgaaagacaaggttttcactgttggagaaggaagttacaaatacagcagaggaaaaaacaaggatgacccccgtggtgttgaattggaattcggcatattgttgtaaactcacggttttcaagatagagataatagattaataaatacatatgcaaataaaaaaaaaaaaaaaaaaaaaaaaaaaaaaaaaaaaaaaaaaaaaaaaaaaaaaaaaaaaaaaaacaaaaaaaaaaaaaaaaaacaaaacaaaaaaaataaagggggggggcccacagtaataacatctctgggaggcagctaactatactgcacgaaccctccagattttataaaaagaggaggacgtcataaagggaggacattatgacgaacaaggaggcgcggcgagtataaccactaagttgggtgagaagaaagtatgtgagcaggatttttggaggagagacaacatcatagggtggggaaagttaaagattgtatagtctggaaaacaaacaacactaggaaggatataaacaagcgcctccgtgggtgagagtaaaaactaaaattcttaggtagtagaatgagtgcggtggggtaacaaagacgaggagatatgatcgacgctgtggagaagcaactaagcgcgtcggacgcaagaggttgtatacgagaaaccaaatacttatcagcgcggagc

SEQ ID NO: 139003 - DNA, 314 bp, Homo sapiens
aggcttggcctaaaaatggcaggctaacaggagaagcagcttctgctgactaagacacagcagacaagttcctgggcaccgctgaacaagtctttaatgcagttaaaagtgtcctattctcggggtggcagggaggggggcaggccacaaaggacatgagtgttaggaaaagaagaaagcacagggaattaaggcaggaagggataggctaactactgttctgtgcaaatgcaattgggtttatgatcaggactgactgcccttacgtataaagttgctaacccccaagacctgaagggaaaagtcttttgaag

SEQ ID NO: 139004 - DNA, 410 bp, Homo sapiens
ggccctggcttttctcatgaaacctgtgcgaccttcagccaatcatgccccctctctagatcccaggtgtccctctgcacttgaattccatgtggcattgtagcaggacgagccgcagacaaaactcctcagacaccaagttaaagaaggaaggggtttattcggccgggggcatcagcaagactcctgtctcaagagccgagctccccgagtgagcatttcctgtcccttttaagggctcacaactctaagggggtgcgtgtgagagggtcgtgatcaattgagcaagcagggggtacgtgactgggggctgcacgcaccggtaattacgtgggaacaaaacaggaaagggattttcacagtgcatttctatacaatgtctgtaatctatagataacataaccgattag

SEQ ID NO: 139005 - DNA, 221 bp, Homo sapiens
catctggctcacagccttgcaccagaggcgtcacgagaatcaggaaaagttctcctctcatgccgaagacgggagggaaaccagagggactggtgagccttgagtcggccacaggtgtgtggaggatcgtgacttagcaagccggggacacgctgttaatggacttcctgctgtgggggtgagggctccgtgctccatctctgatgccctgtacacacctg

SEQ ID NO: 139006 - DNA, 363 bp, Homo sapiens
gcgcacacaggaatgcacacatggcgtgcgcagggcacaggctcacacacacggactcacacctatttgttccatgtacacctgagttgcagagacaagccagtaggtatacacgctcaggtctcacctggcccagagggcctagatgtacccaattcatacctggttattcagaacacacgtgcacacatgtgaagcccctgtgtgttcagagaacaaatgtgcacacatatgcctatgaggctgtgctgcagccacaactcactgcaggacacagagcacatatatataccatggcacagaggcagggatgcacatacacaatcactgtacagggtcatctgtgtgcacacacacgtgtac

SEQ ID NO: 139007 - DNA, 338 bp, Homo sapiens
gcacacacacagacaaatactcccgtaagacgaacatgccatagtcaaggttagataagctgctgtggcagcagagtagggtgatgcattcagactagtaattagaagggattcaaggaaaaagtaacctttgagatgagtgttgaaggtaactaaaattcttttgatcaatggatggagaggatgtctgtaagagtatgaagggcattccaaactgaaggaacatagacagtttcattttgtttatttatgtctaaggctgtaaaactcagagtattttacaaaggcgattccatgtatcaaaactattaagtttcattcagcaaaaattatatgta

SEQ ID NO: 139008 - DNA, 256 bp, Homo sapiens
ctgagtccagacacgccccaccttggcccagtgtccacctgcacctgctcacattcccatgtgccaccattccttgatgcagctcactctctagaccagtggctcccagccactggggtgcatgagagtctcctgaggagccgaggtacatgtgtgctcaagtcagcatccagacccactgggtccagtctccaggctggcccagtttgagaggtgggtttagagagtttctctgcaatagcactgggaataccta

SEQ ID NO: 139009 - DNA, 881 bp, Homo sapiens
ctctgatgcagtgaaaaaggtgggaagaaagggtgtcataacagtaaaggatgggaaaacactgaatgatggattagaaattattgaaagcttgaagtttgatcgaggctatgtttctccatactttattaatacatcaaaaggtcagaaatgtgaattccaggaggcatatgttctgttgagtgaaaagaaaatttctagtgtccagtccattgtacctgctcttgaaactgccagtgctcaccgtaagcctttggtcataatcactgaagatgttggtggagaagctctaagtacacttgtcttgaacagcctaaagattgattttcaggttgtggcagtcaaggctccagggttttgtgacaaagaaccagctcaaagatatggctgttactactgttggtgcagtgtttggagaagaggggttgatcctacattttgaagatgttcagcctcatgacttaggaaaagttggagaggtcattgtgaccaaagatgatgccatgctcttaaaaggaaaaggtggcaatgctcaaattgaaaaacatattcaagaaatcattgagcagttagatgtcacaactagtgaatatgaaaaggaaaaactgaatgactggcaaaactttcagatgggatagctatgccaaaggttggtgggacaagtgatgttgaagcgaatgaaaagaaagacagagttacagatgcccttaatgctaccagagctggtgttgaagaaggcattgttttgggagggggttgtgccctgctttggtgcattccagccttggactcattgactccagctaatgaagataaactaattggtatataaacaatcaaaacaacactcaaaattccagcaatgaccattgctaagaatg

SEQ ID NO: 139010 - DNA, 424 bp, Homo sapiens
tgctgggccctgttccaggtgctgccctcatgaaacatacattccagggagtctgtgaccctctggccctggactacgtgagaggtcagtggggttcatgcttcctgctcttcccaccttccatatctctgctttttgaaattgcttttttccccaaagtctgctctgcactctccttccccaagggtgtgatctcgtctccatcttagcctttcttacagctggccttacactcagctgctgggcccagatctggctgccccattgactaggagcttcttgagggcaggctcgcttcgttctcactccccacagggagcagggtgtgaccagaagtgtttgctgaattgaacagaattatcaggggctggtcaggcatggtggctcatgtctgtaatcccaacactttgggaggctgaggtag

SEQ ID NO: 139011 - DNA, 249 bp, Homo sapiens
ccgcgatccgatggccatgccccgtcccgatggcatgcatgttaatggagccagggctgtccaccttggagtagttgttcaaacagctgaggtggagtggggatgactcaggaagtggcagggacagttggtcccttgtgtgtgtctggatttcttccgtggaaccccatgttgtcgcttcacttgtttccttccaatgatggggagctctctacctgtactcccctcctttactctcaagggccaatc

SEQ ID NO: 139012 - DNA, 253 bp, Homo sapiens
ctggcaaccccacgctaccttctgcctctttgaatttgcttactccgggtacctcatataaatagagcatttgtccttttgtgactggctcatgtcgctcagcgtgatgtcttcaaggctcatccatgtggtagcgtgtgtgagcgtttcctgcctgccttagactgaggaatacgccattgtgtgcctgcaccacattctgtttgtttgttcacccatcggcagacacttgggtcgcctctaccccttggct

SEQ ID NO: 139013 - DNA, 729 bp, Homo sapiens
tgctgggattacaggcgtctggccttaatttgcattttcatcttgcagtgagctaacaggatcccgaaactctcctcgctgtaggagagtttgctctgctctttagtgaggaggctgtcctggggctctgggatttggtgaaatgattcctctccagttgttgatccctgcttcagccccacttctggctctgcccatttttgccttctcctgcccaagttggagtgccctggtataatgccgaatggatcctgccatcaaacccccatccttgaacccactcccattccagggctggagggaccctgagtgcatgcaccccttaggtgtggggtaagaggcacccaattgctctgttttcctccgcacccccacctctgttctagctccacattagacccatgacctcactgtggtggtcccagcctgaggccagcatttcccaaagctggtctcagtccaccatcatccatcacttggagaggctggaaaagcctgtaaatgtgggatcctgctggagacccactgaagcagaagcactaaggggagctgggactctgcatctaaagccacccaaggaggttttgtgctcacaaaaactctggaattccacctggggtctcctgaaggctgcaactgagactcccgagctacaattaaggtttcagaaggcccaatggatacctcgcctttacctgtgatttggtgctcaggcaattatgtaataaa

SEQ ID NO: 139014 - DNA, 752 bp, Homo sapiens
aaaaataaaaatgtctttctaggccaggtgcagtggctcacgcctgtaatcccagcattttcatcttgcagtgagctaacaggatcccgaaactctcctcgctgtaggagagtttgctctgctctttagtgaggaggctgtcctggggctctgggatttggtgaaatgattcctctccagttgttgatccctgcttcagccccacttctggctctgcccatttttgccttctcctgcccaagttggagtgccctggtataatgccgaatggatcctgccatcaaacccccatccttgaacccactcccattccagggctggagggaccctgagtgcatgcaccccttaggtgtggggtaagaggcacccaattgctctgttttcctccgcacccccacctctgttctagctccacattagacccatgacctcactgtggtggtcccagcctgaggccagcatttcccaaagctggtctcagtccaccatcatccatcacttggagaggctggaaaagcctgtaaatgtgggatcctgctggagacccactgaagcagaagcactaaggggagctgggactctgcatctaaagccacccaaggaggttttgtgctcacaaaaactctggaattccacctggggtctcctgaaggctgcaactgagactcccgagctacaattaaggtttcagaaggcccaatggatacctcgcctttacctgtgatttggtgctcaggcaattatgtaataaa

SEQ ID NO: 139015 - DNA, 278 bp, Homo sapiens
gggataggttactgatagtcatttttttcaggattcagtagaaaattaaagtaaatcgatcattttatagccccactggaatggctacaagggcatgttgctaagcaaatggtaatttaaatgtactgtgtaatttttctacgcaatttactgaaggcagattttatttctcagttaatatcagatgctctttatctcttagtgcatgatgtatcagtgatagacaaattattaatccatgtttcaatcaaatactgtggtttgacaactgctcatgt

SEQ ID NO: 139016 - DNA, 300 bp, Homo sapiens
atatgatctcctcctcagctcacacagtgcttgcattaccgtcgtaagccaacgtgccagctcacttgtgcgttcagcactaaatgctgtatagaggcggattcttcagcagatcaactaccgaatgaggctgggtgtttttgtctttgttctgtgtttgggttgagaaggttggtctttgggaggagtcaggatgaggaaggtggtgttctgctgggtaagcggatatgggcactgaaacaatcgcaggctgcctgaattccaggcagggtggggcacgaggatgctgggatgtgagcc

SEQ ID NO: 139017 - DNA, 268 bp, Homo sapiens
tctcccttctggataactacctagaggcaggtcccagaaaccctgggcacatccaaccaggggctgtgaaaggtgctctggggcctggttggcattggctttcctcaaatccagttccccactgagttgtccatgctggcgtccgacgtttcctctcctcaccttctctcttgaccccactcctatcgagctcttgctcctccgcctgctgagatggctcatagcccagtcctatcctgggggctgctccatcagcctcctcccactc

SEQ ID NO: 139018 - DNA, 504 bp, Homo sapiens
aacaaggaaacaaagaatcaaaagtttgtattcctttcattttgctgcaaatttatgtaaacaaagtggctgcaagggaggataaaacagtataacaccttactatccatccgccgttctcaactatgtgcaagacagccctaatctggaattttgttttttaaaaaaagtccaccttaatcaatgtggataaatgccttaacgttcattcattgaaggacgatcctataatagcagagctgtactcagaagattttactctcactctatacacagtgctaacagatggtcattggctctctagcccacagtatataatgcccaaaaccagaaaagggatttctagagggaggcatcaggaagcaggaagaattcataggaaaggagcagacaagtaaaccgcagaaagcagatgagcagtcgagaatgcacaatctggctccagttcgtgttggggcagatagcgctgaccactccaaggtccctgaaagcttggcaggaagt

SEQ ID NO: 139019 - DNA, 578 bp, Homo sapiens
tgaccaacttctctttgttacccctccctaattcctgttttccacatatggttacatttcttccctgctatataaacctctaattttagtcggtcagcaagacggaattgagactgatctcccagctccttggctatagtacctgattaaagccttcttccctggcaatattgttgtctcagggattggccttctgtacagtgatcagtgggacctagaccgaaaccctggcatttcagtaacagtttcatctgtgttaacacactcttcataacagtaacaggttcatttttctgaaactccattttgatcatattgggacttgtccacatctgtgccactgcatttgggttaacccagtcacatctccattagaaggttcatgcataccgggccgggcacggtggctcacacctgtaatcccagcactttgagaggctgaggcaggtggatcaggctggtcagtagttcaagacaagcccggccaacattggtgaaaccctgtctctactaaaaattaaaaaaatttaaaaaattagcctggtgtggtggcacttgcctgcggtcccagctactca

SEQ ID NO: 139020 - DNA, 701 bp, Homo sapiens
atgtgtgtgaacactggaaaaactatttccaaatatttgagagagaaattgcaacgttagaaaaaaatacagcattaggtgcacagaaaactaaacaaacgagtaaaaaagatacatatttttaactccagaaaaataacataaggtacagaaaaggaaaagaaatcatggggtactttctggctcagcataacagtctcaaaaattttgatgtaactattctgcaatcagtgctataccaagccatattgaagcctgaggcaaaagaaaaaatgaatgcccctataagttttgctttgtgtgtggtgtgtttttgttttgttttttgtttttagcaacagggtctcactttgtttcccaggctggtctctaactcctagacttaagcaatcctcccagctctgtctccaaagtgatgggattacaggtgtgtgccattgtgcccagcctgtttctgtgtatttaaaaaattttttttctagaatgttagtcagaaaaatattgaaaaatttaaaagtaggagaattaaactcacattagcttaaacttaaagattttatttatgccaaaaacagtattattttattctcctggctaatggaagcaaatgcatcaacagtacattttcaaatctaattcttttcttattttgttttcaaatgagcaaactgtcatgtacaatttctcttgaacaagtgaca

SEQ ID NO: 139021 - DNA, 579 bp, Homo sapiens
catacactgaagcaggggcggttttaaacattacacagaacttaaaacaatcgaacgaattcgtcctttgttctttttattacattaattattacattaatactgtttaaaaagaaactcaaaaggcattaaacttaggtaccaatctacacaaagtcctcgaaggggcctggcttggaccgaacgcgcttttgtgccgccccgctcgctcgcagcaccctgaaggccactgagcttagggcgctcggtccctagaagcgacttgaaatgagggggtcgccaggccaggccctcgctctgcaggggaggatccgaccaaagtttgccaagtttccaggcaagcccaactgcgcaaatgccgctttttagctccagcggcaggcctggcccgtgggagttttgccccaggggtctccgggccttcaaagaaaagtcccacgaggtggggggcgccgcctgggccgccggccagggggacccgtcgccccagggcacaaagaaagagcgcgcctacagggtgtcccctgaccccggcgactcggggccagggaggctcggcgcgccccagcggccgctctt

SEQ ID NO: 139022 - DNA, 783 bp, Homo sapiens
acctcaattatgtagactgttttatcactgctgtcccagcacagcacctggcacagttagctgttcaagacatctctgttgagtgggtaaatgaatgagttccactccaggttcctgtgtttgtgacctccaggggcctcttctcttcccttccccttctcacgtaggctgatgccctggtcttccagctatgcactctacctgcctctcgatgctctaagccgatgtgtccatcatttggctgtttgcatattctgattcatgacattttcctgcacagtgctggctgacactctgtagcccatcatatctgacttctctggccagcctgtatgcctaccatcagctcgccctccaaggcacagtccttccccgtttcctgatgttttcacttctgccccagccatgcaaatctcagcacacacagctcattaaatagctttgaacctctcccttctttttttttcaatactgtttggcaaatgctttccaagagcctactaagggctgggcacagcgcctcatgcctgtaatcccagcactttgggaggccgaggcagttagatcacctgaggtcagaggttggagaccagcctggccaacatggtgaaaccacatctctactaaaaatacaaaaattagctgggtgtggtggcaggcacctgtaatctcagctacttgggaggctgaggcaggagagtcgcttgaacccggcactccagcctgggtgacaagagcaaaactccttctcaaaaaaaaaaaaaagagcctactaagcaaaaa

SEQ ID NO: 139023 - DNA, 235 bp, Homo sapiens
cattcatatcaccttccctttctattctcaaaccaactgctacacataagcagaatcggtttttagttttctcctaaatgtgaaatcacaaaaggacttgacatcaaagaattccaaatcggtctttatcaatggctattccaaagccgtctgcaatcaatattgcaataactaaggctccacggaatcctatggtatcaatcccagcgatgaggccaataaaagaagccctgca

SEQ ID NO: 139024 - DNA, 193 bp, Homo sapiens
ccccagcccacttttaaggcacctgcctaaaaaacctgctcctaaagcatgttcttataggtcagtgttatcaacaccacctggtgtttattagaaatgcagaccctcaggccctacctagacctattaaatcagaatctacattttaacgagattccaggggatgtgtatgaacatcaggagtctgagaagt

SEQ ID NO: 139025 - DNA, 801 bp, Homo sapiens
cagccttagcaagtcaagtgcattttataagttgggattttctttgtatcagtgttttttcacagagccaaatctgtgaagctgaacctatatacatgattagttcagaatttttcttaaaaaacagttactacatgccaatttctttaggttggttatttctaatagataactttcccagttgactggaaaatactggtaacatactagtaacaatatttttcagtgaaactcatattctgttgactagttagatgaaacattttgttttctcttccctctagttaaaaacaacctttaatattttcttctcatattctgcaacctctttactctcaaactttaactccgtggaagaccttgctcattttttcagttttattatgtctgaaactttgctaactatgaaaaataatttaggagccattagttttagttttgaattatgtaatctaaaaagttttcagtttttagagttattctcttgattcctcttatggtttaaggtcttaggatggtgcttatcaaactgaagcgtatctctctgaggtataaactttactcagttgggggaaaaataactggtaattatgttaaacattttaataaaatagatgactgtattgtggaatgggatataagtatttcaaaaaatctgagtgcctataaaataaaacttcaaggacattttagaccattccatgggctgcctcagattgtgccttcaaatcctctggaatcatacatttactctcatattctaagttgactgtctctgtcatgaagattatagtcgtaaaa

SEQ ID NO: 139026 - DNA, 328 bp, Homo sapiens
ttgaactagtgttaaggtaggagaggcaaaaaaggatgagcattttggaggcatcacctagaatggatatcagaggagagagacatgtgagagcaggtgtgggtaaacagactatatcctggtgctttgggagtttacagaagtaaagcatgcttttagtaacctattctgaacttggagaacttgctgaaactcgaatatatatttttaagagctaatggctatattgtttgtacctggaaagcaaatcatgttcctgaaatatttctgtgctctcttaaattattactactgccatgtgaatggatttactgtaggattcctttaa

SEQ ID NO: 139027 - DNA, 577 bp, Homo sapiens
aatcagtgaggacaaaactggtattttctgcttcttaaaaaccatcaggtttcatccatcaacgaagactttgagtgcaaccaaacaggtaaaatatgagggaaaacaaatgatggatgagttaagcactaggactggaaaattataaattcttaaaattgaggagcttcatggaaggttatacttggaaacttctttacagaaaaactctattgcatagggaatggaatgtagcaaacacatacagaggaaaggaaacctagaaccaaaattaggtcacaaaagaatatttgcaactgtggtttccggaggtgggcgctggtgcacgaagccttccaggtatgaaactttgcctttgttttcttctcacttccctcacgttccttccttccccccatgtctcttccttcctgctgggcttgttctcacagcccttgcaagcatgcaaagagtcactaaaaatactgaggaatcctcagagcaaaagagatatttttctcctaactgagagtactacaagataattgcaggtgaaatacaaagtttaaaaccatcttcagatttcacaagtgttgta

SEQ ID NO: 139028 - DNA, 1009 bp, Homo sapiens
acctattttttcttgctcctcccactgaggataactgtaaaccctggaaaaaacaagaggcaaccaaaggagaattctgaaaggtgaaaagaggaaggcaaactagttatgtcagtactagagaaacaacataacagcagggacctcacaacccccaccaacaacagcaacaacagaaggtggcccaggcctagtgtttctgaatgccaacctagcaatagagggtggcccagctagactaattctcacccatatctaacagaaatccctccagcaacatccacagcacctgtaaagagccctaatgaccgtaagtggttaagagaaggggtttccttcctcaccggacctgcagcttctctttcccaccaagagacatcaggtatctgagtggctccaacaagaaggattctagaagtggcccagaaagcctctttgtttctgtgggactgcgactctcgtctacccagaggcactgaacattcagagacactggacatctacccagaaaacaccaggaaaggggatctggccacaacatgcagtcaagtatgggaagcccctgtgttctcacaggcaagagaattttgcttcttcacccagagacaccaagcagctgggtggcattagcaagggagatctggtcataatgggtgtgtggtccaggaagcctctttatccttgtgggccagagacttccctctcccactcagaaacactgggcagccaggtagcaccaataaaggtgatcctgccacaacaagaaacccaaaatgggaagcctctttgtccttgcaggctggagatccccattccatacttagaccaggtggcctggcttggggaatttcttgccacccacataggcagtaccagtagagaccagcgggagccccagtgataccatataaaccaaacataccaagatagcactgcaaaggctattttccaaggaaattgtcattgaaactacagcccacaaaagtaggtcaggacctgcatgttaaac

SEQ ID NO: 139029 - DNA, 685 bp, Homo sapiens
aagtccgagtccggtgcagagaacgaagccccttctctttcccaccaagagacatcaggtatctgagtggctccaacaagaaggattctagaagtggcccagaaagcctctttgtttctgtgggactgcgactctcgtctacccagaggcactgaacattcagagacactggacatctacccagaaaacaccaggaaaggggatctggccacaacatgcagtcaagtatgggaagcccctgtgttctcacaggcaagagaattttgcttcttcacccagagacaccaagcagctgggtggcattagcaagggagatctggtcataatgggtgtgtggtccaggaagcctctttatccttgtgggccagagacttccctctcccactcagaaacactgggcagccaggtagcaccaataaaggtgatcctgccacaacaagaaacccaaaatgggaagcctctttgtccttgcaggctggagatccccattccatacttagaccaggtggcctggcttggggaatttcttgccacccacataggcagtaccagtagagaccagcgggagccccagtgataccatataaaccaaacataccaagatagcactgcaaaggctattttccaaggaaattgtcattgaaactacagcccacaaaagtaggtcaggacctgcatgttaaac

SEQ ID NO: 139030 - DNA, 269 bp, Homo sapiens
aactcgggcaggattacagggaagccaggaggagtggaggtttgtgcttcctctttcaaggagaaatgggtgaggttgcaggccagcacaattctggagtggtagaaacagttgtctaagtgggaaggggttgtggcagcggtctgagggccacagaatatgcctccttccataaggtataaggaagcccctacagttctttagttctgtttctttttcttttttaattttttgagacagggtcttgctctattgcccaggctggagtg

SEQ ID NO: 139031 - DNA, 230 bp, Homo sapiens
tgctggaattacaggcgtgagccaccacgcccagccacactattttattaatgggaagaaggaagataatttcttctttcaagggacttatatttgaaaagtcaccacataacaggatttggatctggatttagaagttttcaattctgtttcctttttgggttttgttggaactgatgaggaagtaaggtagagaaagaagacaaatgggatagaaagtgagggtagga

SEQ ID NO: 139032 - DNA, 130 bp, Homo sapiens
tagttgaaatatatacaatttcagcttgaatccaggcttcacatatcaggctctttttagacctgtgtcattttccaatttcaaagttatcagttgcccaagggtctttctgtgccatgcaaagatgtgc

SEQ ID NO: 139033 - DNA, 281 bp, Homo sapiens
aagggcagtaactcattctggatgttactaaaagtagaaaacaaaaatccaaaaacaaacctacagcctcatttacaattagaatctgtctgggccttctgatttctaaagtctgtgaggctgccaggattcaccaattctcctttcccctgaggcccagcaactattgatttatagcttaaactctgtgaaggtccacagacctttgaaaggaacttgctggtactttgtcagtcgtgtacacctaactgactcctcctacgaggtacagtctcctcata

SEQ ID NO: 139034 - DNA, 222 bp, Homo sapiens
caaaggcctaggtccttgcctccagggacaggggacagagaagggaacaagggggaggggaggcctctgggcttctatctggacttctatctgcagtgctccctactgtccctgcccttcatcccaggaccactgctctcatcctgacctccacccgccaccagacagcctcctaactaactcccctgcatccttccaccccagcctcagaggctccttcct

SEQ ID NO: 139035 - DNA, 292 bp, Homo sapiens
tcatgcaacatgtgcctgtgtccagcttctctcacttaatgtcatattttcaagattgattaatgttgtagcatgtatcagcatttcatttcttcttattgcaaatattcgttgtatttataccttatcttatatatgcattgtccagttcatgaactatgattagcatatttctactttttggctattttgaataatgatggtatgaagatttgtgtacaggttttgtgttgatgtgttttcgtttctcttcattatatacttaacagtgaaattgctgggtcatatggaa

SEQ ID NO: 139036 - DNA, 481 bp, Homo sapiens
gacagagaagaaagccctggaattctagcttcaaatagctaataagcaccatttctttttcttcataaggtgtgctaccagaggggaatctgaataagcagcattcatttttaaccaggagcttcctctgcagttgaaattctgccttgctgctgcagacgcctctgtatgcatgactcgaggcttctgcctctcgagcttgtagctttcagaagcaataagtgaaggcagggaacgtttttatctagcacagggcttaaccctgttttccagccaatatcaggaaatgtccttgttttaatagggcccaagataatcactataaaaattataaaagtcactttttaatctctgaataatctcaagaaggaaagagagaagacagcatgagacctcctagtaaaacaggtgccccttcgaagtctggaggaggttgtgtttagaataaatcaaagcaagcagttgtacagcaggcagcctc

SEQ ID NO: 139037 - DNA, 459 bp, Homo sapiens
tctggtgccctactttaagtgaagtgatcctgtttactttctttaaaggacgggaatctgttgccctcacttttttgttaacagaatggaccccccaccacctcgcatcagcacacactcccctcctgttctctcctgggaaaagtccgtcagttagggtgatttccctaaggagctttctctgataggcacagggatcctttagagcaatgtcaatggggctagttgatcagttacagacacacctacccttgagttttacagaagaccttatttctgagtgacgtttccctgggaattccaatgacttttgaatgacttttacaatgactttcgcctgggagttccacctgggggcatttgttacaagtgacagaggccattccaattctcactccccatttagccaacatctctcctttccattcatacccaacgccgtgcccctgtcttgtgaca

SEQ ID NO: 139038 - DNA, 247 bp, Homo sapiens
cttcttggatgtctgcccagggagacaagcatctctttgataatcagcagcatacagctttgtctctacctgttacttgaaagcttcatacacaagacctgtctcccctgccagcaatttgaagacaggtaccatggcttactgccacttctgactttgcttacctaggtgctccttatggacaggatgccatcttggtcatttttgcatctttggtgcccaacagtgtttggcacacagtaggtac

SEQ ID NO: 139039 - DNA, 381 bp, Homo sapiens
ggtgatcaaggaaatgcaactgaagacagtgatgatgtagtctaagcccattttagtggcaaaggttaagaagtagggcaatatccagcattaaagagactgtggctacacaggtccacttcggcattgctggtgggagtgtaaattggtacaaccacctttggaaaagagtgttcactatctcctaaagattctgatcccttatggccaagcaaatctactagtagttctatccccaaaggagactcttgaacatttacaacaagagacatgtacaagaatgttcttagcagcagtgctttcaatagaagaaacactgacacaacccaatgcctgaaattgaaagcatgaatgaacaaattatggcttattcacacaatg

SEQ ID NO: 139040 - DNA, 159 bp, Homo sapiens
tctggtttttcagaggaagatatgacacattcattaaggtgattcaatatagtgcatatctaaataatatatcatttgttctcttgctagtctcagcgaaatgtcatttgctcttgtgttagtctcttgtcagtctcagaatctctttatagccttcaa

SEQ ID NO: 139041 - DNA, 161 bp, Homo sapiens
ggtcgcacggtgctggggactccctctccctgcccatgagagggagctgacaggtgtgcctggtgtttcctcccagtgaaaacacctggggaaaaccaggctggagataggggctctgagcccaggactgagagccagccaggttccagaacatgacacct

SEQ ID NO: 139042 - DNA, 358 bp, Homo sapiens
ctccatcgtgactttcttcacacaaccaaatctcagagacatttgattatgcctcttctcaactgaaagaggtgccacagaataaaatctaaatttcttaaagtagcacccagggcctgcatgatctggtcctctcaacctcactattcctacttcctctcccatatcataaccatcccacagacttacgtggctttgcatattctagtattatggcctataattcaccctcctccccaacagcttgaaatgctactggattctctaaagctcaagtcaaatgccactctcctccctgaattgtttctccccaatgagatatttcccttctctgtgcccacctgtacttcctttgaat

SEQ ID NO: 139043 - DNA, 480 bp, Homo sapiens
ctgtcttcatccttttctccttcagcggagatttatttcttccaatttctgcagccaactctgtgggagttgttgggttggtgaacccgaggggtggaagagacagctctgggaccactgaatagcctagctttgtttaggggcatgttttcctgactgtttatggtgcctgacagggttgtttttgttctggggagagctcatttgataaagcaggctgctgagaaagctgtggggctccactttttctggggatatctccaaggccccccagggagctgcgatttagcatcccgcaggcaccccttgctcacggaggtcatctgaggccctttgcatcctcgtcccaagtctaactcagatagtggaggggagagaaactgttgccagcttcaccagcttaatagtagtcaggaaggagttcaggccagcaagattccattttaatcgtcaatcacacattaccaaataaaaaagaaa

SEQ ID NO: 139044 - DNA, 350 bp, Homo sapiens
cctccaagacggcccctatatgtctcacctcctggtacacatgcccttggactgacctgtgtaaccaaaaggatactgtggaaataagtgtgacttttgaggctaagtcacagaagactctgcagtttctatcttgcttgctcttggatcactcactctggggcagccagctgccatgctgtgaggatactcaagcaacccagcagtggtccacatggtgaggactgcagcctcccaccaacagccagcactcacagcccaggcaaatgagtaagccgccttaggagaggattcttgagcctcagtcaagtctttaaacaactgcagtcccagccgacatcttgacagca

SEQ ID NO: 139045 - DNA, 277 bp, Homo sapiens
gggaaattcaaggaataataaactgaatgaaaaaatgggctttaccaacctgctaaaggccagatatttctgccagtaatggggaaaaatttgagtcaattagatcaatctctgtaacccggtcttctttgtaagacactttgaaaaagtctagagttgtagactttcagagcaaacctcgcacatttctgtatggatgggcacttccccctgtactcactgatcccaaaccagggcacacaacagtcaccttgacagcttctaaaattacagattt

SEQ ID NO: 139046 - DNA, 271 bp, Homo sapiens
taatttgtgcatgtgggggaaaatgaggaaggatatttacagaaatgttgtcatgattcttatttctgggtgattagactgcagtggagttcctcgccttgccccttctttttacttatttgtttttttcctaagccttctgtggtcaacatgtgttacctttatagaaagaaaacaaccacaataagagctttgtgggaagtgttcagagcaggagattctaaaccttaggagtctggatttagcaacccaattcccaccactgctcgtg

SEQ ID NO: 139047 - DNA, 280 bp, Homo sapiens
agctgggactaaaggtatccaccaccacgcctggctaatttttgtatttttagtagagatggggtttcaccatgttgatcaggctggtctcgaactctggcctcaagtgatctgctcgccttggcctcccaaaagtgctgggattacaggcatgagcagctgtgcccagctggataattatttaataaattggggagcataggaagcatagtatttgtgaagtgggtaggcaggtgtgatgggggtagtgatgttacatttggggcattttgaagttggt

SEQ ID NO: 139048 - DNA, 244 bp, Homo sapiens
tccaaattaatttcttgaaaactcaactgtcccgggctttcaaaccagggggttaaattgatctgatgtacaccagaggccttgggaacgtcctggccagggtaataaatgaaatgcattaaataatcttaattgatacagtaatactcagggggcagctgtattgccaaattgtccctttattcatttctgctcatttagatatcaatcagatttctaaagagagatgcagtgcatctggatg

SEQ ID NO: 139049 - DNA, 294 bp, Homo sapiens
gcctgcaccgcagcccaagctgaggtcacctctccctcgactctcactgggctcccgtctttgctccactccgtgtcccccacatggcagccagacagatccttctggagcagaggctagatcatggcacccctgctcagggccctcatctccctcaaaccccaagtccttaccgtgcctccacggctctatacgatctggcgctggccacatctggaccagcacgggggccattctgccctctcttcgcccctacctcattggagcaagccaagagccctcccagctcagtct

SEQ ID NO: 139050 - DNA, 670 bp, Homo sapiens
ccttattagaggattctgctcatgccagggtgaggtagtaagttgtattgttgtggggtagggatattaggccccaattagaagataactatacaacttactactttccctggtgtgtggcatattcacacttagtcttagcagtgttgcctccatcagacaaagttgtagatgttccttggataatttggactggaagaaaagagacatggaaggggacagatggtgtttagggtgaggcagatgtcattataaagtgacttgtctttcattaattggagcatataattattttacctttgggcatgaactcattttgctattcttcaactgtgtaatgattgcattttattagtaatagaacaggaatgtgtgcaagggaatggaaagcatactttaagaattttgggccaggcgcagtggttcatgcctgtaatcccagcatttttgggaggccgaggcgggtggatcacctgaggtcaggagttcgagaccaacctggccaacacggcgaaaccccgcctctactcaaaatacaaaaattagccaggcttggtgacactcgcctgtggtcccagctactcaggaggctgaggcaggagaattgcttgaacccaggaagtggaggcttcagtgagctgagaacacgccactgcactccagcctgggc

SEQ ID NO: 139051 - DNA, 432 bp, Homo sapiens
aaagacaacagcaacaaaaaagttagaaaaatttatgggctgggtgtggtggctaacgcctgtaatcccagcactttgggaggctgaagtgggaggatcacgtgaagccaggagttcgagaccagcctgggcgacatactacgactccatctttaaaagaatttttttttaaattagctcatgtggcggcacgtattcgtagtcccagctactcacgaggctgagacaggaggatggcttgaccccaggagttccaggctgcggtgaaatatgattgtgccactgcactctggcctgggcaacagagatcctgtctttaaaagcaaaaacaaacaaacaaacaaaaaacttgtgtatttaagtttacaagttccaactcaattaaaatttcattttaagttagtccatatactaagggcccccacagaggta

SEQ ID NO: 139052 - DNA, 465 bp, Homo sapiens
tggacccacggcgggtgtctagggattacataaaaacaacaataacaaatctcatgaaaatttcacaaatggaagtgaaacaatatcacctctattatacagatgtgaaaagagaggcccgatgaggtctagcaacttgccctaaatcatatccctagcagagcagatggagaggcaggattcaaacccagaattcctttttttttctttgagacagagtcttgctctgtcaccaggctggagtgcggtggcataatctgggctactgcaagctccacctcccaggttcacaccattctcttgcctcagccttctgagtagctgggactacaggcacacgccaccacgctgggctaatgttttggtatttttagtagagacagggtttcaccgtgttaaccaggatggtctctatctcctgacgtcatgatccgcctgagtacaacctgccggtggggggatcct

SEQ ID NO: 139053 - DNA, 742 bp, Homo sapiens
cttgcctgggcccagccagtagcctgttgctgttggcaaaaagcctgggccttggagcccgctggccgtcaaggtcctgggcccattgagaagaaggaagaaaggttgggccgcaaactaggagcagctcccagaatttccatggaaagctggaacaatgcctgctgacagcaactttctaacagtaactttcccgacccagacaccacaaagctagcacaacggagctcagatgcaggctaggactcggtccatgcctcaggaaccagggaaagccatcctcacactccctggatccagggaacccacgcccagggccccccagcttgttccctcagtgcccagctcttggctatttctttcacttcattccatcgcccagacaccattaccacatacacattccatccatacccccaggtctcagcctgccctaccttcccaggctccagtccctgttcctcagcatcccccaccacatcctgagtaagctttgtccccagataacctcttcagcatgatccttaaatctccctaagcctcagtttctcccctgtggaatgggggtaagaatctctttctctgaatgcccctgtgttaggaaataatttagaatacttcggaaacaaaaagctctgttcacacctaagcaatcagggcagtggcctggccttgccaggaacttaggcttttatctggatcctctttccaggcctctcaattaattccccaggtccttaac

SEQ ID NO: 139054 - DNA, 525 bp, Homo sapiens
catggggaaacccctttcgggcttttgactcggtccatgcctcaggaaccagggaaagccatcctcacactccctggatccagggaacccacgcccagggccccccagcttgttccctcagtgcccagctcttggctatttctttcacttcattccatcgcccagacaccattaccacatacacattccatccatacccccaggtctcagcctgccctaccttcccaggctccagtccctgttcctcagcatcccccaccacatcctgagtaagctttgtccccagataacctcttcagcatgatccttaaatctccctaagcctcagtttctcccctgtggaatgggggtaagaatctctttctctgaatgcccctgtgttaggaaataatttagaatacttcggaaacaaaaagctctgttcacacctaagcaatcagggcagtggcctggccttgccaggaacttaggcttttatctggatcctctttccaggcctctcaattaattccccaggtccttaac

SEQ ID NO: 139055 - DNA, 1628 bp, Homo sapiens
  misc_feature (37)..(37): n is a, c, g, or t
  misc_feature (92)..(92): n is a, c, g, or t
cgggcgcgagccgccgcagccccgcgcccgctgctcnctgcggagccgttttgtgccgcggcgcgggggaacggggacgcggggcggggggngcggagccggcgggcgcagcctcagcatggacgtgacagtctcggagctcctggagctcttcctgcagagcccgctggtgacctgggtgaaaacttttggcccgtttggaagcggcagccaggacaacctgactatgtacatggatttagtggacggcatctttttgaaccaaattatgctgcaaatagatcccaggcccacaaatcaacgcatcaataagcacgtcaacaatgatgtgaaccttcgcattcagaatttgaccatcttggtgagaaacattaagacctactaccaggatagaccctttttccggtaactaaacttcttgcgggcagacacagcgtttgagttttcgcattggcttcaaacaaacccagtggaagtggacagtgaacaagacacccccgcaggaggcccgggcacggggtgtggctgccaggcctggccatggaaggccatcactgtgggctcttctgggagtggcactgacagccagcaaggagaatgggtgctggggcggagtggaagaaggtgagcttgaggccggagttcctaccccaggaggcaccgtcagcgtcccacttctgctcgtgtgatcccctggaggcacctgaatcaggcagtaaacatggagtgagaaacaccggagtagaagaccttgcaacagcacatgtgtgggcccagttcctagctgccccgggtggccaaggccacatcctgtacacacaggtctgggagtgtctgcatttcagcccttgaccgtgaacttgaccctctggaggtgtccatcttgatgtgatcctctgactgcaacctcatcctctgcctctcagagctgcctccccctgtggcttcttgccctgaggcatgggaggcgttggtgccaggagcttggggtttgagtcaggttggctcggggataagacccagcctttccacacattagtttgtgatgctgggtcatagtgcgtctgtttgctccctgtcaagggaccagtaacatgaggggtcagagaagggatcagaactctcgtgggcctccagtgtgtcgcaagtttttgctgttctgcttttcctcagctgctggtgggaatgcaaattgctgtgctgactttggaaaaactctccggcagtaaagcctaaagttccacatccacacaccgtactgtggcccagctgatttctctcctaagggtatcccggagtaacttctgcacatggatgcctgggacttcacagcccttctgcacacaataacagaaacctggaagccacccagatgcccatcagtgggagaagggatgaatacacgaagacacgatcacacaatggaatattatacagctgtccaaacacattaactgcagcataacttcagtgatgtaggtggattctggcaatatcataaatattagtaaaaatagcatgttcccaatgatgacttacagcactatgccttttaaaaataaagttaaaagcaactacaatgactgtactctctaggaaaatttacaggtgcaataaaactacataaa

SEQ ID NO: 139056 - DNA, 551 bp, Homo sapiens
  misc_feature (37)..(37): n is a, c, g, or t
  misc_feature (92)..(92): n is a, c, g, or t
cgggcgcgagccgccgcagccccgcgcccgctgctcnctgcggagccgttttgtgccgcggcgcgggggaacggggacgcggggcggggggngcggagccggcgggcgcagcctcagcatggacgtgacagtctcggagctcctggagctcttcctgcagagcccgctggtgacctgggtgaaaacttttggcccgtttggaagcggcagccaggacaacctgactatgtacatggatttagtggacggcatctttttgaaccaaattatgctgcaaatagatcccaggcccacaaatcaacgcatcaataagcacgtcaacaatgatgtgaaccttcgcattcagaatttgaccatcttggtgagaaacattaagacctactaccagagatggggtgatgattatgatgaagaaggtgaagaagcagatgaggaaggggaagaaggaggagatgaggaaaatgatccagactatgacccaaagaaggatcaaaacccaacagagtgcaagcagcagtgaagcaggatggtctaccttccgcttccctgga

SEQ ID NO: 139057 - DNA, 597 bp, Homo sapiens
  misc_feature (37)..(37): n is a, c, g, or t
  misc_feature (92)..(92): n is a, c, g, or t
cgggcgcgagccgccgcagccccgcgcccgctgctcnctgcggagccgttttgtgccgcggcgcgggggaacggggacgcggggcggggggngcggagccggcgggcgcagcctcagcatggacgtgacagtctcggagctcctggagctcttcctgcagagcccgctggtgacctgggtgaaaacttttggcccgtttggaagcggcagccaggacaacctgactatgtacatggatttagtggacggcatctttttgaaccaaattatgctgcaaatagatcccaggcccacaaatcaacgcatcaataagcacgtcaacaatgatgtgaaccttcgcattcagaatttgaccatcttggtgagaaacattaagacctactaccagagatggggtgatgattatgatgaagaaggtgaagaagcagatgaggaaggggaagaaggaggagatgaggaaaatgatccagactatgacccaaagaaggatcaaaacccaacagagtgcaagcagcagtgaagcaggatgtatgtgccttgaggccgacagatgggaaggggggaaagaggagaacaaggaagttcgagtcatgaact

SEQ ID NO: 139058 - DNA, 269 bp, Homo sapiens
gcacgtgttggagagagcagctgatgggcgtcccaggtgtgcagttggggtaggctggccaccctttcctcccggtgccagtgcgtagtgtgcagcacaatagtgaaggtcatagtttttccacctgagaatttttggtttattatttttaagagatggggtgatgattatgatgaagaaggtgaagaagcagatgaggaaggggaagaaggaggagatgaggaaaatgatccagactatgacccaaagaaggatcaaaacccaacaga

SEQ ID NO: 139059 - DNA, 1636 bp, Homo sapiens
ctgcctcggggcggaccgggtcccagtggtcactcctgtccctggggtttagccactcccgaaaaggaccccattcttcccaaccaaatatctcatgtagtttttctgaatccctgagaccagccggtggatggcggtgacgggtggggaatggggggcgccgaatgggaaagcgaacagactggggtgaaaacttttggcccgtttggaagcggcagccaggacaacctgactatgtacatggatttagtggacggcatctttttgaaccaaattatgctgcaaatagatcccaggcccacaaatcaacgcatcaataagcacgtcaacaatgatgtgaaccttcgcattcagaatttgaccatcttggtgagaaacattaagacctactaccaggatagaccctttttccggtaactaaacttcttgcgggcagacacagcgtttgagttttcgcattggcttcaaacaaacccagtggaagtggacagtgaacaagacacccccgcaggaggcccgggcacggggtgtggctgccaggcctggccatggaaggccatcactgtgggctcttctgggagtggcactgacagccagcaaggagaatgggtgctggggcggagtggaagaaggtgagcttgaggccggagttcctaccccaggaggcaccgtcagcgtcccacttctgctcgtgtgatcccctggaggcacctgaatcaggcagtaaacatggagtgagaaacaccggagtagaagaccttgcaacagcacatgtgtgggcccagttcctagctgccccgggtggccaaggccacatcctgtacacacaggtctgggagtgtctgcatttcagcccttgaccgtgaacttgaccctctggaggtgtccatcttgatgtgatcctctgactgcaacctcatcctctgcctctcagagctgcctccccctgtggcttcttgccctgaggcatgggaggcgttggtgccaggagcttggggtttgagtcaggttggctcggggataagacccagcctttccacacattagtttgtgatgctgggtcatagtgcgtctgtttgctccctgtcaagggaccagtaacatgaggggtcagagaagggatcagaactctcgtgggcctccagtgtgtcgcaagtttttgctgttctgcttttcctcagctgctggtgggaatgcaaattgctgtgctgactttggaaaaactctccggcagtaaagcctaaagttccacatccacacaccgtactgtggcccagctgatttctctcctaagggtatcccggagtaacttctgcacatggatgcctgggacttcacagcccttctgcacacaataacagaaacctggaagccacccagatgcccatcagtgggagaagggatgaatacacgaagacacgatcacacaatggaatattatacagctgtccaaacacattaactgcagcataacttcagtgatgtaggtggattctggcaatatcataaatattagtaaaaatagcatgttcccaatgatgacttacagcactatgccttttaaaaataaagttaaaagcaactacaatgactgtactctctaggaaaatttacaggtgcaataaaactacataaa

SEQ ID NO: 139060 - DNA, 832 bp, Homo sapiens
  misc_feature (37)..(37): n is a, c, g, or t
  misc_feature (92)..(92): n is a, c, g, or t
cgggcgcgagccgccgcagccccgcgcccgctgctcnctgcggagccgttttgtgccgcggcgcgggggaacggggacgcggggcggggggngcggagccggcgggcgcagcctcagcatggacgtgacagtctcggagctcctggagctcttcctgcagagcccgctggtgacctgggtgaaaacttttggcccgtttggaagcggcagccaggacaacctgactatgtacatggatttagtggacggcatctttttgaaccaaattatgctgcaaatagatcccaggcccacaaatcaacgcatcaataagcacgtcaacaatgatgtgaaccttcgcattcagaatttgaccatcttggtgagaaacattaagacctactaccaggaagttctccagcagctgattgtaatgaatttgcccaatgttttgatgattggcagagacccactgtctgggaagagcatggaggaaatcaagaaggtgctgctgctggtgctgggctgtgctgtccagtgtgagaggaaagaggagttcattgaaagaatcaaacagctggacattgagacccaggctggcatcgtggcccatatccaggaggtaggtgcgtggcctcgtggtgggctcagctgtggactgctgctcctgtggtggccgggaggcaaaacttctctatgagtggaaacgtttgaagaatacatcacccattacgattttgctaatcttaggtttcagacaccacagacacattgattctatttggaaagatagccatcaatcagccagctaaaataaaatgagggtaaaaataaaaattaaaaaaaaaaaaca

SEQ ID NO: 139061 - DNA, 326 bp, Homo sapiens
tgcctttattgggatggacagctggagtaaacatcatccagaaagactgggactctgggtcctctcaaacccagcacacccgcaccacgaataccagcccccagcaagaaacctctaagcactttgggccaaagcggtttcagtttgaaaccatgatgaatttaacataaatcaagaaaagcaacagaagcaacttttcccatctggaatggagtacagccttctattttatgctatttgtctaccctgtcactaactgcagagaaaacgttctaaaaactgccctttgtagcctcaagccatttccctagggctgtttgacttaa

SEQ ID NO: 139062 - DNA, 250 bp, Homo sapiens
caggcatgctctagagagatccaccacggactgacgactgataaatgatgagttcaatgccagcctcagaacgcagcacctgctttatgtcctcctagaggtgcgctaccatgcccacttcatgtagcatttgcatctttagctcaggcagccagtcagcccaggctggtctcaaactcctgacctcaaatgacccacccaccttggcctaccaaagtgctgggattacaggtgtgagccaccatgcctg

SEQ ID NO: 139063 - DNA, 435 bp, Homo sapiens
aaatgaaaagaatcaccttagcacttggaaaaaatgagtaattatttattgcataaaggaggaaaaacaagttaacagtcaggatgggcaaagtgtacataaccacagaggtgggtagcatggatttacctgattttagttcaacagcttcatagatctaagcttcaaaaatggcagatgcaccgtgtgtgttattcgggccaaacatgtgtaatggaatgctaagtggagagaaaaggtcagagaagtgataggcaccctgaggccgtcattctttatctgttcaaatagttacctcattttggcttttggccctggggggcaggctccggagcctcaggtgcgtcagagttaagctgtttcccaccccggaacacgcaccggcatttcagccttcacttgctcaactccagagccaggacgctccagagagga

SEQ ID NO: 139064 - DNA, 492 bp, Homo sapiens
ggaaaagtctacaaccattatacaaagcatctgatccttgtgtcagtataccaatattgtttataataaataagaggtaggcagcatgtcataatgaaagaacaaaggtagtcagaactgaggtttcatcataaatgtatcacttattttttgtgtgaccttggacaagttacttatcacagcaagccttggctgtctcatttataatacagtggtaatacctatctaccttgtagagttgtaagcactagcaataatgtgtagaacacacctagaactattattaatatattaattggagctactaacataaataaaaactataatttctgccctcaaaagggttagcaatgaggaggtgttactgagatattccacggacattatttcttttattccaaaggcaatctgatgaatacctcatgcccatttcaaggtgactctgatttcacttcacaatacacagctttccttttgttgttgttgttgttc

SEQ ID NO: 139065 - DNA, 315 bp, Homo sapiens
atgtgcatctatctttctgtgtggctgtgacccattctgggtgattgcataggtgcattcctgggttgcgtgtcctggcactgtgcgcgtttttgtgggtctgtgtgtggcccaggtccgtttgcctggccactttttcctctggggttgattgagggcactgttgccctcttagcctgcagggttggcctggcttgtcctaggctggggccttgggcctctgagcaggtcagccctctgtagctgcagggatgaccctctggtcgcgcaatcttgcccaccatctcttgaagaacccgtcaaggcctctggtct

SEQ ID NO: 139066 - DNA, 800 bp, Homo sapiens
ttctgggcttaagctatcctccctcctcagcctcccaagtagctgtggctacaggcatgtgacactgtgccaagccctatgtatattatactacaatagcatttgcaagaaaaacgaacagttaaaagtttaaaaatttgtatgttgatgtaatttcacaacagtaacaggggtctatatatagttgtaagacttctttgttttacttgaacttgtgaaatatcgactcttaagtaagtagactgtgacaagttaggtttgtatattgtaatccctagagcagctactaaaatgcagtacaaagatagttgaaaagtagataaattaatatggaatactaaagtatattgaacagaggggaggggcacctcaccaaagaaagtacacagatgtcaaataagcatatgaaaagatgttccacattatatgttattagggaattgcaaattaaaacaaaaatgagataccacagcacagctattggaatggcagaagtccaaaacaatgacaacaccaaatgctggtgagaatgtggagcaacaggaacactcattcattggtggtgggaatgcaaaatggtacagccactttggaaaacagtttgacagtttcttataaactatatttttaccatatgatccagcagtaacaacttcttggtatttacctaaattagttgaaaacttatgtccacacaataacctgtacacagatatttatagcagctttattcataattgctaaaacttggaaacagtcaagatgtccttcagtaggtgaatggataaactatggtacat

SEQ ID NO: 139067 - DNA, 286 bp, Homo sapiens
cccggcaggtgagaggaagaaagtgtggagaacggtgcacgcttacatgatcctggcaggtgagaggaagaaagtgagcagaatggtgcatgctaagatgatcccggcaggtgaggggaagaaagtgagcagaacggtgcatgctaacatgaagccagcaggtgagggaaaggagaacagatttgttcatagcaatgtcagtatccattttggcacataaagatttttgatgagccctgtttgcatagagccagatgttttcccctccctgtcgggctagtcgggg

SEQ ID NO: 139068 - DNA, 502 bp, Homo sapiens
gatcaacaactacactctagaataatctcagctgccagtaagccagaggggcttggagggtgaggagtccctgtgataaccaagatcaagttctaaaccagccagcaggcctcgcgaggctggctcacctttcaggctgctggtgttggaaacatgagactgtgcctctcagcccaggcagggccctgcctggggtcccacagcttccaggagccagtagggagcccagagcctggcaaggccagcaagtagggaggggatactgcttggcaggaagtcctcaggagggagtgtgaggcttggtctgcctagatcattacagcccagggctttctgtacctaggacttcagtcccaaccccgctgaccccatcttaaagaggacaaggaagggatatctgcagctggaaggagggatatctgcagctggaaggagggatatctgcagctggaaggagtgtgccagcttgaacagtgacggggcaccactttctggaaaatat

SEQ ID NO: 139069 - DNA, 344 bp, Homo sapiens
ccagctttatacttcttctaatattgaataatgtgttcataccacatctccccaggtaatgggtctaaatgagtaacaagctcagtatgtcatcactttctttacaaaacactgcatttactaaggcttgaatcagtccttattagatataactttaacgcagttttttcattaataacaagaaaaacagcaccaaaatatcgtattttctgaagatattatgattttaactacagaaaggcaaaaatatcttccaactccctaattccatttcagtggtgacataagtgatatatagtagtggttaacatacaaagacaagtacactgtaacactatacatct

SEQ ID NO: 139070 - DNA, 298 bp, Homo sapiens
gatatcatcaacagtgaaacaaaaaaacaaacaaaaaagacaccctccgcccaaaaactcccctcttaccaataggctttgattatattcctctgagatatttaaacagaatcttttttttttttttttgagacggaatctcactgtgtcgcccaggctggagtgcagtggtatgatcttggctcactgcaacctccacctcccaggttcaagagattctcctgcctcagcctcctgaatagctgggactagaggtgtgcaccaccatgcctggctaatttttgtatttttagtagaa

SEQ ID NO: 139071 - DNA, 426 bp, Homo sapiens
agggacacaatgtgggatgagtcttttgaaggaaaagatgatgcaagtgaactgtgatagtggcaggagcatagagaggagtgggaagactgtgagacacttcctaggaagtgtttacaggacttgattattccccagaggtgagaggtaagagagagaggaatggaagctggctcctaatttgtcataatatgaaactttgagcatgttgtagcttttgaataatgtaagccccagattaacaaaattaaaaatgggaaactggagtcttttctattttccaaaaatctcccaggaaacaaaattatgcctgtaacttgtgtggtctttagctattgtgcatttttttttttaaaccactttgagtgatccttataaatacacaaatgccggtgcaaacagggaacatgaaaaccaagtgagagg

SEQ ID NO: 139072 - DNA, 523 bp, Homo sapiens
tgggctcaagtgatcctcccacttcagcctcccaagtggccagaactataggtatgcaccaccatgcctggctaattttttagtacttttttaggggcaaggtcttgctctgtgtcctgggctggtctcaaatgccggcctctggtcttcaaatgaccctctcgccttagcttccagagtatctgggattagaggtgcagaccgccatgcctggctaaaaacagatactgtaagtgtaatgtaaatgtaattagatattgtaaattgtaaatgaaagaatgctgccaattaactttaaggtgtaagatggcaactgagactatcaggaataatcaggccaaaagtcctgtgtgtcaaggatgggttttgcaactggtgtatgccactatagaggtatttgactagctaaaataataataatcagatatatttgaaaaagaaccatttcatcagtttagccatccacagtttatacctacttgaaaacatgctgtgcatgataaatacaatttttatcaattaa

SEQ ID NO: 139073 - DNA, 811 bp, Homo sapiens
  misc_feature (798)..(798): n is a, c, g, or t
ctgaggaaactctgagggccatatctttaatatgtaaatacatactgctgtctttgataaaggaaggatatagcacctcctataggaaagaaaggatcccttggctcactgatgaaagctgaatttccttaataggaaagaaaggatccattgactgttactgatgacagttggatttccgtattagaatagataagctgaggttgtccagggccaaattgtgtagctctttgatgcctgttgggtaaaaatgtgatttgaaaatggaggaaatttcaggatgaattaattgagaatcttctggttgagaagagctgctttaacagccttaacaggaggaattagtgtctttctctttgctgtatatgatggacagaactcatatactaaagatgggtgattgatctagttcagagaaagaaaaatgtgtaaaacatttaaaaagttggtggtcttcctatttcccatatgttgtcataaatgcttcatgtgtactatattatttaagcttctcaacaaccttgaataagagactacatgtctgttgtagatgaggaaaaagatttaagtgacctacctgaggttgcatagctcataacagaatcagatctaaaattcagctgtgtttaacaactcagctttttaatcatttttagcatgtgcaatattttttctttatgttctttaatttcttttcgaatggtagagaaaagcagtgggaatggaagttacacataacctacagtatcctatctcatccacagaagcttatgtggtgagaagaaatgtttgagaaangctagtgccaatg

SEQ ID NO: 139074 - DNA, 895 bp, Homo sapiens
ctgaggaaactctgagggccatatctttaatatgtaaatacatactgctgtctttgataaaggaaggatatagcacctcctataggaaagaaaggatcccttggctcactgatgaaagctgaatttccttaataggaaagaaaggatccattgactgttactgatgacagttggatttccgtattagaatagataagctgaggttgtccagggccaaattgtgtagctctttgatgcctgttgggtaaaaatgtgatttgaaaatggaggaaatttcaggatgaattaattgagaatcttctggttgagaagagctgctttaacagccttaacaggaggaattagtgtctttctctttgctgtatatgatggacagaactcatatactaaagatgggtgattgatctagttcagagaaagaaaaatgtgtaaaacatttaaaaagttggtggtcttcctatttcccatatgttgtcataaatgcttcatgtgtactatattatttaagcttctcaacaaccttgaataagagactacatgtctgttgtagatgaggaaaaagatttaagtgacctacctgaggttgcatagctcataacagaatcagatctaaaattcagctgtgtttaacaactcagctttttaatcatttttagcatgtgcaatattttttctttatgttctttaataaacattaattttctacttaaaaaaaaaaaagggggggggtctaaaagtatctggagggccagtttggtacagtttttgacaagggcatagggggccatataaaaggcggcgggttaacggtggtggaaaagcttggattgggaagaatcgggggacatggaacccagaaacctgggaaaaaggcggccaccattcggaaggaata

SEQ ID NO: 139075 - DNA, 367 bp, Homo sapiens
cagaaggtgtcaagtaagtaatagtttggggagcttaaagtgcatggagggtacatggcaaaatattaggcaagttagtcaggggtcatgtcagttaagagcattttatgcctaagagtgggcttaaatctttgcaaacaggacatgcgagccagagaagtgttatgaaggaagaagaggcataagaaggctccctcttgagataatctgaagaattggccagattgaaaaccttttaaaatcaaaacccctgatttgttgataaatcttactgttcaacctataggttccctttggaaattgattttgaaaagtgaaaaattccattataatgttaaaaagcctcttccaatttgtccattttgta

SEQ ID NO: 139076 - DNA, 384 bp, Homo sapiens
tgggaccaaatcttacctcagaagcttgtgtgaagatgaatgatctcgggtatttaacgcatgtagcgcagtgtctggcgtgttgtacgtgcgcagtgaacgatagttctctgggtctctgttcttgccccttgtttgtcagctggcgtgagggccagaggataagtttttctccctcaagaaacgaaccaacattttccaagttgctaactgcttctccatattagatttttgttaattttctgaccagtgggtgaggtgggatatcagttttgcttgttatagataatgggctaagaccaggtgtgatggcacatgcctattgggaggccaaggcaagaagactgcatgaggcctagggaacatagtgaggctctgtctcta

SEQ ID NO: 139077 - DNA, 431 bp, Homo sapiens
cgtaccgcacgagttcggagttgggggtgtttgggaggaggattatgaattccactttggctacactggctgacaggtgcatgtgggacatccatgtggagttgcagaagtacttagatatgagtctggagcccaggagtggtctggaactgtacatctagtagtacatatttgggctgggagatgaaaatggaggccatgggcttaggtgagctcacctagggagaaagtatggtattagaacagggccaaggaatgagcactgagaaaatctaccatttcaagctggagtgggagacagtaacagaattggggagatatggaagcaggaatgtggtagccaggttccacgttggcctccaatgacaccacctcctggtattcatatccttgtgtagtctcctcccacactgaatacggctaacctgtgt

SEQ ID NO: 139078 - DNA, 270 bp, Homo sapiens
acctccccctgcagatcttgggatttgtcagcctccataatcacatgtgccgatttcttacaataaatctctttatgtacatcccattggttctgtttctctggagaaccataatacaattgtcaatcagtccaaattaatttataattttaaagtgagtaaataaaaatctcacttggagaagataaaacaattctaatattcatctgaaaggataagccagtatgaatagtttttaaaaattaaaaagaggaatttacatgtggctat

SEQ ID NO: 139079 - DNA, 212 bp, Homo sapiens
tatgtcctatataacttagcctaaattgtttaaaccaagtatgataatattataagaagatattaataaaccaacgacatgggaattttggattaacctctcgcaaaaactgaaattatatgaaaatcaattacaaggacttacgaataatatcaaaattctaaaaaccacaaatatgtgttttcagaaacaatattacaaacttttctcca

SEQ ID NO: 139080 - DNA, 519 bp, Homo sapiens
acatttcacctgacacttcaaaaagattggccatcaagggattctggcaagagccctgatgcctctggagtagattacagaagcattccttgaaaccttaggatgtgagcataaaataaacacaaataagctccccttgtctaaataaaccaaggtacagtttgatgaggcagttttcgttttctccctaccccttccacacttctctcctcaaaggccaggcttgtttgcttacttatttaatactaaaccctttgtaccttcaaagaacgcctttgtgtctgagatgaagtggagcatttctgcctgctggacacaattttccaaatgaacctccaaacacagagtagcccagattattaacaataagacaacctcgcaggttggccggatggatgaaatgaacaggaggtaagaaggaaaacatgaaaaaggatggattttcagcaggtttttccagccaaaccatttgcaattccactggaaaggattctcagggggaaagaaaccaaagaacat

SEQ ID NO: 139081 - DNA, 342 bp, Homo sapiens
ctccgtaaagaggtgtctttactataaaagctatagtgtaagctagtcatattaaattgttggctcaggagttcgataatgcttgggcagtgagagtgaataataaaatgttcaatgagcctagggtgttgtgagtgttaatcagtgcaatgagtaagggaagggagcctactaaggtgtataagagaaaatgtggctgagtctctgttgtgaccagccctacccagtagggccctgaaatagcattttagacctgtctctaatagcattttagacctgtctctaaattctcctctgtctccttctgctcctcttagtatacctacccagtactgagccaga

SEQ ID NO: 139082 - DNA, 423 bp, Homo sapiens
atactcccaaattaatgctttttacctattgtcccttggattaagtaaattcaacttgactcaactaaatcttaaggtttgacaccctgacaaacatgtcttaaaatgttttaaagtacataagatttaaaaccttggccaggcatggtggctcacgcctgtaatcctagcactttgagaggtcgaggtaggtggatcatctgaggtcaggagttcgagaccagcctggccaacatggtgaaacccgtttctactaaaaatacaaaaataactgggtgtagtggtgcatgcctgtaatcccagctacctgggaggctggggcaggagaattgctggaacccgggaggcagaggctgcagtgagccaagatcacgccactacactctagcctgggtgacagagcaagactcagtctcaaaaaaa

SEQ ID NO: 139083 - DNA, 521 bp, Homo sapiens
ctctctaactcccttggctcattctaacatgcaaaaacttgctttttattgttgtttactttaaaaaaaatattttgcattgtgaaatataatgtacacacagaagaataaacaaaacaaagtaaaaagcttaattattccaaagtgaagatctatggcccaggtgcagtggctcacgcttgtaatcccagcactttgggaggccaagttgggtgggtcgcctgagaggtcaggagttcaagaccagcctgaccaatatggtgaaaccccatctctactaaaaatacaaaaattagccaggcatggtggcgggtgcctgtaatcccagctactcaggagattgagacaggagaattgcttgaactcgggaggcgcaggttgcagtgagccaagatggtgccactatactccaacctgggtgacagagcaagactctgtcttaaaaacaaaaacaacaattcttctgaggggtaactaccacagactggttataacatattaagcatctggccagacaaagg

SEQ ID NO: 139084 - DNA, 234 bp, Homo sapiens
aatatagtggaatgtgattaaaatgtctttagacacgtgaatacaaactcacttgaaaaagcagttcccaagatggaatagacattaattcattatatataatatttattatgtataatattcatgtatataatatttacttatatgtaatgaatatgttgtttgtaaaaccttaggatgcatgctaatcaactgtgatagagtccatttaacactgagtgttgtggcaagtcg

SEQ ID NO: 139085 - DNA, 489 bp, Homo sapiens
agtaagcctaactttgaccaacagagggtcttaaagacaacagggcagcagactctgccagacactgtggcaatccacagtgagcttctcctggtctggctgcattcccctcacacatctgctgtgcaccagccccctcaaccttccctgtgaacactagcttagaatcaaaatcaaagcattactcagcaggccatcccatcactccgctgtgtcttccccaggctgctctgtggaagggtcagtcaagatccctcttaatgccggggagagctgtccagagtctgcaggaggccctctggcttcagagggcccaggccaagtgaaggtcaccctgcactgtgttgggcatttacacacaatgctgggggctgccttggctcacacaccagcctcacccatggggctacactcagtggcatcagcaagcagcatctcctcaaaggcccagattacaaagtaaaggcacatggccaggtgcagaggctc

SEQ ID NO: 139086 - DNA, 498 bp, Homo sapiens
ctcactatacatttgttaagtaaaaagctgtcttcgtatttaaaaggtttcattagtactttataaactcaaggctttcaaataccaccacccttaacaaacacttactgaaagagtaaatagcttcttgctaatacagcatatatccaaaagagataactgaggagaacagcaaatcttcctatatgcttgttgctttttatcattatcaatatccacacaacaccagcctagcaaaaccctgacaggatgatgtcctcaatgatgtacagcaggagagaaaacccattctccagcaaggacaaataacccacagggaagggggagcacaaaggcataaagggcagctttctgtcgtctgaaaggcgatttgttttagaggaacaggaggattttattgttcacctgatgtctttcattaagaacaggaaactacacttctctgaatggttcaactccccattactccatggagtgctgcgggggccctacccaggg

SEQ ID NO: 139087 - DNA, 184 bp, Homo sapiens
tgctaatgttttcttaaattacatcctcttgtgggtccataaaatactaaagttattacaaataaataaatggagtttctcttcatgatgtaaagcagctttcaatgaagtcattgagaggaagtttggtttggaaggaagcagtgcctaaccagggcaaagcactgctttccacccatggggg

SEQ ID NO: 139088 - DNA, 810 bp, Homo sapiens
gttagtttcaagagtcctaaaaatgtcaactctgaccatttttgccgatgttcctgttttcacagaggagaggatcttgagaggggcttactccaccatcttcactgacatcactccaagaaatgtattttgcaagaaatattttgaagcagaaagacaccatttattttgcccatgaattagaatacattagagaaaataagactatcccttgctggcaagaacacagtgacacagtagggtggaatataaattggcacatttgtggaaagcaacagtacatatcagtcaatgtttttgagattcacattgatgcgttaattttacaaatagaaatagggcctaaagaagtcacctcaaaaggcatgaacgctccatgaatgtatccatgcagggatcatagctgagcactggatgccccctgcacgtccgggggcaggaaacaggacagggcagagctgcgtcacagggcaggacagtctccgttagacggagaatcctccgtagagctgcttgcacgtgtacattcatctttttgtcagatgttaattcaagttgcctttggttgtgggactgggaggatcttttctctttgttgatactttttcgtactttccaaatacttgactgatgagcacatgctgccttggttaccggaggataagtgagcgagcaaagtgaggcctgtgctgtgtccatcctggtgcctcaagcacaagcccctattcctgccctgagcccagctgccggcatgtccggggagaaggcttctcccagctccggcattgacttctatctgctggaatcatc

SEQ ID NO: 139089 - DNA, 220 bp, Homo sapiens
gaagttgccttaacctctgtgtacctgttttctcatctgtaaattggatgtgataacagcacctttgtaggctgtgtgtggagtctttgagaaggtgtataaagagctttcagtgcctggttcatagtagccttcaatcgttagcttatatgaatcaggaaagctagtatttattagcacatacaaatgtgtcaggcactatgctctgggcttcctatca

SEQ ID NO: 139090 - DNA, 330 bp, Homo sapiens
tgagtgatgcagggagttcagtgagaggaagctggggtgaagactccattgattgggggtgtgcctcgttgctgacttgagccggagcagtatcagtggaaggaggtcagtgggagatgcttgtagtgggagggaatgaaaatgggaatggagcgaggagtcatccagagatgactaagaggatggcctgggggagccatcagggtaccaacaggaggcaggtggcatgctcaaatgtgtgactagagaagctaaggaagagaccctttgtaaaagtatgttctggtctaggtacagcatcaagtcatggtgtacctgtgggaccgaggg

SEQ ID NO: 139091 - DNA, 567 bp, Homo sapiens
tagcgaccaaaaggtgaaaacacatttatgttcacctttcatatgaagtatgaatgtgtttttttgtaattttttttcaatctaatttgaagtagatggaggaaaaataataaaaaaagagataacattgtatatattacattattttctttattttgatttctctgcaactgtgctactattgtactccaatattccttactcaatccttgtctgctattccagtttcctttttactagcacatgactatgatcctaccagagttttaagatgttgatagacatacaaaagcacttattatttttgcatgtgatattaatagaaagatagaaaggatctcactataggagaaaaatcaatcaaggctcaaacttatcattaaatgagaattctggccagaatccaatactttttttttaatgaaagaattcaaagccttacaatttaaatttcatcatcaagctatatatagagaagatgggaggccttggctcagcagaagatcatgtaaaaatttcatatctagaatattaaaatgactgctgaagcaggtattctggttgata

SEQ ID NO: 139092 - DNA, 395 bp, Homo sapiens
attctttatatgtgtgccatccataaaatctaattgtatggatgggctgtaatttagtctaatcagtgtcttattgatgaagcttattttaaagccttgtacttttccagctgataattaggtacttgaagatttgtgactgttacatctcatgaactataggtttattcagaatggaatattgctaccacatttaatgttttttgctttgaaatttatttgctagcaatgttactgtatatgcctttttttttaatttttatactttctatgacatttaatttttgatatggctcttagaaacacatagctagattttgtggttttactcaatctgttattaatacattcatatttgttgtatttatttatatgtttgggcacacattattcct
